United States Patent 12,583,896 (CAGED-DEGRON-BASED MOLECULAR FEEDBACK CIRCUITS AND METHODS OF USING THE SAME) - sequence listing, part 2

SEQ ID NO: 15277 - protein, 241 aa, Artificial Sequence
  Synthetic sequence.
SEKELLKEILDRIRELLEDDNRLLKRIVDEIRKLLRDHMVLHEYVNAAGITLLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 15278 - protein, 241 aa, Artificial Sequence; identical to SEQ ID NO: 15277
  Synthetic sequence.

SEQ ID NO: 15279 - protein, 246 aa, Artificial Sequence
  Synthetic sequence.
SEREELLERIKEILKRVKDKLDEDLKRLKEILEKLRDHMVLHEYVNAAGITEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETVRELIERLKRVLEEAIEVVERVAR

SEQ ID NO: 15280 - protein, 240 aa, Artificial Sequence
  Synthetic sequence.
DREKSVRDIEEDLKRVLDKLRRRVETSKEELKKVLRDHMVLHEYVNAAGITVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 15281 - protein, 243 aa, Artificial Sequence
  Synthetic sequence.
SEAERLADEVRKAVKKSEEDNETLVREVEKAVRELRDHMVLHEYVNAAGITRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 15282 - protein, 245 aa, Artificial Sequence
  Synthetic sequence.
SEKDEVTRRIRELLKEAEETNREAIERIKRLLDRVRDHMVLHEYVNAAGITRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 15283 - protein, 245 aa, Artificial Sequence; identical to SEQ ID NO: 15282
  Synthetic sequence.

SEQ ID NO: 15284 - protein, 249 aa, Artificial Sequence
  Synthetic sequence.
DAEEVVKRLADVLRENDETIRKVVEDLVRIAEENDRDHMVLHEYVNAAGITIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 15285 - protein, 240 aa, Artificial Sequence
  Synthetic sequence.
SKEETLKRLLDELEKRNRETVERLERLLKELEDRNRDHMVLHEYVNAAGITKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 15286 - protein, 240 aa, Artificial Sequence; identical to SEQ ID NO: 15285
  Synthetic sequence.

SEQ ID NO: 15287 - protein, 243 aa, Artificial Sequence
  Synthetic sequence.
SEAERTKESLKKVLKALVDLNRELLRKLEENMRELRDHMVLHEYVNAAGITKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 15288 - protein, 186 aa, Artificial Sequence
  Synthetic sequence.
SAEDSIRELLERDERLLEEARKEAKRLNEENERLLERDHMVLHEYVNAAGITLDDIRKKIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 15289 - protein, 178 aa, Artificial Sequence
  Synthetic sequence.
DEVEKLLRDLEELDRDIERKVRELLKRNKEVLDDIERDHMVLHEYVNAAGITVADVIRKTTDKRTVDKLLKELEKILKEVLDRVRRLLEEAKESLDRSREEIERLLEESKTLVDEVRRAGIDKKEVDKIEKHSRDLIERAKRETDRLLEEAERLMREVVDRVRKILEEAKRLIDEARR

SEQ ID NO: 15290 - protein, 182 aa, Artificial Sequence
  Synthetic sequence.
DEAEKLLKELRDLLEESRKDLERLLKELEDLLEESKRDHMVLHEYVNAAGITIKETVERRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 15291 - protein, 182 aa, Artificial Sequence
  Synthetic sequence.
RVEDALRKLLDDVRRLVEEAERRLRTSNDKSRRLVERDHMVLHEYVNAAGITVRDVRRRIRDEDVKRVLEELLKRDHDVVRRVLERIDEMLERNSRLVKRVLEDIRRLLKRVREVVERIKRVRSKVVEEVLKELEELIKTAKKIIEDVLRASEDTIRRLEEIIRKVEEDSKRIIEEIERAAR

SEQ ID NO: 15292 - protein, 184 aa, Artificial Sequence
  Synthetic sequence.
SLEEVIKTVRKLLEEVERRLREVVERAERMLEEVRRRDHMVLHEYVNAAGITEKALRDKNVSEEIEEKLRKIKEELERDNEKVNRDNERSVETLRRLLDRVRKEVKDIAKELEERLKEVERKSRDDRIVEKLLRDAERIVKRLRELIEKLREEVEKIVDENRKTVEELRRRNEEIVRRLRREIE

SEQ ID NO: 15293 - protein, 177 aa, Artificial Sequence
  Synthetic sequence.
ELREDVERVVDEIRRLVEENVRRIDEVAKDIKRLADRDHMVLHEYVNAAGITIRRLKEEGVTEVVDELREEVRKLSEDNRRHSRELIERVKKLLKELEEHSRDLKRRVKELLEDLKRKGVDERVLKKLKEVIEDVERKSRDALRRLEEAIRRVRRESERVNRELDEVIKRVTEELKK

SEQ ID NO: 15294 - protein, 174 aa, Artificial Sequence
  Synthetic sequence.
SEDETIRRIVRTVHEESRKSTEDVRREVERVLRESERDHMVLHEYVNAAGITVEETGISEELEERMRRIIREIREHLKDNLRRVREVIERIERKLEETERRDEKVLREIEKKIRDGDGREEVAREVTKIARDTIRENEEIAKEVREIVERSIKNLEEVAEEVERVVRELIEARR

SEQ ID NO: 15295 - protein, 174 aa, Artificial Sequence
  Synthetic sequence.
SRDEKIRDILRRVLKEVRDSTKKVEEDLEDVHRRTERDHMVLHEYVNAAGITVRDEGASEELKRRMEEVVRRIEELLKKLLKEDRDVVKEIRDKLDETRKEMEEVAERIKDKIRRGDGREKVAEEVKRIADRLIDLNRRIAEEVDKIVRDSIKKVEEIVTEVEKIVEKLIRDVR

SEQ ID NO: 15296 - protein, 170 aa, Artificial Sequence
  Synthetic sequence.
SEVEDVVRKVEKLVRDLIKHVEENVRRVEEVVRKLIRDHMVLHEYVNAAGITLAKEPGSEDLLRKLEKVLKEIDDKLKELEDRLRDMVRRSRESSEENERRLKRVEDEVRRNGISEEVEKVLREVVKEVEKVNRESREVTRRVLEEAKEMLERVKKIVKEVIEKVRRVVK

SEQ ID NO: 15297 - protein, 173 aa, Artificial Sequence
  Synthetic sequence.
SLEELLEEARKTVERLIRESERVLRESEERVRRLIERDHMVLHEYVNAAGITIERVEDEEALKELEKLLREDSKRVKEVLDDLRRDLERNKRRNEKVLRELEELLKRLEELVREGVREEELEKLLREIEERVKEMLKRDEDTLREIERKVKEAVRDSERTLEEIEKRVTEEKT

SEQ ID NO: 15298 - protein, 174 aa, Artificial Sequence
  Synthetic sequence.
SELEKVVKEVADLLRRNLEKSKRVLEEVRRRLEENLRDHMVLHEYVNAAGITILELVREGKDKRDLTRLLEEDDKRVKEALDKSRENNERILKEVRRALRESEEDNRRILKEVREKVDSRLLEELEERVRESIERSRRFIEELEKIVEETLTESEKLARASSEITKTVLDEIRK

SEQ ID NO: 15299 - protein, 180 aa, Artificial Sequence
  Synthetic sequence.
STEEVLDEIRKLHKTLTEDIKRVLREIEELHRRTIERDHMVLHEYVNAAGITIDDVRTKDTPNVEKLLKDLEKSAKENEEHNERTLREDDRVLKEIRRRATELLKANEEMLRRIEEVMRAGKVDAEELLRESKEAIKEVKRVLEELRKESKRVVDETRKLSEENLEHSERVLRKVEEDLR

SEQ ID NO: 15300 - protein, 180 aa, Artificial Sequence
  Synthetic sequence.
SKEEVLREIERLHKETIRRIEEVLREATELHKRLTERDHMVLHEYVNAAGITIEDVRRADTPNVEELLRELKDALDKVRDHNRKTLKKNEDVVREIEKEVRELLKEDEDVLRRIEKVMRDGRVDARELLEESRREVERSEKEVERLLRKSRKVVEEVRKLSEENDREVKKILEEVKRRLD

SEQ ID NO: 15301 - protein, 178 aa, Artificial Sequence
  Synthetic sequence.
DDLERVLKEIKKAADKIREDNKRTADKIRKRVKELDRDHMVLHEYVNAAGITIKERVRGREEARKVIEELKKLVDEVRKRNEKSIEELKKLLKEDRDLMRRVIEELEDLVRRLREEVRDDEALRRVEEEVERLIRDLRRVLKETSDRVRELIDKHRRLSEEVEKDVKRLIDELKKKTD

SEQ ID NO: 15302 - protein, 187 aa, Artificial Sequence
  Synthetic sequence.
SEKETVRDELRKLVETIRKLLEEDKESDKRLADRIRRDHMVLHEYVNAAGITLEKVLEELRKKVSEDELRKLRKRIEDLRRRDEELNKRSREKLEDLNERNKDSLRRIEDELRKLVEEAREVEKRDNDEERLRKLLERLERVIRDLLRKIEENNKRLRKAIKELLDELRKINKELREVIKKLLDDAR

SEQ ID NO: 15303 - protein, 175 aa, Artificial Sequence
  Synthetic sequence.
SEEDELRRLLKEVNERVERLLDEIRKELEKIAEELRRDHMVLHEYVNAAGITVEENRVDEEIKKDAERALTELKEEHERLDREAKKDLDRIRKELERLEEEHRRVSERIEEVLDKESDKTEDIAREIRELMERTRRVIEEIKKELRDILEKLRRVSEELNKKLDEILKRIEDRTR

SEQ ID NO: 15304 - protein, 171 aa, Artificial Sequence
  Synthetic sequence.
SEKEKVIKEARELLERLRKRLKDVNDDVTRLLDELRRDHMVLHEYVNAAGITLEEEVPVEDVIRELKRRLEEVDKKNRDILETLKRELDEVSRRTREELEKLRKELEEVEKAGLPAEELKRVADRLRRRLERLVEENERVVKKILDEIRRSVEENKRIVDKVRKDLDERRK

SEQ ID NO: 15305 - protein, 177 aa, Artificial Sequence
  Synthetic sequence.
SAIEKVKEVVERVLETVRDSVRRSHEESKRLIDKVRRDHMVLHEYVNAAGITVRRKGIPERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 15306 - protein, 177 aa, Artificial Sequence
  Synthetic sequence.
SVLEEVRRRVEELLKTVKESVDRSHERSERLIEEVRRDHMVLHEYVNAAGITVREKGIPEDRVKRIEDKLREELERLERENRKIEEDLKRSNDELRRENERIAERLEELLRELSRDTNDKVARDVLEEIERLIREANERNKRNLEDVERVIRELNKENERVLREVEKKIEKLIRETE

SEQ ID NO: 15307 - protein, 183 aa, Artificial Sequence
  Synthetic sequence.
KDAEDLERRVRELVEENNRVSKRLAEEVTRLVKENERDHMVLHEYVNAAGITLLDMKRRGEVREEEVKRVLREIEELLREITEHSKEVLKTIEKLLRDSLEHSRRVLEEIERLLETILRKSKDSERLKKLVDELRETLERSLRENEKVADELRKRAEKSLEDVKRVVDELRKIVDDVLKRVED

SEQ ID NO: 15308 - protein, 183 aa, Artificial Sequence
  Synthetic sequence.
SEIEKLVEDVRKLVEDNLRHSEEVHRRNRRLIEENERDHMVLHEYVNAAGITLRELAERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 15309 - protein, 181 aa, Artificial Sequence
  Synthetic sequence.
EEIERALREMRELSRTHKELVEKILRDIAELAKTHERDHMVLHEYVNAAGITIADEIRKEDKKEELKRKIDELRRRAEELLKESKEHLKRLEDTVRELIERLKETLKKVEEDLKRILEKLEKSRELDEIAKDVKRLIDENRELLKRVEDEVRRLIRKLEELNRRTEEEVKKLIKKLEDDLK

SEQ ID NO: 15310 - protein, 174 aa, Artificial Sequence
  Synthetic sequence.
SEIEELEKRIDELLKELRDLSRRIAEEVKRLLEELKRDHMVLHEYVNAAGITLKRKGVPEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 15311 - protein, 174 aa, Artificial Sequence
  Synthetic sequence.
DELRDVKRELDRLLRENEEIVERIAETVRRLLEELKRDHMVLHEYVNAAGITLRKRGVPEKELKEVADTLRKLLKDIERSNKEVEDRLRKLLEEIKESTDRLREELEEVEKLLRGGKDVETVLRRVRELSRDNKRRMRRVLEEAKRLAKEDKERIDKIRKEIEELIKRLKDKAT

SEQ ID NO: 15312 - protein, 174 aa, Artificial Sequence
  Synthetic sequence.
DEEEDLERRIKKLLDENRELLKRIAEELRRLLEELRRDHMVLHEYVNAAGITLKDRGVPEKDLRDVAEKVKKVLKESEDSNRDVKRKLEKLLRDLERSTERLEREARKVRKLLRDGKDIETLLRELEKLSRDNKELLKKIEKEIRDLIKEDKERNRELSERLRKLVEELKKKAT

SEQ ID NO: 15313 - protein, 174 aa, Artificial Sequence
  Synthetic sequence.
REIEEAAKDLDRLLEENKKLVKEVEEELRRLLKENRRDHMVLHEYVNAAGITLRRRGVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 15314 - protein, 177 aa, Artificial Sequence
  Synthetic sequence.
SEAEKVVEELKKLLREVEKKIRDHTEDVKRILEELERDHMVLHEYVNAAGITLKDKNSDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 15315 - protein, 182 aa, Artificial Sequence
  Synthetic sequence.
DELEEVVRRVRELSRTVKEELREVIERVRELSERVKRDHMVLHEYVNAAGITVMKRVRDSGLDKSKLEKLEDESRRVLDKSREILRKNEEDNRRLNKELEEILKKNEDDNEDVRRKVDEVTRKGKDAEEVLREVEKVVEDSRRSAKDALKRVEDRVRESDKSVRELLEENRKVVEDIKRRVD

SEQ ID NO: 15316 - protein, 174 aa, Artificial Sequence
  Synthetic sequence.
EELERILDKVRKVIEEVRKRLRDDLRTVEKVLKETERDHMVLHEYVNAAGITVEEAARRGRDRREIKEELKKVLDDLRELLRALEEKNRRVNKENEDSLRKIEEDLRDVLRKLEEEIKGREVLRKVRELLRTIREEVERVLRKSNELSTRIKKRIDDVLETLERLLKELDDKLR

SEQ ID NO: 15317 - protein, 178 aa, Artificial Sequence
  Synthetic sequence.
SSKDEIRRRVEEVVERSDEIVKRSREHVKTVVDELDRDHMVLHEYVNAAGITLDKIRKDGGSEETLKRVLDELREILKELKEEVKKVKRKLEKVVKENRDTIREVEERNRKILDELRKRGVEERALREVEEISRKSEEKLRRVLKESEDIAKEAEDRLKTVLERVERIADEVLKRLTK

SEQ ID NO: 15318 - protein, 178 aa, Artificial Sequence
  Synthetic sequence.
SKVEKLEEEIARLVERSRRLVEELKKEVTKVKEKVDRDHMVLHEYVNAAGITLRDIKRRGGSEEVLRRVTEELKKVLEDNRRVIEEVLRDLERILEELKRKAEEVTKRNRDDLKRLRDSGVDEEVLRRVEETSDRSEKELRTVLRDVTEDIKRIAEELKKALEDSTEIIRRAEDELRT

SEQ ID NO: 15319 - protein, 182 aa, Artificial Sequence
  Synthetic sequence.
SDADRVAEELKKLVEDSRRENERVIEESKRLVKENERDHMVLHEYVNAAGITLRDILEKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 15320 - protein, 182 aa, Artificial Sequence
  Synthetic sequence.
DEVREVAERLRRLVDESRKRNEEVIKESEALVDRVRRDHMVLHEYVNAAGITLEKDIRRLKDKKTVEKIIREVLKKIDELLKRVERTNREISKENKRLLDEVRKTNEEISRRLKKLLEDIRRRNVDVETIERVVRELLEENKEVLRKTEEMVKRSTETNKRLLERSKEVADRLRERIKEAAK

SEQ ID NO: 15321 - protein, 175 aa, Artificial Sequence
  Synthetic sequence.
SEVDEVLREAKRIVDEVHKDNERATEESRRLVKKVHRDHMVLHEYVNAAGITVKDANIDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 15322 - protein, 175 aa, Artificial Sequence
  Synthetic sequence.
SEMDDVLKKLAETVKRIIERLKKLTDDSRRLVEEVHRDHMVLHEYVNAAGITAEERNIDEKDVRKLLEDLKKKSEEVAERNKRILDTLREISKRAEDEVRKVLKELEKTLKELEDRRPDVRELSEEVKKLLDEVRKALKRHKDENDKLLKEIEDSLRRHKEENDRLLEKLKESTR

SEQ ID NO: 15323 - protein, 178 aa, Artificial Sequence
  Synthetic sequence.
SEEEKLKEVKDRIREVLRKLEEHTDKVKKEVEKVLRRDHMVLHEYVNAAGITLERLRRKKKDAEDLLRELEKIIEEIERELDRVLEENDKMAEEWKKLLDKVLDDNRKSIRDIEKELDDREPTDELVTEVEKLLRDDEETNRDVVKKVREAVKKDADTNRKVIEEVKKVLEDAARRLD

SEQ ID NO: 15324 - protein, 186 aa, Artificial Sequence
  Synthetic sequence.
SRVDEVIERLERLLRELDKINRDMIEDDKRLNTELNRDHMVLHEYVNAAGITLEEIRKKLSDEKTLEEIIERVERRLEELIERSKRRNREILERSKELIERSKKTNEEILRRAEELIKRLREEVKDIKEALDKIRRLEERARRVIEELDEKNRRALERSKENVKRLDERNERLRKELEEKVRRLRK

SEQ ID NO: 15325 - protein, 183 aa, Artificial Sequence
  Synthetic sequence.
SEVDEVLERIKRLLERLAEHSDKVVRDIEKLLDDNRRDHMVLHEYVNAAGITLEEMRRRGDLREELLERVVREVEKEIRDIKRKNKRSVETVEKLVRDDRKELKRALEDVERLIRELETRLKDKEELRRKLEKVLREAEKVIDELLKKTDEVLKRARETIEDLNRKLDKVLKEVRDKLDRLRD

SEQ ID NO: 15326 - protein, 184 aa, Artificial Sequence
  Synthetic sequence.
ELIKKARKDVEEVRERSERLVDELRKRNKKLADESRRDHMVLHEYVNAAGITIEDLLRKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 15327 - protein, 186 aa, Artificial Sequence
  Synthetic sequence.
KEVEDLERTVRTILKRMRELITRNEEEIRRSIEELKRDHMVLHEYVNAAGITMKELKKEGGDDKKRLVEEIKRLLDELRENSKRSSDRAKEIHERNKRHSEESSRTIEKLLKELRDLVRDVERKLRDEDAKRKLDELTKRVEKVVREADERNKRLTKRSKEVLDEVHRANEEALKEVEEVVRRVTK

SEQ ID NO: 15328 - protein, 176 aa, Artificial Sequence
  Synthetic sequence.
REAEEAKEEVEELNRRNKKELDDARRRVDELDKRNKRDHMVLHEYVNAAGITLERVKEEGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 15329 - protein, 186 aa, Artificial Sequence
  Synthetic sequence.
SEIEKLIEELRRELEKVKDELERSIEEMDRELDDVRRDHMVLHEYVNAAGITVTERTKRGDRPEEVLRKELEDIKRKLRRILEEHHEKIRRIKEKLRRENKRVRDELKRIKDEIDEKVKDVRRKGADEELLKRLEEVAEDVKRALEELLKKHTRVVERVEKALDELDKELERIVREAEKELDRREK

SEQ ID NO: 15330 - protein, 179 aa, Artificial Sequence
  Synthetic sequence.
RLEDEVRKMEKEVREEVKRLEDESRKVLEESRRNLDRDHMVLHEYVNAAGITIKDLRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 15331 - protein, 183 aa, Artificial Sequence
  Synthetic sequence.
SIREKIRELEERLEEVLRRIEENSERVLREAERVLKRDHMVLHEYVNAAGITLEEIRKLPVEDELVRRVKELVERLKRHNKKSSEDVERVVRELKEELKRSSEEVKKAVDRLKEELEKVLRDGGEREVDRVIRKLEDVLRKLEEHNRRVVERLKRLLEELKKHNEDSLRKSEEVLRKLEEDAR

SEQ ID NO: 15332 - protein, 182 aa, Artificial Sequence
  Synthetic sequence.
SIEDLVRELKKKVDEVAEDLRRKVREALERSRENIDRDHMVLHEYVNAAGITVDKLRKETREEEVKDILRRVLELSKRIVEESKEILDRVLELSKKVVDDIEEIIRRVEETVKEVLTRLSRVDDKVVKKLIKEVDDILREVTKLVEKLIRELEDINRKVNERNRRLAEESRKILDEVEKRVR

SEQ ID NO: 15333 - protein, 179 aa, Artificial Sequence
  Synthetic sequence.
SKAEEVEELVKKLLAEVKKSLDDVRRTVEKLLREVRRDHMVLHEYVNAAGITLKDLKDDGQDERAVRRVVEEIKELLDRNNEDSKRVVKEIRKLLDENDKTSKRVVEEIKRLLDEVRKEGKISEEKVEKLERDVRRALERDTRENKKLEDRVETALREDKKRNDDLREDVKRVLEEIRT

SEQ ID NO: 15334 - protein, 177 aa, Artificial Sequence
  Synthetic sequence.
SAADEVVERMKELVATVKRENDEVVKELKKLVKELERDHMVLHEYVNAAGITLARRVGKDKREVVEEVRRTSKELVERNEETAKRVDDLVRRLVEENRRSVTEVEELVKELVKELRRGSGSEDLVREVEKRVRDIVEESRKLAEETRKAVEDIIEKSKRIAEDTLEKNKEMVERLER

SEQ ID NO: 15335 - protein, 174 aa, Artificial Sequence
  Synthetic sequence.
SESDEVIRDLARLLDELARHVDDSVRRMDEVVKRSTRDHMVLHEYVNAAGITVEKKPGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 15336 - protein, 174 aa, Artificial Sequence
  Synthetic sequence.
KEVEDAVKELEDLLRANEDKTRSIVEDMRASNKDLERDHMVLHEYVNAAGITLRRAGVPRDSLKRLAEDVERVTRESRELLERVHRADRELIERLKESNERLRRAIEEIRKAIKGGSDIKTLLDRVRKLAEEDAERLDRLRRESEELNERVRRVDKKLLEEIRRKAKKVEDDTR

SEQ ID NO: 15337 - protein, 184 aa, Artificial Sequence
  Synthetic sequence.
DEIRKVVKEITDLLKASNDKNRKVVEEIRDLLRKSKRDHMVLHEYVNAAGITLRRRIDKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 15338 - protein, 186 aa, Artificial Sequence
  Synthetic sequence.
SRVEEIIEDLRRLLEEIRKENEDSIRRSKELLDRVKRDHMVLHEYVNAAGITIEKEVREKGSESEEVKKALRAVLEELEKLLRRVAEINEEVLRRNSKLVEEDERRNREVLKELARLVEELIREIGDEDKARKVAEVAEKVLRDIDKLDRESKEAFRATNEEIAKLDEDTARVAERVKKAIEDLAK

SEQ ID NO: 15339 - protein, 186 aa, Artificial Sequence; identical to SEQ ID NO: 15338
  Synthetic sequence.

SEQ ID NO: 15340 - protein, 181 aa, Artificial Sequence
  Synthetic sequence.
SEVDDVLRRLEELIKTLEDINAKSLEDIKKLIDDLARDHMVLHEYVNAAGITLREAKKGIDSREAEEIAKRVLEELKRTSDDLRKKVERVDEDLRRLLRENHERNKKILRDLERLLRDAARRGVPKEALDRMREEIRRLEEESRKSDETIERLIRELRRRVEEVLKTSTDLIRELEEEVKK

SEQ ID NO: 15341 - protein, 183 aa, Artificial Sequence
  Synthetic sequence.
SKLEEVEKAVRKVIEDSRRVNEEVNRRSEEVVRELERDHMVLHEYVNAAGITARRVLKGSGDERLAAEVERIIEEIRELNERDRKRVEEIRKEIEDLNRDLNRRSKESEDRLRKLLEDATRGGVTKEADEVVERAERISEENKRRVEDVARKSKELVEDVRRHSEEVVRRVEELVKEVEERVR

SEQ ID NO: 15342 - protein, 238 aa, Artificial Sequence
  Synthetic sequence.
EEDERLTKRVEEIKRENRELLRRLEEEVKELERKSERDHMVLHEYVNAAGITLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 15343 - protein, 245 aa, Artificial Sequence
  Synthetic sequence.
TEEEVLRKVEKLIKDLLDVLRDLLRASEEVVREALRRDHMVLHEYVNAAGITSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDLTETKKELEKRHEDLRRELEKLLRDYKRELEEIERALEEIEKTLKRRADETRR

SEQ ID NO: 15344 - protein, 234 aa, Artificial Sequence
  Synthetic sequence.
SAKETIRKLIEENKDIIRKLAEKLKRLLEESERIAERDHMVLHEYVNAAGITLRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDKELEKLLEDLEREIRRLAKRLKELSDRLEEKIRKIKRELDDLSARLREKIERTRK

SEQ ID NO: 15345 - protein, 238 aa, Artificial Sequence
  Synthetic sequence.
SKEDKARELEKRLRDNLKKLEEVVRELAEVLKRNLERDHMVLHEYVNAAGITLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRDIRRELKELEERARKILRDDERDLRALEKRIRDIIREDREELERLKERARK

SEQ ID NO: 15346 - protein, 244 aa, Artificial Sequence
  Synthetic sequence.
SAEETLRRITEESKRVLEEITKKYEDLERESREVLRRDHMVLHEYVNAAGITLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 15347 - protein, 250 aa, Artificial Sequence
  Synthetic sequence.
STEEILKRVKEILDELAKELRDIIRESLRTIEELLDRDHMVLHEYVNAAGITVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLEEKERRIRTRYEELRRRLRKRVKDYEDKLREIEKKVRRDAERIEEELERAKK

SEQ ID NO: 15348 - protein, 238 aa, Artificial Sequence
  Synthetic sequence.
SEAEKIREALETNLRLLEELIKRLKEILDTHNELLRRDHMVLHEYVNAAGITLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 15349 - protein, 238 aa, Artificial Sequence; identical to SEQ ID NO: 15348
  Synthetic sequence.

SEQ ID NO: 15350 - protein, 242 aa, Artificial Sequence
  Synthetic sequence.
SEKERLMRLLDKLKDLNRRLVERIKELLDKALELHKRDHMVLHEYVNAAGITVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLREALKKLEDDLRKIERDAEREYKKLKDELEELTERYRREIRKLKEELKADRK

SEQ ID NO: 15351 - protein, 242 aa, Artificial Sequence; identical to SEQ ID NO: 15350
  Synthetic sequence.

SEQ ID NO: 15352 - protein, 247 aa, Artificial Sequence
  Synthetic sequence.
SEAEDLEELIKELAELLKDVIRKLEKINRRLVKILERDHMVLHEYVNAAGITLRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRETHKKIEKELREALKRVRDRST

SEQ ID NO: 15353 - protein, 247 aa, Artificial Sequence; identical to SEQ ID NO: 15352
  Synthetic sequence.

SEQ ID NO: 15354 - protein, 240 aa, Artificial Sequence
  Synthetic sequence.
SDKEEIKRRVEKTARDLETEHDKIKKRLEDTVRDIKRDHMVLHEYVNAAGITIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 15355 - protein, 240 aa, Artificial Sequence; identical to SEQ ID NO: 15354
  Synthetic sequence.

SEQ ID NO: 15356 - protein, 248 aa, Artificial Sequence
  Synthetic sequence.
DEDRIIEEIARLLEELLRELLELIKKLIETNRRLNERDHMVLHEYVNAAGITLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 15357 - protein, 238 aa, Artificial Sequence
  Synthetic sequence.
DADELLRRLAEEVERVIREAEDLLRRWKETIKKVLDRDHMVLHEYVNAAGITIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 15358 - protein, 231 aa, Artificial Sequence
  Synthetic sequence.
DKAEVLREALKLLKDLLEELIKIHEESLKRILDLIDRDHMVLHEYVNAAGITLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDVARRSEEELRRIIKKLKEVVKEIRKKLK

SEQ ID NO: 15359 - protein, 247 aa, Artificial Sequence
  Synthetic sequence.
SKAEKLLKDLREALEKVKRRYEELERRLDEVLKEHERDHMVLHEYVNAAGITIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTIERLIEESIRVNEELLEVIERLLDRARK

SEQ ID NO: 15360 - protein, 239 aa, Artificial Sequence
  Synthetic sequence.
SERELIERWLELHKEILRLIRELVERLLKLHREILDRDHMVLHEYVNAAGITARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERTLKKLLDDSARMAEEVKKTLKELLERSEKVAEDVRK

SEQ ID NO: 15361 - protein, 246 aa, Artificial Sequence
  Synthetic sequence.
KEIEETLKELEDLNREMVETNRRVLEETRRLNKETVRDHMVLHEYVNAAGITLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVEELEKALEEIKRRLKEVIDRYEDELRKLRKEYKEKIDKYERKLEEIERRERT

SEQ ID NO: 15362 - protein, 231 aa, Artificial Sequence
  Synthetic sequence.
SKEEEVEKVLRKWEEILRRLIEENKRANDKIRREYERDHMVLHEYVNAAGITAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 15363 - protein, 231 aa, Artificial Sequence; identical to SEQ ID NO: 15362
  Synthetic sequence.

SEQ ID NO: 15364 - protein, 247 aa, Artificial Sequence
  Synthetic sequence.
RDRDVLRKVKAEIEELVARIEKVSRDALSEVKRLLDRDHMVLHEYVNAAGITLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 15365 - protein, 231 aa, Artificial Sequence
  Synthetic sequence.
SKDEELARLLEELVERWRKIVEDLERDHRRLVKEIRRDHMVLHEYVNAAGITIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 15366 - protein, 231 aa, Artificial Sequence; identical to SEQ ID NO: 15365
  Synthetic sequence.

SEQ ID NO: 15367 - protein, 238 aa, Artificial Sequence
  Synthetic sequence.
SEIEDVIRRLRKILEDLERVSEKLLREIKKILDEARRDHMVLHEYVNAAGITAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKRIKEASDKVREDVDRLIKELKEAAD

SEQ ID NO: 15368 - protein, 229 aa, Artificial Sequence
  Synthetic sequence.
SKEERLREVAEKHKKDLEDIVKRVDEAAKETARRLERDHMVLHEYVNAAGITLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 15369 - protein, 229 aa, Artificial Sequence; identical to SEQ ID NO: 15368
  Synthetic sequence.

SEQ ID NO: 15370 - protein, 241 aa, Artificial Sequence
  Synthetic sequence.
SEKELLKEILDRIRELLEDDNRLLKRIVDEIRKLLERDHMVLHEYVNAAGITLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 15371 - protein, 241 aa, Artificial Sequence; identical to SEQ ID NO: 15370
  Synthetic sequence.

SEQ ID NO: 15372 - protein, 240 aa, Artificial Sequence
  Synthetic sequence.
DREKSVRDIEEDLKRVLDKLRRRVETSKEELKKVLKRDHMVLHEYVNAAGITVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 15373 - protein, 240 aa, Artificial Sequence; identical to SEQ ID NO: 15372
  Synthetic sequence.

SEQ ID NO: 15374 - protein, 252 aa, Artificial Sequence
  Synthetic sequence.
SLEEITKRLLELVEENLARHEEILRELLELAKRLAKRDHMVLHEYVNAAGITLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLREVVRKVLEEAKRLLDELEEVHKRVKKELEDIIEENRRVVKRVRDELREIKRELDE

SEQ ID NO: 15375 - protein, 252 aa, Artificial Sequence; identical to SEQ ID NO: 15374
  Synthetic sequence.

SEQ ID NO: 15376 - protein, 241 aa, Artificial Sequence
  Synthetic sequence.
SAEEAVEKLVRIARAIVKINEDLSREVVRILREIVRRDHMVLHEYVNAAGITVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKELEKLKRELERLLEESRRKLEKLKRDLERVLEETRR

SEQ ID NO: 15377 - protein, 237 aa, Artificial Sequence
  Synthetic sequence.
REDEVLRDIERLLREIEEKIRRILEESTAELRKVEERDHMVLHEYVNAAGITKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 15378 - protein, 237 aa, Artificial Sequence; identical to SEQ ID NO: 15377
  Synthetic sequence.

SEQ ID NO: 15379 - protein, 237 aa, Artificial Sequence
  Synthetic sequence.
SREDLLRSLAELIETILRKSSELLDRLLKLVREHSERDHMVLHEYVNAAGITLKLIKGGISEDDVRRIVKEAKDELRRSVEEVKKSVDDLKEELKRSLREVRELVKSIADALEEIVRRSSGLGEVIKKLLELLRRLLEVHERTIRLLAELLERHLEVHEESIRLLLRLLEELLELVERKGDEKELRRIAEAVERVLRDHKAKNDKILRDVEEVLRRHLEELARILKDVKKVLDEARK

SEQ ID NO: 15380 - protein, 243 aa, Artificial Sequence
  Synthetic sequence.
SEAERLADEVRKAVKKSEEDNETLVREVEKAVRELKRDHMVLHEYVNAAGITLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 15381 - protein, 243 aa, Artificial Sequence; identical to SEQ ID NO: 15380
  Synthetic sequence.

SEQ ID NO: 15382 - protein, 245 aa, Artificial Sequence
  Synthetic sequence.
SEKDEVTRRIRELLKEAEETNREAIERIKRLLDRVRRDHMVLHEYVNAAGITLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 15383 - protein, 247 aa, Artificial Sequence
  Synthetic sequence.
DEERLAEELERVLDRNRKLLEEALRELRRVIEENRKRDHMVLHEYVNAAGITLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTEEDVERAVKEIRDRLRKLLEDYERAVRRLEDKLRRVRERYEAVLKRIKDKLEETKR

SEQ ID NO: 15384 - protein, 243 aa, Artificial Sequence
  Synthetic sequence.
SRVEELKKLIEDILRISREVVERIARVAEDIHRINRRDHMVLHEYVNAAGITVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 15385 - protein, 243 aa, Artificial Sequence; identical to SEQ ID NO: 15384
  Synthetic sequence.

SEQ ID NO: 15386 - protein, 249 aa, Artificial Sequence
  Synthetic sequence.
DAEEVVKRLADVLRENDETIRKVVEDLVRIAEENDRRDHMVLHEYVNAAGITVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 15387 - protein, 249 aa, Artificial Sequence; identical to SEQ ID NO: 15386
  Synthetic sequence.

SEQ ID NO: 15388 - protein, 240 aa, Artificial Sequence
  Synthetic sequence.
DKDKRLEELLKRLKELNDKTFEELERILEELKRANERDHMVLHEYVNAAGITIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 15389 - protein, 240 aa, Artificial Sequence
  Synthetic sequence.
SKEETLKRLLDELEKRNRETVERLERLLKELEDRNRRDHMVLHEYVNAAGITIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 15390 - protein, 240 aa, Artificial Sequence; identical to SEQ ID NO: 15389
  Synthetic sequence.

SEQ ID NO: 15391 - protein, 243 aa, Artificial Sequence
  Synthetic sequence.
DEEETLRRLLERKVELAKEYLDVSKEVIDRTTKLLDRDHMVLHEYVNAAGITLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 15392 - protein, 243 aa, Artificial Sequence; identical to SEQ ID NO: 15391
  Synthetic sequence.

SEQ ID NO: 15393 - protein, 243 aa, Artificial Sequence
  Synthetic sequence.
SEAERTKESLKKVLKALVDLNRELLRKLEENMRELTRDHMVLHEYVNAAGITVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 15394 - protein, 178 aa, Artificial Sequence
  Synthetic sequence.
DEVEKLLRDLEELDRDIERKVRELLKRNKEVLDDIERRDHMVLHEYVNAAGITADVIRKTTDKRTVDKLLKELEKILKEVLDRVRRLLEEAKESLDRSREEIERLLEESKTLVDEVRRAGIDKKEVDKIEKHSRDLIERAKRETDRLLEEAERLMREVVDRVRKILEEAKRLIDEARR

SEQ ID NO: 15395 - protein, 182 aa, Artificial Sequence
  Synthetic sequence.
DEAEKLLKELRDLLEESRKDLERLLKELEDLLEESKRRDHMVLHEYVNAAGITKETVERRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 15396 - protein, 181 aa, Artificial Sequence
  Synthetic sequence.
SEVERVLEDLRRLVRDVEEKLRRIIERDRRLVEEVERRDHMVLHEYVNAAGITLEELKDISDKKTIERIVREIIKEARDLVRRNHERNREIVDESRRLVEELRRIVEEIIRRLRELLERVKSGELAERIEDVVREAEKRLRELLKELEKTSRDLKKRLEELDRELKALVEKVERDLEELRK

SEQ ID NO: 15397 - protein, 174 aa, Artificial Sequence
  Synthetic sequence.
SEDETIRRIVRTVHEESRKSTEDVRREVERVLRESEERDHMVLHEYVNAAGITEETGISEELEERMRRIIREIREHLKDNLRRVREVIERIERKLEETERRDEKVLREIEKKIRDGDGREEVAREVTKIARDTIRENEEIAKEVREIVERSIKNLEEVAEEVERVVRELIEARR

SEQ ID NO: 15398 - protein, 174 aa, Artificial Sequence
  Synthetic sequence.
SELEKVVKEVADLLRRNLEKSKRVLEEVRRRLEENLRRDHMVLHEYVNAAGITLELVREGKDKRDLTRLLEEDDKRVKEALDKSRENNERILKEVRRALRESEEDNRRILKEVREKVDSRLLEELEERVRESIERSRRFIEELEKIVEETLTESEKLARASSEITKTVLDEIRK

SEQ ID NO: 15399 - protein, 178 aa, Artificial Sequence
  Synthetic sequence.
DDLERVLKEIKKAADKIREDNKRTADKIRKRVKELDDRDHMVLHEYVNAAGITKERVRGREEARKVIEELKKLVDEVRKRNEKSIEELKKLLKEDRDLMRRVIEELEDLVRRLREEVRDDEALRRVEEEVERLIRDLRRVLKETSDRVRELIDKHRRLSEEVEKDVKRLIDELKKKTD

SEQ ID NO: 15400 - protein, 181 aa, Artificial Sequence
  Synthetic sequence.
DEEETLEDVLRELEERVEKLLRDLTRDLERVEKEHKERDHMVLHEYVNAAGITEELLKRIEDDEKLRRLKEEVRKLVEESRERNKRHHKEVREVLERIRELLERLEKELRRALEEIRDKIRKDGATDEILRKIEELLRRAEEVIRDLERKVRKLERDIRENIKKNHREVREILRKIEEDVR

SEQ ID NO: 15401 - protein, 175 aa, Artificial Sequence
  Synthetic sequence.
SEEDELRRLLKEVNERVERLLDEIRKELEKIAEELRDRDHMVLHEYVNAAGITEENRVDEEIKKDAERALTELKEEHERLDREAKKDLDRIRKELERLEEEHRRVSERIEEVLDKESDKTEDIAREIRELMERTRRVIEEIKKELRDILEKLRRVSEELNKKLDEILKRIEDRTR

SEQ ID NO: 15402 - protein, 177 aa, Artificial Sequence
  Synthetic sequence.
SAIEKVKEVVERVLETVRDSVRRSHEESKRLIDKVRKRDHMVLHEYVNAAGITRRKGIPERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 15403 - protein, 183 aa, Artificial Sequence
  Synthetic sequence.
KDAEDLERRVRELVEENNRVSKRLAEEVTRLVKENEDRDHMVLHEYVNAAGITLDMKRRGEVREEEVKRVLREIEELLREITEHSKEVLKTIEKLLRDSLEHSRRVLEEIERLLETILRKSKDSERLKKLVDELRETLERSLRENEKVADELRKRAEKSLEDVKRVVDELRKIVDDVLKRVED

SEQ ID NO: 15404 - protein, 183 aa, Artificial Sequence
  Synthetic sequence.
SEIEKLVEDVRKLVEDNLRHSEEVHRRNRRLIEENERRDHMVLHEYVNAAGITRELAERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 15405 - protein, 177 aa, Artificial Sequence
  Synthetic sequence.
REIEELRKEIETLIRENEELNRRSKETSEELIRRLKKRDHMVLHEYVNAAGITRDRGAPEEDVRRAEERVKKLIEDNKRHSDEVAKTDKKLNEDSERHTRRVEERLRELLDRLSRSDKDEVVRRVAEEARRLSKRNKDAIREVNETSRRLATRDAKHTRDVLREIKRLADEIRERTR

SEQ ID NO: 15406 - protein, 174 aa, Artificial Sequence
  Synthetic sequence.
REIEEAAKDLDRLLEENKKLVKEVEEELRRLLKENRDRDHMVLHEYVNAAGITRRRGVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 15407 - protein, 182 aa, Artificial Sequence
  Synthetic sequence.
DEIETVLDEVRRLHEDAKRRLEEMIDEVRKLNEESVRRDHMVLHEYVNAAGITKEEVERAGLDKGKLEELEERLERVREDVERILREIKRRNEKTLEDSERILEENKERNRTVLKKLKELRDRGSDAREALKESRKVVEESRESVRRVLEKNRRVVEESKRLAEELLRRVKKVVDEIRKRVE

SEQ ID NO: 15408 - protein, 182 aa, Artificial Sequence
  Synthetic sequence.
DELEEVVRRVRELSRTVKEELREVIERVRELSERVKKRDHMVLHEYVNAAGITMKRVRDSGLDKSKLEKLEDESRRVLDKSREILRKNEEDNRRLNKELEEILKKNEDDNEDVRRKVDEVTRKGKDAEEVLREVEKVVEDSRRSAKDALKRVEDRVRESDKSVRELLEENRKVVEDIKRRVD

SEQ ID NO: 15409 - protein, 182 aa, Artificial Sequence
  Synthetic sequence.
SDADRVAEELKKLVEDSRRENERVIEESKRLVKENEDRDHMVLHEYVNAAGITRDILEKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 15410 - protein, 175 aa, Artificial Sequence
  Synthetic sequence.
SEVDEVLREAKRIVDEVHKDNERATEESRRLVKKVHERDHMVLHEYVNAAGITKDANIDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 15411 - protein, 186 aa, Artificial Sequence
  Synthetic sequence.
SRVDEVIERLERLLRELDKINRDMIEDDKRLNTELNKRDHMVLHEYVNAAGITEEIRKKLSDEKTLEEIIERVERRLEELIERSKRRNREILERSKELIERSKKTNEEILRRAEELIKRLREEVKDIKEALDKIRRLEERARRVIEELDEKNRRALERSKENVKRLDERNERLRKELEEKVRRLRK

SEQ ID NO: 15412 - protein, 185 aa, Artificial Sequence
  Synthetic sequence.
DDIERLKREIERLLKEAEKISRDNEERSKELLDRLRKRDHMVLHEYVNAAGITKRLADKIKDKEELTRRLKEVVDRVEKSVRDSERMLREVVREDEESVRRSKTKLEDLLRKVEELVRRLEKKVTDEKVKRDAREALRKAKKKVDELKRKNDEVHRRSREEVKRLLEENRKLLEDLRRMVREITQ

SEQ ID NO: 15413 - protein, 184 aa, Artificial Sequence
  Synthetic sequence.
ELIKKARKDVEEVRERSERLVDELRKRNKKLADESRRRDHMVLHEYVNAAGITEDLLRKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 15414 - protein, 186 aa, Artificial Sequence
  Synthetic sequence.
KEVEDLERTVRTILKRMRELITRNEEEIRRSIEELKKRDHMVLHEYVNAAGITKELKKEGGDDKKRLVEEIKRLLDELRENSKRSSDRAKEIHERNKRHSEESSRTIEKLLKELRDLVRDVERKLRDEDAKRKLDELTKRVEKVVREADERNKRLTKRSKEVLDEVHRANEEALKEVEEVVRRVTK

SEQ ID NO: 15415 - protein, 179 aa, Artificial Sequence
  Synthetic sequence.
RLEDEVRKMEKEVREEVKRLEDESRKVLEESRRNLDKRDHMVLHEYVNAAGITKDLRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 15416 - protein, 183 aa, Artificial Sequence
  Synthetic sequence.
SVDERLDEVLERVKEDMDRNRRKNDESLREDEENVRRRDHMVLHEYVNAAGITRELKKRVKDERVKEFLDRVLEEIRKSAEEVKTIIDEVHKESEETVRRTKKIIEEVLRRIEELIRRVKKDRKEEVVKTVEEDIKRLLKEVNKVSDEAHKRNKELNERVNRVNKEAHKRNEDLLREAERKVR

SEQ ID NO: 15417 - protein, 183 aa, Artificial Sequence
  Synthetic sequence.
SIREKIRELEERLEEVLRRIEENSERVLREAERVLKERDHMVLHEYVNAAGITEEIRKLPVEDELVRRVKELVERLKRHNKKSSEDVERVVRELKEELKRSSEEVKKAVDRLKEELEKVLRDGGEREVDRVIRKLEDVLRKLEEHNRRVVERLKRLLEELKKHNEDSLRKSEEVLRKLEEDAR

SEQ ID NO: 15418 - protein, 182 aa, Artificial Sequence
  Synthetic sequence.
SIEDLVRELKKKVDEVAEDLRRKVREALERSRENIDRRDHMVLHEYVNAAGITDKLRKETREEEVKDILRRVLELSKRIVEESKEILDRVLELSKKVVDDIEEIIRRVEETVKEVLTRLSRVDDKVVKKLIKEVDDILREVTKLVEKLIRELEDINRKVNERNRRLAEESRKILDEVEKRVR

SEQ ID NO: 15419 - protein, 179 aa, Artificial Sequence
  Synthetic sequence.
SKAEEVEELVKKLLAEVKKSLDDVRRTVEKLLREVRKRDHMVLHEYVNAAGITKDLKDDGQDERAVRRVVEEIKELLDRNNEDSKRVVKEIRKLLDENDKTSKRVVEEIKRLLDEVRKEGKISEEKVEKLERDVRRALERDTRENKKLEDRVETALREDKKRNDDLREDVKRVLEEIRT

SEQ ID NO: 15420 - protein, 174 aa, Artificial Sequence
  Synthetic sequence.
SESDEVIRDLARLLDELARHVDDSVRRMDEVVKRSTRRDHMVLHEYVNAAGITEKKPGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 15421 - protein, 174 aa, Artificial Sequence; identical to SEQ ID NO: 15420
  Synthetic sequence.

SEQ ID NO: 15422 - protein, 174 aa, Artificial Sequence
  Synthetic sequence.
SESDDVIRKLRELLEELRTHVEKSIRDLRKILEDSTRRDHMVLHEYVNAAGITRKKPGDEEVRKTVEEISRRVAENVKRLEDLYRRMEEEVKKNLDRLRKRVEDIIREVEEARKKGVDEEKLKDLIRKLRDILRRAAEAHKKLIDDARESLERAKREHEKLIDRLKKILEELER

SEQ ID NO: 15423 - protein, 177 aa, Artificial Sequence
  Synthetic sequence.
DEVRELLERNRRLLEEIKKTVKDLIRANEELLKRIEDRDHMVLHEYVNAAGITEKGLSDDETIREAKERLKASLEDVKRRVEEVKRLLEKSLEEVETIIREAEKRNRDSLREMERRGSSEELEELRRVVEESDETIKRLLEEAKESVDRSLDRIRKLLEDVRRSVERSAKRIDEKRK

SEQ ID NO: 15424 - protein, 184 aa, Artificial Sequence
  Synthetic sequence.
DEIRKVVKEITDLLKASNDKNRKVVEEIRDLLRKSKKRDHMVLHEYVNAAGITRRRIDKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 15425 - protein, 238 aa, Artificial Sequence
  Synthetic sequence.
EEDERLTKRVEEIKRENRELLRRLEEEVKELERKSEKRDHMVLHEYVNAAGITDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 15426 - protein, 247 aa, Artificial Sequence
  Synthetic sequence.
SEKEELLKLIKRVIELLKRVLEEHLRLVEDVIRRLKERDHMVLHEYVNAAGITKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRNLEDVRRVIEDVKRKSARILEEARRLIEEVERELEKIRK

SEQ ID NO: 15427 - protein, 238 aa, Artificial Sequence
  Synthetic sequence.
SEAEKIREALETNLRLLEELIKRLKEILDTHNELLRRRDHMVLHEYVNAAGITEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 15428 - protein, 248 aa, Artificial Sequence
  Synthetic sequence.
SAEEELEKLVRKVEEDLKRLEEESERIKKEIKDTLRARDHMVLHEYVNAAGITRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRKLVELVDEVLKVHEESLRKLLTLAAKVLEVLRKITK

SEQ ID NO: 15429 - protein, 240 aa, Artificial Sequence
  Synthetic sequence.
SDKEEIKRRVEKTARDLETEHDKIKKRLEDTVRDIKRRDHMVLHEYVNAAGITEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 15430 - protein, 248 aa, Artificial Sequence
  Synthetic sequence.
DEEERVKKLLTDLRRLLRKLHEESKKLLDELRKKLRERDHMVLHEYVNAAGITREAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDENLKMVERLIRELEKVLDDHERKVRRLIEELLEVLDRDAK

SEQ ID NO: 15431 - protein, 236 aa, Artificial Sequence
  Synthetic sequence.
STREKAKKVLDTLRADNEDMKRVVEKILRALKRTNERRDHMVLHEYVNAAGITKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 15432 - protein, 247 aa, Artificial Sequence
  Synthetic sequence.
SKAEKLLKDLREALEKVKRRYEELERRLDEVLKEHEERDHMVLHEYVNAAGITEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTIERLIEESIRVNEELLEVIERLLDRARK

SEQ ID NO: 15433 - protein, 231 aa, Artificial Sequence
  Synthetic sequence.
SKEEEVEKVLRKWEEILRRLIEENKRANDKIRREYEERDHMVLHEYVNAAGITERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 15434 - protein, 231 aa, Artificial Sequence; identical to SEQ ID NO: 15433
  Synthetic sequence.

SEQ ID NO: 15435 - protein, 247 aa, Artificial Sequence
  Synthetic sequence.
RDRDVLRKVKAEIEELVARIEKVSRDALSEVKRLLDERDHMVLHEYVNAAGITRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 15436 - protein, 231 aa, Artificial Sequence
  Synthetic sequence.
SKDEELARLLEELVERWRKIVEDLERDHRRLVKEIRERDHMVLHEYVNAAGITRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 15437 - protein, 238 aa, Artificial Sequence
  Synthetic sequence.
SEIEDVIRRLRKILEDLERVSEKLLREIKKILDEARRRDHMVLHEYVNAAGITVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKRIKEASDKVREDVDRLIKELKEAAD

SEQ ID NO: 15438 - protein, 246 aa, Artificial Sequence
  Synthetic sequence.
SREEIVATLEDLARKILEVVKKLAKEIEDAWREIERARDHMVLHEYVNAAGITDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELVELLEEILERNTRVIKEIIDLLRTVIRIHEKIVEDLIKLLEELLRRLEEATR

SEQ ID NO: 15439 - protein, 237 aa, Artificial Sequence
  Synthetic sequence.
KEKEDALKKLEDLARKSREDLERVLRKHKKILDKIEERDHMVLHEYVNAAGITLRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 15440 - protein, 237 aa, Artificial Sequence; identical to SEQ ID NO: 15439
  Synthetic sequence.

SEQ ID NO: 15441 - protein, 229 aa, Artificial Sequence
  Synthetic sequence.
SKEERLREVAEKHKKDLEDIVKRVDEAAKETARRLEERDHMVLHEYVNAAGITEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 15442 - protein, 241 aa, Artificial Sequence
  Synthetic sequence.
SEKELLKEILDRIRELLEDDNRLLKRIVDEIRKLLEERDHMVLHEYVNAAGITDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 15443 - protein, 246 aa, Artificial Sequence
  Synthetic sequence.
SEREELLERIKEILKRVKDKLDEDLKRLKEILEKLKERDHMVLHEYVNAAGITREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETVRELIERLKRVLEEAIEVVERVAR

SEQ ID NO: 15444 - protein, 240 aa, Artificial Sequence
  Synthetic sequence.
DREKSVRDIEEDLKRVLDKLRRRVETSKEELKKVLKARDHMVLHEYVNAAGITRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 15445 - protein, 240 aa, Artificial Sequence; identical to SEQ ID NO: 15444
  Synthetic sequence.

SEQ ID NO: 15446 - protein, 237 aa, Artificial Sequence
  Synthetic sequence.
REDEVLRDIERLLREIEEKIRRILEESTAELRKVEEERDHMVLHEYVNAAGITEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 15447 - protein, 237 aa, Artificial Sequence; identical to SEQ ID NO: 15446
  Synthetic sequence.

SEQ ID NO: 15448 - protein, 243 aa, Artificial Sequence
  Synthetic sequence.
SEAERLADEVRKAVKKSEEDNETLVREVEKAVRELKKRDHMVLHEYVNAAGITVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 15449 - protein, 243 aa, Artificial Sequence; identical to SEQ ID NO: 15448
  Synthetic sequence.

SEQ ID NO: 15450 - protein, 245 aa, Artificial Sequence
  Synthetic sequence.
SEKDEVTRRIRELLKEAEETNREAIERIKRLLDRVRERDHMVLHEYVNAAGITKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 15451 - protein, 245 aa, Artificial Sequence; identical to SEQ ID NO: 15450
  Synthetic sequence.

SEQ ID NO: 15452 - protein, 243 aa, Artificial Sequence
  Synthetic sequence.
SRVEELKKLIEDILRISREVVERIARVAEDIHRINRRRDHMVLHEYVNAAGITEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 15453 - protein, 249 aa, Artificial Sequence
  Synthetic sequence.
DAEEVVKRLADVLRENDETIRKVVEDLVRIAEENDRLRDHMVLHEYVNAAGITELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 15454 - protein, 249 aa, Artificial Sequence; identical to SEQ ID NO: 15453
  Synthetic sequence.

SEQ ID NO: 15455 - protein, 240 aa, Artificial Sequence
  Synthetic sequence.
DKDKRLEELLKRLKELNDKTFEELERILEELKRANEARDHMVLHEYVNAAGITEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 15456 - protein, 240 aa, Artificial Sequence; identical to SEQ ID NO: 15455
  Synthetic sequence.

SEQ ID NO: 15457 - protein, 240 aa, Artificial Sequence
  Synthetic sequence.
SKEETLKRLLDELEKRNRETVERLERLLKELEDRNRARDHMVLHEYVNAAGITEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 15458 - protein, 240 aa, Artificial Sequence; identical to SEQ ID NO: 15457
  Synthetic sequence.

SEQ ID NO: 15459 - protein, 243 aa, Artificial Sequence
  Synthetic sequence.
SEAERTKESLKKVLKALVDLNRELLRKLEENMRELTKRDHMVLHEYVNAAGITREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 15460 - protein, 241 aa, Artificial Sequence
  Synthetic sequence.
SADEALEELVRRLLEVLKTVLERTKELSRDDLRVVKERDHMVLHEYVNAAGITRDGLDDADRVLEEVERVIREAKREVKRWEEVVRKVVEDSRRLIERVLAEVEEVIKEAKRLLDERKSGGSREVIEELLSLLREIVRHHKEVSDEHLKLSAELVKRILDVVEETLRLATEIVRRIKEGGNSEDVRRDIERLLEELKRRVERLLEDIERLLAELEKLNEDVLRENKALLEDLERRVRERKK

SEQ ID NO: 15461 - protein, 186 aa, Artificial Sequence
  Synthetic sequence.
SAEDSIRELLERDERLLEEARKEAKRLNEENERLLERIRDHMVLHEYVNAAGITDIRKKIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 15462 - protein, 177 aa, Artificial Sequence
  Synthetic sequence.
ELREDVERVVDEIRRLVEENVRRIDEVAKDIKRLADDNRDHMVLHEYVNAAGITRLKEEGVTEVVDELREEVRKLSEDNRRHSRELIERVKKLLKELEEHSRDLKRRVKELLEDLKRKGVDERVLKKLKEVIEDVERKSRDALRRLEEAIRRVRRESERVNRELDEVIKRVTEELKK

SEQ ID NO: 15463 - protein, 174 aa, Artificial Sequence
  Synthetic sequence.
SEDETIRRIVRTVHEESRKSTEDVRREVERVLRESEEVRDHMVLHEYVNAAGITETGISEELEERMRRIIREIREHLKDNLRRVREVIERIERKLEETERRDEKVLREIEKKIRDGDGREEVAREVTKIARDTIRENEEIAKEVREIVERSIKNLEEVAEEVERVVRELIEARR

SEQ ID NO: 15464 - protein, 180 aa, Artificial Sequence
  Synthetic sequence.
SKEEVLREIERLHKETIRRIEEVLREATELHKRLTETNRDHMVLHEYVNAAGITDVRRADTPNVEELLRELKDALDKVRDHNRKTLKKNEDVVREIEKEVRELLKEDEDVLRRIEKVMRDGRVDARELLEESRREVERSEKEVERLLRKSRKVVEEVRKLSEENDREVKKILEEVKRRLD

SEQ ID NO: 15465 - protein, 187 aa, Artificial Sequence
  Synthetic sequence.
DEEEELRKRLEKLSKEVRELLRRDEEEDRRLNRELEELRDHMVLHEYVNAAGITDLLRKARRKVSEEELTRLRKKLRDLEEESKEALRELRRRVEELNKENKKSLDDLERRLKELEDRAREVEKRDRREDELRELLRRLEDVIRKLAEDLKRNTEDLRRVIKELAERLEELNKRLKREIRRLKEELR

SEQ ID NO: 15466 - protein, 181 aa, Artificial Sequence
  Synthetic sequence.
DEERKLEKSLKDVEDTHRRLLEKNDEDLKELRKRVEDMRDHMVLHEYVNAAGITEKLKRIEDDETLKRLRKRVKELLDEIRRRLERLEREVDKRLEEIKERNDRHHEEAKKELKRIRDKIRRDGADEKILREVEDLLRKVAEDLKRSNDEVKELAERLEETIRDLLRRIEEILKEIEERVR

SEQ ID NO: 15467 - protein, 175 aa, Artificial Sequence
  Synthetic sequence.
SEKEDLERELEEVRRRVEESLRKNEEDVKRVRDELKKLRDHMVLHEYVNAAGITRANVDKRVLDEADRLLKELEDDHKKLEEDAKKALDELREEHKRLEETLRRMLKRIKEVLDRESDKMEEIKKEIEKILRDIERVSRELNKKLEEIVRRLKKVSDELNRRIEEIAERVRRRRK

SEQ ID NO: 15468 - protein, 177 aa, Artificial Sequence
  Synthetic sequence.
SAIEKVKEVVERVLETVRDSVRRSHEESKRLIDKVRKRRDHMVLHEYVNAAGITRKGIPERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 15469 - protein, 177 aa, Artificial Sequence
  Synthetic sequence.
SVLEEVRRRVEELLKTVKESVDRSHERSERLIEEVRESRDHMVLHEYVNAAGITEKGIPEDRVKRIEDKLREELERLERENRKIEEDLKRSNDELRRENERIAERLEELLRELSRDTNDKVARDVLEEIERLIREANERNKRNLEDVERVIRELNKENERVLREVEKKIEKLIRETE

SEQ ID NO: 15470 - protein, 178 aa, Artificial Sequence
  Synthetic sequence.
SSIERVEKEVRRLLRESDESLKRVMEEAKELIKSVRESRDHMVLHEYVNAAGITERTGDEREDLRRVLEELRKLIEDNRREDKRSEDELRKLIRDNKEENDRARREAEKLLEDLSRGRSEEEVERVLEEVRRIIEKLKEDDKRSLERIERIVRRNNELNKESVDRIRKIIKEMEERAD

SEQ ID NO: 15471 - protein, 177 aa, Artificial Sequence
  Synthetic sequence.
SVIERVEEEMEKVIRDSERVTKEVEDRAREVHERSEKRRDHMVLHEYVNAAGITRAGVDKRILDELRKRIKDSREDLERINEELRRALRKLLEDSKRINEELRKTLEELRKRLERVDDEEEVKKLAEEVRRLVEDSIRKLEELARRVDELVRESIERVDRNVEENKRLVREAIERRR

SEQ ID NO: 15472 - protein, 179 aa, Artificial Sequence
  Synthetic sequence.
SSKEVADELRKKAEKVLDELRKIIRELERKNEDSLRRTRDHMVLHEYVNAAGITDLVRTRGEDDRLVREVERLLRELKRRLEELIRRSEELIKRSREEVDRVIRTVEKLLEELDRLLRANKGDIEDLRRTVDKLVEEIKDLARKLAKSSDDTVREDEKLVEELRKDVKRIVRKIKKDLE

SEQ ID NO: 15473 - protein, 183 aa, Artificial Sequence
  Synthetic sequence.
KDAEDLERRVRELVEENNRVSKRLAEEVTRLVKENEDKRDHMVLHEYVNAAGITDMKRRGEVREEEVKRVLREIEELLREITEHSKEVLKTIEKLLRDSLEHSRRVLEEIERLLETILRKSKDSERLKKLVDELRETLERSLRENEKVADELRKRAEKSLEDVKRVVDELRKIVDDVLKRVED

SEQ ID NO: 15474 - protein, 174 aa, Artificial Sequence
  Synthetic sequence.
SEIEELEKRIDELLKELRDLSRRIAEEVKRLLEELKKLRDHMVLHEYVNAAGITRKGVPEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 15475 - protein, 174 aa, Artificial Sequence
  Synthetic sequence.
DELRDVKRELDRLLRENEEIVERIAETVRRLLEELKKLRDHMVLHEYVNAAGITKRGVPEKELKEVADTLRKLLKDIERSNKEVEDRLRKLLEEIKESTDRLREELEEVEKLLRGGKDVETVLRRVRELSRDNKRRMRRVLEEAKRLAKEDKERIDKIRKEIEELIKRLKDKAT

SEQ ID NO: 15476 - protein, 174 aa, Artificial Sequence
  Synthetic sequence.
DEEEDLERRIKKLLDENRELLKRIAEELRRLLEELRRLRDHMVLHEYVNAAGITDRGVPEKDLRDVAEKVKKVLKESEDSNRDVKRKLEKLLRDLERSTERLEREARKVRKLLRDGKDIETLLRELEKLSRDNKELLKKIEKEIRDLIKEDKERNRELSERLRKLVEELKKKAT

SEQ ID NO: 15477 - protein, 174 aa, Artificial Sequence
  Synthetic sequence.
REIEEAAKDLDRLLEENKKLVKEVEEELRRLLKENRDLRDHMVLHEYVNAAGITRRGVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 15478 - protein, 177 aa, Artificial Sequence
  Synthetic sequence.
SEAEKVVEELKKLLREVEKKIRDHTEDVKRILEELERRRDHMVLHEYVNAAGITDKNSDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 15479 - protein, 182 aa, Artificial Sequence
  Synthetic sequence.
DEIETVLDEVRRLHEDAKRRLEEMIDEVRKLNEESVRERDHMVLHEYVNAAGITEEVERAGLDKGKLEELEERLERVREDVERILREIKRRNEKTLEDSERILEENKERNRTVLKKLKELRDRGSDAREALKESRKVVEESRESVRRVLEKNRRVVEESKRLAEELLRRVKKVVDEIRKRVE

SEQ ID NO: 15480 - protein, 178 aa, Artificial Sequence
  Synthetic sequence.
SKVEKLEEEIARLVERSRRLVEELKKEVTKVKEKVDEIRDHMVLHEYVNAAGITDIKRRGGSEEVLRRVTEELKKVLEDNRRVIEEVLRDLERILEELKRKAEEVTKRNRDDLKRLRDSGVDEEVLRRVEETSDRSEKELRTVLRDVTEDIKRIAEELKKALEDSTEIIRRAEDELRT

SEQ ID NO: 15481 - protein, 186 aa, Artificial Sequence
  Synthetic sequence.
SEVDEVRKTLEDLLRRLDEENKDIIRRNKELLDDLDRKRDHMVLHEYVNAAGITKILEKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 15482 - protein, 184 aa, Artificial Sequence
  Synthetic sequence.
ELIKKARKDVEEVRERSERLVDELRKRNKKLADESRRLRDHMVLHEYVNAAGITDLLRKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 15483 - protein, 186 aa, Artificial Sequence
  Synthetic sequence.
KEVEDLERRVKEILDRMKRLIDENRKKIEKSIRELERLRDHMVLHEYVNAAGITDLKREGGDDARTLRERVRKIIEDVEEHSRRSTEEVRRIHKENKEHSERSSDEIRELLRRVEELIEEVKRRLRDKEMEKKLEDIVRRVREVVRRAHETNERLVDRSRKAVEKAERTNRRLVEEIRKVAEEVRK

SEQ ID NO: 15484 - protein, 176 aa, Artificial Sequence
  Synthetic sequence.
REAEEAKEEVEELNRRNKKELDDARRRVDELDKRNKDRRDHMVLHEYVNAAGITRVKEEGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 15485 - protein, 182 aa, Artificial Sequence
  Synthetic sequence.
SELEKTLEDLKRHSEENKKKLEEDLRDMERNLKENKDRRDHMVLHEYVNAAGITRRFREGDIDERELERVRRKMEEIKKRLDENVERNRRKAEDIKRKLDENVKRSEDRVKEIKEDIRRRVRDKDKAEELERRLDELVKENREIHERVKKALDDIVKELEELHERLKRRLEEILRRIAETVR

SEQ ID NO: 15486 - protein, 179 aa, Artificial Sequence
  Synthetic sequence.
RLEDEVRKMEKEVREEVKRLEDESRKVLEESRRNLDKLRDHMVLHEYVNAAGITDLRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 15487 - protein, 183 aa, Artificial Sequence
  Synthetic sequence.
RVDERLDTVLKRVEETVRENKKKNDELLERSKENIDRLRDHMVLHEYVNAAGITKLKREVTKEEVKKIIDEVLKEIEDLLRTVKEELDRALERNREVVEETKRRIDRVLKEIEKLIRDVKRDRKEEVVKEVEERIKKLLKEVNDTSKDAERRLRETNERLNEIVKEVEKRIRELSEEVRKRVK

SEQ ID NO: 15488 - protein, 183 aa, Artificial Sequence
  Synthetic sequence.
SVDERLDEVLERVKEDMDRNRRKNDESLREDEENVRRNRDHMVLHEYVNAAGITELKKRVKDERVKEFLDRVLEEIRKSAEEVKTIIDEVHKESEETVRRTKKIIEEVLRRIEELIRRVKKDRKEEVVKTVEEDIKRLLKEVNKVSDEAHKRNKELNERVNRVNKEAHKRNEDLLREAERKVR

SEQ ID NO: 15489 - protein, 183 aa, Artificial Sequence
  Synthetic sequence.
SIREKIRELEERLEEVLRRIEENSERVLREAERVLKEIRDHMVLHEYVNAAGITEIRKLPVEDELVRRVKELVERLKRHNKKSSEDVERVVRELKEELKRSSEEVKKAVDRLKEELEKVLRDGGEREVDRVIRKLEDVLRKLEEHNRRVVERLKRLLEELKKHNEDSLRKSEEVLRKLEEDAR

SEQ ID NO: 15490 - protein, 182 aa, Artificial Sequence
  Synthetic sequence.
SIEDLVRELKKKVDEVAEDLRRKVREALERSRENIDRLRDHMVLHEYVNAAGITKLRKETREEEVKDILRRVLELSKRIVEESKEILDRVLELSKKVVDDIEEIIRRVEETVKEVLTRLSRVDDKVVKKLIKEVDDILREVTKLVEKLIRELEDINRKVNERNRRLAEESRKILDEVEKRVR

SEQ ID NO: 15491 - protein, 172 aa, Artificial Sequence
  Synthetic sequence.
SRAETVLKEVTDKIKKLADSSDELLRRNKENIDELKKSRDHMVLHEYVNAAGITKGSVDEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 15492 - protein, 174 aa, Artificial Sequence
  Synthetic sequence.
DEEEDLERAIKKLLDENRELLKRIAEELRRLLEELRRLRDHMVLHEYVNAAGITDRGVPEEDLADVAEKVKKVLKESEDSNADVARKLEKLLRDLERSTERLEREARKVRKLLRGGKDAETLLRELEKLSRDNKELLKKIEKEIRDLIKEDKERNIELSERLRKLVEELKKKAT

SEQ ID NO: 15493 - protein, 184 aa, Artificial Sequence
  Synthetic sequence.
DEIRKVVKEITDLLKASNDKNRKVVEEIRDLLRKSKKLRDHMVLHEYVNAAGITRRIDKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 15494 - protein, 177 aa, Artificial Sequence
  Synthetic sequence.
SKEDRLREELKKLLARLAEEIERLKRALEESNKDLKRTRDHMVLHEYVNAAGITRGGVSEELLRELERSTAENKERAKELLKRHEDLVRKVEKELADLLRRLEEIVARVDEALKRGISEEELDKLLKEARDLIREIEKRLEELLKRVEKLTEDAKRDLERSNREHKELADRIKETAR

SEQ ID NO: 15495 - protein, 243 aa, Artificial Sequence
  Synthetic sequence.
KREDILKKLEDIIRDIIDKLRRILEKVKRLNEDIIREIRDHMVLHEYVNAAGITRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIKRLKEELERRHRRLEEEVERVARELEKAHRDLERDIRRVAEELKKLLKKLRDDRR

SEQ ID NO: 15496 - protein, 244 aa, Artificial Sequence
  Synthetic sequence.
SAEETLRRITEESKRVLEEITKKYEDLERESREVLRKLRDHMVLHEYVNAAGITKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 15497 - protein, 242 aa, Artificial Sequence
  Synthetic sequence.
SEKERLMRLLDKLKDLNRRLVERIKELLDKALELHKKLRDHMVLHEYVNAAGITRGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLREALKKLEDDLRKIERDAEREYKKLKDELEELTERYRREIRKLKEELKADRK

SEQ ID NO: 15498 - protein, 242 aa, Artificial Sequence; identical to SEQ ID NO: 15497
  Synthetic sequence.

SEQ ID NO: 15499 - protein, 240 aa, Artificial Sequence
  Synthetic sequence.
SDKEEIKRRVEKTARDLETEHDKIKKRLEDTVRDIKRERDHMVLHEYVNAAGITKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 15500 - protein, 248 aa, Artificial Sequence
  Synthetic sequence.
DEDRIIEEIARLLEELLRELLELIKKLIETNRRLNEEHRDHMVLHEYVNAAGITRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 15501 - protein, 248 aa, Artificial Sequence; identical to SEQ ID NO: 15500
  Synthetic sequence.

SEQ ID NO: 15502 - protein, 238 aa, Artificial Sequence
  Synthetic sequence.
DADELLRRLAEEVERVIREAEDLLRRWKETIKKVLDDLRDHMVLHEYVNAAGITELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 15503 - protein, 231 aa, Artificial Sequence
  Synthetic sequence.
DKAEVLREALKLLKDLLEELIKIHEESLKRILDLIDTLRDHMVLHEYVNAAGITRSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDVARRSEEELRRIIKKLKEVVKEIRKKLK

SEQ ID NO: 15504 - protein, 236 aa, Artificial Sequence
  Synthetic sequence.
STREKAKKVLDTLRADNEDMKRVVEKILRALKRTNERARDHMVLHEYVNAAGITEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 15505 - protein, 247 aa, Artificial Sequence
  Synthetic sequence.
RDRDVLRKVKAEIEELVARIEKVSRDALSEVKRLLDENRDHMVLHEYVNAAGITKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 15506 - protein, 231 aa, Artificial Sequence
  Synthetic sequence.
SKDEELARLLEELVERWRKIVEDLERDHRRLVKEIRELRDHMVLHEYVNAAGITKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 15507 - protein, 229 aa, Artificial Sequence
  Synthetic sequence.
SKEERLREVAEKHKKDLEDIVKRVDEAAKETARRLEEIRDHMVLHEYVNAAGITKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 15508 - protein, 229 aa, Artificial Sequence; identical to SEQ ID NO: 15507
  Synthetic sequence.

SEQ ID NO: 15509 - protein, 246 aa, Artificial Sequence
  Synthetic sequence.
SEREELLERIKEILKRVKDKLDEDLKRLKEILEKLKEKRDHMVLHEYVNAAGITEKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETVRELIERLKRVLEEAIEVVERVAR

SEQ ID NO: 15510 - protein, 240 aa, Artificial Sequence
  Synthetic sequence.
DREKSVRDIEEDLKRVLDKLRRRVETSKEELKKVLKADRDHMVLHEYVNAAGITELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 15511 - protein, 240 aa, Artificial Sequence; identical to SEQ ID NO: 15510
  Synthetic sequence.

SEQ ID NO: 15512 - protein, 241 aa, Artificial Sequence
  Synthetic sequence.
SAEEAVEKLVRIARAIVKINEDLSREVVRILREIVRLNRDHMVLHEYVNAAGITVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKELEKLKRELERLLEESRRKLEKLKRDLERVLEETRR

SEQ ID NO: 15513 - protein, 237 aa, Artificial Sequence
  Synthetic sequence.
REDEVLRDIERLLREIEEKIRRILEESTAELRKVEEEVRDHMVLHEYVNAAGITDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 15514 - protein, 243 aa, Artificial Sequence
  Synthetic sequence.
SEAERLADEVRKAVKKSEEDNETLVREVEKAVRELKKNRDHMVLHEYVNAAGITDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 15515 - protein, 245 aa, Artificial Sequence
  Synthetic sequence.
SEKDEVTRRIRELLKEAEETNREAIERIKRLLDRVREARDHMVLHEYVNAAGITKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 15516 - protein, 243 aa, Artificial Sequence
  Synthetic sequence.
SRVEELKKLIEDILRISREVVERIARVAEDIHRINRRVRDHMVLHEYVNAAGITEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 15517 - protein, 249 aa, Artificial Sequence
  Synthetic sequence.
DAEEVVKRLADVLRENDETIRKVVEDLVRIAEENDRLWRDHMVLHEYVNAAGITLLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 15518 - protein, 240 aa, Artificial Sequence
  Synthetic sequence.
DKDKRLEELLKRLKELNDKTFEELERILEELKRANEASRDHMVLHEYVNAAGITGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 15519 - protein, 240 aa, Artificial Sequence
  Synthetic sequence.
SKEETLKRLLDELEKRNRETVERLERLLKELEDRNRASRDHMVLHEYVNAAGITESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 15520 - protein, 240 aa, Artificial Sequence; identical to SEQ ID NO: 15519
  Synthetic sequence.

SEQ ID NO: 15521 - protein, 243 aa, Artificial Sequence
  Synthetic sequence.
DEEETLRRLLERKVELAKEYLDVSKEVIDRTTKLLDEYRDHMVLHEYVNAAGITRGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 15522 - protein, 243 aa, Artificial Sequence
  Synthetic sequence.
SEAERTKESLKKVLKALVDLNRELLRKLEENMRELTKLRDHMVLHEYVNAAGITEGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 15523 - protein, 186 aa, Artificial Sequence
  Synthetic sequence.
SAEDSIRELLERDERLLEEARKEAKRLNEENERLLERIERDHMVLHEYVNAAGITIRKKIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 15524 - protein, 182 aa, Artificial Sequence
  Synthetic sequence.
DEAEKLLKELRDLLEESRKDLERLLKELEDLLEESKRDLRDHMVLHEYVNAAGITTVERRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 15525 - protein, 182 aa, Artificial Sequence
  Synthetic sequence.
RVEDALRKLLDDVRRLVEEAERRLRTSNDKSRRLVEEAKRDHMVLHEYVNAAGITVRRRIRDEDVKRVLEELLKRDHDVVRRVLERIDEMLERNSRLVKRVLEDIRRLLKRVREVVERIKRVRSKVVEEVLKELEELIKTAKKIIEDVLRASEDTIRRLEEIIRKVEEDSKRIIEEIERAAR

SEQ ID NO: 15526 - protein, 183 aa, Artificial Sequence
  Synthetic sequence.
KVEKRLTDLLKTVADEVKRVEDELRETVRESKEVVDKSRRDHMVLHEYVNAAGITAERRVSEDLVRRIRKVLDENREVNDRVVKEDERILEENERVNRKVVEKIRDILRKIEEVVRRAAEEIRDEEVVKKVEKEIRELLERLKEEADRVRERSKKILTDLKKSSEDVKRESERMLKKLEDEIR

SEQ ID NO: 15527 - protein, 184 aa, Artificial Sequence
  Synthetic sequence.
SLEEVIKTVRKLLEEVERRLREVVERAERMLEEVRRRTRRDHMVLHEYVNAAGITLRDKNVSEEIEEKLRKIKEELERDNEKVNRDNERSVETLRRLLDRVRKEVKDIAKELEERLKEVERKSRDDRIVEKLLRDAERIVKRLRELIEKLREEVEKIVDENRKTVEELRRRNEEIVRRLRREIE

SEQ ID NO: 15528 - protein, 184 aa, Artificial Sequence
  Synthetic sequence.
KLDEVIEEIRKLLRRMEEELRRSVEEIDKLLREVRELLRRDHMVLHEYVNAAGITLKKRGVPEEVKERLDRLVETLRRLSEETLKELDKLVREVKELSKESLKRLRELVERLRRELEEIKKRGEDEKLVEDLKRRAEEVIRELREIVKRNTEIAREVVERAKRIVEKNEKLLKDVVEEAKKIVK

SEQ ID NO: 15529 - protein, 181 aa, Artificial Sequence
  Synthetic sequence.
SEVERVLEDLRRLVRDVEEKLRRIIERDRRLVEEVERENRDHMVLHEYVNAAGITELKDISDKKTIERIVREIIKEARDLVRRNHERNREIVDESRRLVEELRRIVEEIIRRLRELLERVKSGELAERIEDVVREAEKRLRELLKELEKTSRDLKKRLEELDRELKALVEKVERDLEELRK

SEQ ID NO: 15530 - protein, 177 aa, Artificial Sequence
  Synthetic sequence.
KEEEDLEREVKRLEDKVREDAKKLEEVVKTVEKLVRDDARDHMVLHEYVNAAGITLTERKLDEETLRKVKEDLKRTLERLKRENEKSLEELRDILRRLKKENDDTLKELRDELKRLTDSGASEDVIRKMEEIIKRLEEVSREVEKRLRRIIRELERVSKEVLDRLREIIEKLDRDAT

SEQ ID NO: 15531 - protein, 180 aa, Artificial Sequence
  Synthetic sequence.
STEEVLDEIRKLHKTLTEDIKRVLREIEELHRRTIEENKRDHMVLHEYVNAAGITVRTKDTPNVEKLLKDLEKSAKENEEHNERTLREDDRVLKEIRRRATELLKANEEMLRRIEEVMRAGKVDAEELLRESKEAIKEVKRVLEELRKESKRVVDETRKLSEENLEHSERVLRKVEEDLR

SEQ ID NO: 15532 - protein, 180 aa, Artificial Sequence
  Synthetic sequence.
SKEEVLDEMRRLHETTKRDIRRVLKEIEELHERTLRENKRDHMVLHEYVNAAGITIKRKKTPDVEKLVRRVEEMLKELEKHNKKTTDDDKRVLDEIRRRADELVKEDERVLREIEEVVRAGKVDLKELLDESRRVVKESKEDLDRLLKESRDVVDDTRRKSEKNLRDAERVIREAEEAVR

SEQ ID NO: 15533 - protein, 187 aa, Artificial Sequence
  Synthetic sequence.
SEKERLKEELEKLSKEIEDILRDDKRSDDELRRRLRELLRDHMVLHEYVNAAGITMLEEARKRVSEDELRAIKKEIEDLNRRNEESLRAIEEKIKRLNDENRKSLEEIRRRLKRLVEEVDELRKRDNREELLRRLLEKLKRMAEKLKRDIEDNNRKLRKVATELAKEIEDNSEKLREDAKRLSEKIK

SEQ ID NO: 15534 - protein, 187 aa, Artificial Sequence
  Synthetic sequence.
DEEEELRKRLEKLSKEVRELLRRDEEEDRRLNRELEELLRDHMVLHEYVNAAGITLLRKARRKVSEEELTRLRKKLRDLEEESKEALRELRRRVEELNKENKKSLDDLERRLKELEDRAREVEKRDRREDELRELLRRLEDVIRKLAEDLKRNTEDLRRVIKELAERLEELNKRLKREIRRLKEELR

SEQ ID NO: 15535 - protein, 171 aa, Artificial Sequence
  Synthetic sequence.
SEKEKVIKEARELLERLRKRLKDVNDDVTRLLDELRKENRDHMVLHEYVNAAGITEVPVEDVIRELKRRLEEVDKKNRDILETLKRELDEVSRRTREELEKLRKELEEVEKAGLPAEELKRVADRLRRRLERLVEENERVVKKILDEIRRSVEENKRIVDKVRKDLDERRK

SEQ ID NO: 15536 - protein, 177 aa, Artificial Sequence
  Synthetic sequence.
SAIEKVKEVVERVLETVRDSVRRSHEESKRLIDKVRKRLRDHMVLHEYVNAAGITKGIPERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 15537 - protein, 179 aa, Artificial Sequence
  Synthetic sequence.
SSKEVADELRKKAEKVLDELRKIIRELERKNEDSLRRTERDHMVLHEYVNAAGITLVRTRGEDDRLVREVERLLRELKRRLEELIRRSEELIKRSREEVDRVIRTVEKLLEELDRLLRANKGDIEDLRRTVDKLVEEIKDLARKLAKSSDDTVREDEKLVEELRKDVKRIVRKIKKDLE

SEQ ID NO: 15538 - protein, 174 aa, Artificial Sequence
  Synthetic sequence.
SEIEELEKRIDELLKELRDLSRRIAEEVKRLLEELKKLSRDHMVLHEYVNAAGITKGVPEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 15539 - protein, 182 aa, Artificial Sequence
  Synthetic sequence.
SDADRVAEELKKLVEDSRRENERVIEESKRLVKENEDRNRDHMVLHEYVNAAGITILEKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 15540 - protein, 178 aa, Artificial Sequence
  Synthetic sequence.
SEEEKLKEVKDRIREVLRKLEEHTDKVKKEVEKVLRDIRRDHMVLHEYVNAAGITLRRKKKDAEDLLRELEKIIEEIERELDRVLEENDKMAEEWKKLLDKVLDDNRKSIRDIEKELDDREPTDELVTEVEKLLRDDEETNRDVVKKVREAVKKDADTNRKVIEEVKKVLEDAARRLD

SEQ ID NO: 15541 - protein, 183 aa, Artificial Sequence
  Synthetic sequence.
SEVDEVLERIKRLLERLAEHSDKVVRDIEKLLDDNRKENRDHMVLHEYVNAAGITMRRRGDLREELLERVVREVEKEIRDIKRKNKRSVETVEKLVRDDRKELKRALEDVERLIRELETRLKDKEELRRKLEKVLREAEKVIDELLKKTDEVLKRARETIEDLNRKLDKVLKEVRDKLDRLRD

SEQ ID NO: 15542 - protein, 179 aa, Artificial Sequence
  Synthetic sequence.
KDEETLKRLLEKAKEVVDRLKDENEKVTRDNHESVKKAKRDHMVLHEYVNAAGITAIRRVREAKEVVDTAEKLLRDNHEHSRDTVKKARELNETSRRHSERIVEKIEEILEEVERTLRENRGDVRELAKKVEKAIRELEELSRENREAVKRISDEIKRLSDENAKDSERIIKEIDDRVR

SEQ ID NO: 15543 - protein, 179 aa, Artificial Sequence
  Synthetic sequence.
REDERLEEIARKIKKVVDELVERNKKLTEDNHESVRRAERDHMVLHEYVNAAGITAIERIRSDKKVVDEVKKLLEDAKKHSKEVIDELRRLNEESKRSSEDTIRRMRKLLRELEETVKAKKGDVEDIERKVEDIIRRLEDLSRRNEEKVRRISEEIKKLSKDNERTIKEIIKEIEERVK

SEQ ID NO: 15544 - protein, 184 aa, Artificial Sequence
  Synthetic sequence.
ELIKKARKDVEEVRERSERLVDELRKRNKKLADESRRLIRDHMVLHEYVNAAGITLLRKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 15545 - protein, 179 aa, Artificial Sequence
  Synthetic sequence.
RLEDEVRKMEKEVREEVKRLEDESRKVLEESRRNLDKLRRDHMVLHEYVNAAGITLRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 15546 - protein, 179 aa, Artificial Sequence
  Synthetic sequence.
SKAEEVEELVKKLLAEVKKSLDDVRRTVEKLLREVRKSLRDHMVLHEYVNAAGITLKDDGQDERAVRRVVEEIKELLDRNNEDSKRVVKEIRKLLDENDKTSKRVVEEIKRLLDEVRKEGKISEEKVEKLERDVRRALERDTRENKKLEDRVETALREDKKRNDDLREDVKRVLEEIRT

SEQ ID NO: 15547 - protein, 174 aa, Artificial Sequence
  Synthetic sequence.
SESDEVIRDLARLLDELARHVDDSVRRMDEVVKRSTREARDHMVLHEYVNAAGITKPGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 15548 - protein, 174 aa, Artificial Sequence; identical to SEQ ID NO: 15547
  Synthetic sequence.

SEQ ID NO: 15549 - protein, 174 aa, Artificial Sequence
  Synthetic sequence.
SESDDVIRKLRELLEELRTHVEKSIRDLRKILEDSTRHARDHMVLHEYVNAAGITKPGDEEVRKTVEEISRRVAENVKRLEDLYRRMEEEVKKNLDRLRKRVEDIIREVEEARKKGVDEEKLKDLIRKLRDILRRAAEAHKKLIDDARESLERAKREHEKLIDRLKKILEELER

SEQ ID NO: 15550 - protein, 186 aa, Artificial Sequence
  Synthetic sequence.
SRVEEIIEDLRRLLEEIRKENEDSIRRSKELLDRVKEINRDHMVLHEYVNAAGITEVREKGSESEEVKKALRAVLEELEKLLRRVAEINEEVLRRNSKLVEEDERRNREVLKELARLVEELIREIGDEDKARKVAEVAEKVLRDIDKLDRESKEAFRATNEEIAKLDEDTARVAERVKKAIEDLAK

SEQ ID NO: 15551 - protein, 186 aa, Artificial Sequence
  Synthetic sequence.
SEVDEIIKELERLLAEIARENERIIRESRKLADEVRKRNRDHMVLHEYVNAAGITAVRRKGSESEEVKKLIEDVLREIERLLKRIEEENREVVKRNSELVERVRAINEEILRRVAELVEKIARDIGDKDEVTKVKKVADDVLAEIKKLDDETRRVIEDTNKKIADLDKATRDVVRKVLEEVKKLEK

SEQ ID NO: 15552 - protein, 185 aa, Artificial Sequence
  Synthetic sequence.
SSVEELLERLRRISEENKRRIEKLLREVEKVLRELKDRHRDHMVLHEYVNAAGITEIKSGLPEEAVKRVLERVRERVKEVLEEADRLNDEMRRIVTEVEKELDKSDKEVEDAVRDILKKIEEGVRDRETAERARETLKRLLDENRDRSKKVKEEIRRILEDLTRTTERVKREIAKLLKELEDTAR

SEQ ID NO: 15553 - protein, 180 aa, Artificial Sequence
  Synthetic sequence.
SELEEVLRRIEALVRKAHKENEDVLREIERLVRTAHRLNRDHMVLHEYVNAAGITGGREDKDKVEEALRRLRELYRRLEEENRRILREIEELVKELEKRNREILKELEDLVADAERKGSDGSEAVRRLKEILERLKEEVRRSLEELRKEVERLKKEVEDSLRELKKSLEEWVKSLEEATR

SEQ ID NO: 15554 - protein, 238 aa, Artificial Sequence
  Synthetic sequence.
EEDERLTKRVEEIKRENRELLRRLEEEVKELERKSEKIVRDHMVLHEYVNAAGITGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 15555 - protein, 244 aa, Artificial Sequence
  Synthetic sequence.
SAEETLRRITEESKRVLEEITKKYEDLERESREVLRKLRRDHMVLHEYVNAAGITGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 15556 - protein, 244 aa, Artificial Sequence; identical to SEQ ID NO: 15555
  Synthetic sequence.

SEQ ID NO: 15557 - protein, 250 aa, Artificial Sequence
  Synthetic sequence.
STEEILKRVKEILDELAKELRDIIRESLRTIEELLDELRRDHMVLHEYVNAAGITIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLEEKERRIRTRYEELRRRLRKRVKDYEDKLREIEKKVRRDAERIEEELERAKK

SEQ ID NO: 15558 - protein, 238 aa, Artificial Sequence
  Synthetic sequence.
SEAEKIREALETNLRLLEELIKRLKEILDTHNELLRRVIRDHMVLHEYVNAAGITGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 15559 - protein, 248 aa, Artificial Sequence
  Synthetic sequence.
SAEEELEKLVRKVEEDLKRLEEESERIKKEIKDTLRAIRRDHMVLHEYVNAAGITLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRKLVELVDEVLKVHEESLRKLLTLAAKVLEVLRKITK

SEQ ID NO: 15560 - protein, 240 aa, Artificial Sequence
  Synthetic sequence.
SDKEEIKRRVEKTARDLETEHDKIKKRLEDTVRDIKRELRDHMVLHEYVNAAGITTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 15561 - protein, 248 aa, Artificial Sequence
  Synthetic sequence.
DEEERVKKLLTDLRRLLRKLHEESKKLLDELRKKLRELRRDHMVLHEYVNAAGITAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDENLKMVERLIRELEKVLDDHERKVRRLIEELLEVLDRDAK

SEQ ID NO: 15562 - protein, 248 aa, Artificial Sequence
  Synthetic sequence.
DEDRIIEEIARLLEELLRELLELIKKLIETNRRLNEEHERDHMVLHEYVNAAGITLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 15563 - protein, 238 aa, Artificial Sequence
  Synthetic sequence.
DADELLRRLAEEVERVIREAEDLLRRWKETIKKVLDDLKRDHMVLHEYVNAAGITLTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 15564 - protein, 238 aa, Artificial Sequence; identical to SEQ ID NO: 15563
  Synthetic sequence.

SEQ ID NO: 15565 - protein, 236 aa, Artificial Sequence
  Synthetic sequence.
STREKAKKVLDTLRADNEDMKRVVEKILRALKRTNERAERDHMVLHEYVNAAGITVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 15566 - protein, 236 aa, Artificial Sequence; identical to SEQ ID NO: 15565
  Synthetic sequence.

SEQ ID NO: 15567 - protein, 247 aa, Artificial Sequence
  Synthetic sequence.
SKAEKLLKDLREALEKVKRRYEELERRLDEVLKEHEEIVRDHMVLHEYVNAAGITGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTIERLIEESIRVNEELLEVIERLLDRARK

SEQ ID NO: 15568 - protein, 247 aa, Artificial Sequence; identical to SEQ ID NO: 15567
  Synthetic sequence.

SEQ ID NO: 15569 - protein, 231 aa, Artificial Sequence
  Synthetic sequence.
SKEEEVEKVLRKWEEILRRLIEENKRANDKIRREYEELVRDHMVLHEYVNAAGITLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 15570 - protein, 247 aa, Artificial Sequence
  Synthetic sequence.
RDRDVLRKVKAEIEELVARIEKVSRDALSEVKRLLDENRRDHMVLHEYVNAAGITIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 15571 - protein, 237 aa, Artificial Sequence
  Synthetic sequence.
KEKEDALKKLEDLARKSREDLERVLRKHKKILDKIEELLRDHMVLHEYVNAAGITKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 15572 - protein, 229 aa, Artificial Sequence
  Synthetic sequence.
SKEERLREVAEKHKKDLEDIVKRVDEAAKETARRLEEILRDHMVLHEYVNAAGITGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 15573 - protein, 241 aa, Artificial Sequence
  Synthetic sequence.
SEKELLKEILDRIRELLEDDNRLLKRIVDEIRKLLEEWLRDHMVLHEYVNAAGITIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 15574 - protein, 241 aa, Artificial Sequence; identical to SEQ ID NO: 15573
  Synthetic sequence.

SEQ ID NO: 15575 - protein, 240 aa, Artificial Sequence
  Synthetic sequence.
DREKSVRDIEEDLKRVLDKLRRRVETSKEELKKVLKADKRDHMVLHEYVNAAGITLDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 15576 - protein, 240 aa, Artificial Sequence; identical to SEQ ID NO: 15575
  Synthetic sequence.

SEQ ID NO: 15577 - protein, 237 aa, Artificial Sequence
  Synthetic sequence.
REDEVLRDIERLLREIEEKIRRILEESTAELRKVEEEVKRDHMVLHEYVNAAGITVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 15578 - protein, 237 aa, Artificial Sequence; identical to SEQ ID NO: 15577
  Synthetic sequence.

SEQ ID NO: 15579 - protein, 243 aa, Artificial Sequence
  Synthetic sequence.
SEAERLADEVRKAVKKSEEDNETLVREVEKAVRELKKNNRDHMVLHEYVNAAGITLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 15580 - protein, 243 aa, Artificial Sequence; identical to SEQ ID NO: 15579
  Synthetic sequence.

SEQ ID NO: 15581 - protein, 245 aa, Artificial Sequence
  Synthetic sequence.
SEKDEVTRRIRELLKEAEETNREAIERIKRLLDRVREAVRDHMVLHEYVNAAGITVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 15582 - protein, 243 aa, Artificial Sequence
  Synthetic sequence.
SRVEELKKLIEDILRISREVVERIARVAEDIHRINRRVLRDHMVLHEYVNAAGITILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 15583 - protein, 249 aa, Artificial Sequence
  Synthetic sequence.
DAEEVVKRLADVLRENDETIRKVVEDLVRIAEENDRLWKRDHMVLHEYVNAAGITLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 15584 - protein, 240 aa, Artificial Sequence
  Synthetic sequence.
DKDKRLEELLKRLKELNDKTFEELERILEELKRANEASLRDHMVLHEYVNAAGITGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 15585 - protein, 240 aa, Artificial Sequence
  Synthetic sequence.
SKEETLKRLLDELEKRNRETVERLERLLKELEDRNRASLRDHMVLHEYVNAAGITSGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 15586 - protein, 240 aa, Artificial Sequence; identical to SEQ ID NO: 15585
  Synthetic sequence.

SEQ ID NO: 15587 - protein, 243 aa, Artificial Sequence
  Synthetic sequence.
DEEETLRRLLERKVELAKEYLDVSKEVIDRTTKLLDEYLRDHMVLHEYVNAAGITGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 15588 - protein, 243 aa, Artificial Sequence
  Synthetic sequence.
SEAERTKESLKKVLKALVDLNRELLRKLEENMRELTKLNRDHMVLHEYVNAAGITGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 15589 - protein, 243 aa, Artificial Sequence; identical to SEQ ID NO: 15588
  Synthetic sequence.

SEQ ID NO: 15590 - protein, 178 aa, Artificial Sequence
  Synthetic sequence.
DEVEKLLRDLEELDRDIERKVRELLKRNKEVLDDIEREVRRDHMVLHEYVNAAGITIRKTTDKRTVDKLLKELEKILKEVLDRVRRLLEEAKESLDRSREEIERLLEESKTLVDEVRRAGIDKKEVDKIEKHSRDLIERAKRETDRLLEEAERLMREVVDRVRKILEEAKRLIDEARR

SEQ ID NO: 15591 - protein, 181 aa, Artificial Sequence
  Synthetic sequence.
SEVERVLEDLRRLVRDVEEKLRRIIERDRRLVEEVERENRRDHMVLHEYVNAAGITLKDISDKKTIERIVREIIKEARDLVRRNHERNREIVDESRRLVEELRRIVEEIIRRLRELLERVKSGELAERIEDVVREAEKRLRELLKELEKTSRDLKKRLEELDRELKALVEKVERDLEELRK

SEQ ID NO: 15592 - protein, 174 aa, Artificial Sequence
  Synthetic sequence.
SEDETIRRIVRTVHEESRKSTEDVRREVERVLRESEEVVKRDHMVLHEYVNAAGITGISEELEERMRRIIREIREHLKDNLRRVREVIERIERKLEETERRDEKVLREIEKKIRDGDGREEVAREVTKIARDTIRENEEIAKEVREIVERSIKNLEEVAEEVERVVRELIEARR

SEQ ID NO: 15593 - protein, 174 aa, Artificial Sequence
  Synthetic sequence.
SRDEKIRDILRRVLKEVRDSTKKVEEDLEDVHRRTEEELRRDHMVLHEYVNAAGITGASEELKRRMEEVVRRIEELLKKLLKEDRDVVKEIRDKLDETRKEMEEVAERIKDKIRRGDGREKVAEEVKRIADRLIDLNRRIAEEVDKIVRDSIKKVEEIVTEVEKIVEKLIRDVR

SEQ ID NO: 15594 - protein, 174 aa, Artificial Sequence
  Synthetic sequence.
SELEKVVKEVADLLRRNLEKSKRVLEEVRRRLEENLRESERDHMVLHEYVNAAGITVREGKDKRDLTRLLEEDDKRVKEALDKSRENNERILKEVRRALRESEEDNRRILKEVREKVDSRLLEELEERVRESIERSRRFIEELEKIVEETLTESEKLARASSEITKTVLDEIRK

SEQ ID NO: 15595 - protein, 180 aa, Artificial Sequence
  Synthetic sequence.
STEEVLDEIRKLHKTLTEDIKRVLREIEELHRRTIEENKERDHMVLHEYVNAAGITRTKDTPNVEKLLKDLEKSAKENEEHNERTLREDDRVLKEIRRRATELLKANEEMLRRIEEVMRAGKVDAEELLRESKEAIKEVKRVLEELRKESKRVVDETRKLSEENLEHSERVLRKVEEDLR

SEQ ID NO: 15596 - protein, 180 aa, Artificial Sequence
  Synthetic sequence.
SKEEVLREIERLHKETIRRIEEVLREATELHKRLTETNKRRDHMVLHEYVNAAGITRRADTPNVEELLRELKDALDKVRDHNRKTLKKNEDVVREIEKEVRELLKEDEDVLRRIEKVMRDGRVDARELLEESRREVERSEKEVERLLRKSRKVVEEVRKLSEENDREVKKILEEVKRRLD

SEQ ID NO: 15597 - protein, 180 aa, Artificial Sequence
  Synthetic sequence.
SKEEVLDEMRRLHETTKRDIRRVLKEIEELHERTLRENKRRDHMVLHEYVNAAGITKRKKTPDVEKLVRRVEEMLKELEKHNKKTTDDDKRVLDEIRRRADELVKEDERVLREIEEVVRAGKVDLKELLDESRRVVKESKEDLDRLLKESRDVVDDTRRKSEKNLRDAERVIREAEEAVR

SEQ ID NO: 15598 - protein, 187 aa, Artificial Sequence
  Synthetic sequence.
SEKETVRDELRKLVETIRKLLEEDKESDKRLADRIRELNERDHMVLHEYVNAAGITLEELRKKVSEDELRKLRKRIEDLRRRDEELNKRSREKLEDLNERNKDSLRRIEDELRKLVEEAREVEKRDNDEERLRKLLERLERVIRDLLRKIEENNKRLRKAIKELLDELRKINKELREVIKKLLDDAR

SEQ ID NO: 15599 - protein, 187 aa, Artificial Sequence
  Synthetic sequence.
SEKERLKEELEKLSKEIEDILRDDKRSDDELRRRLRELLERDHMVLHEYVNAAGITLEEARKRVSEDELRAIKKEIEDLNRRNEESLRAIEEKIKRLNDENRKSLEEIRRRLKRLVEEVDELRKRDNREELLRRLLEKLKRMAEKLKRDIEDNNRKLRKVATELAKEIEDNSEKLREDAKRLSEKIK

SEQ ID NO: 15600 - protein, 187 aa, Artificial Sequence
  Synthetic sequence.
DEEEELRKRLEKLSKEVRELLRRDEEEDRRLNRELEELLKRDHMVLHEYVNAAGITLRKARRKVSEEELTRLRKKLRDLEEESKEALRELRRRVEELNKENKKSLDDLERRLKELEDRAREVEKRDRREDELRELLRRLEDVIRKLAEDLKRNTEDLRRVIKELAERLEELNKRLKREIRRLKEELR

SEQ ID NO: 15601 - protein, 175 aa, Artificial Sequence
  Synthetic sequence.
SEKEDLERELEEVRRRVEESLRKNEEDVKRVRDELKKLLDRDHMVLHEYVNAAGITNVDKRVLDEADRLLKELEDDHKKLEEDAKKALDELREEHKRLEETLRRMLKRIKEVLDRESDKMEEIKKEIEKILRDIERVSRELNKKLEEIVRRLKKVSDELNRRIEEIAERVRRRRK

SEQ ID NO: 15602 - protein, 177 aa, Artificial Sequence
  Synthetic sequence.
SVIERVEEEMEKVIRDSERVTKEVEDRAREVHERSEKRIRRDHMVLHEYVNAAGITGVDKRILDELRKRIKDSREDLERINEELRRALRKLLEDSKRINEELRKTLEELRKRLERVDDEEEVKKLAEEVRRLVEDSIRKLEELARRVDELVRESIERVDRNVEENKRLVREAIERRR

SEQ ID NO: 15603 - protein, 179 aa, Artificial Sequence
  Synthetic sequence.
SSKEVADELRKKAEKVLDELRKIIRELERKNEDSLRRTEERDHMVLHEYVNAAGITVRTRGEDDRLVREVERLLRELKRRLEELIRRSEELIKRSREEVDRVIRTVEKLLEELDRLLRANKGDIEDLRRTVDKLVEEIKDLARKLAKSSDDTVREDEKLVEELRKDVKRIVRKIKKDLE

SEQ ID NO: 15604 - protein, 183 aa, Artificial Sequence
  Synthetic sequence.
SEIEKLVEDVRKLVEDNLRHSEEVHRRNRRLIEENERKIDRDHMVLHEYVNAAGITAERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 15605 - protein, 174 aa, Artificial Sequence
  Synthetic sequence.
SEIEELEKRIDELLKELRDLSRRIAEEVKRLLEELKKLSKRDHMVLHEYVNAAGITGVPEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 15606 - protein, 174 aa, Artificial Sequence
  Synthetic sequence.
DELRDVKRELDRLLRENEEIVERIAETVRRLLEELKKLTKRDHMVLHEYVNAAGITGVPEKELKEVADTLRKLLKDIERSNKEVEDRLRKLLEEIKESTDRLREELEEVEKLLRGGKDVETVLRRVRELSRDNKRRMRRVLEEAKRLAKEDKERIDKIRKEIEELIKRLKDKAT

SEQ ID NO: 15607 - protein, 174 aa, Artificial Sequence
  Synthetic sequence.
DEEEDLERRIKKLLDENRELLKRIAEELRRLLEELRRLTERDHMVLHEYVNAAGITGVPEKDLRDVAEKVKKVLKESEDSNRDVKRKLEKLLRDLERSTERLEREARKVRKLLRDGKDIETLLRELEKLSRDNKELLKKIEKEIRDLIKEDKERNRELSERLRKLVEELKKKAT

SEQ ID NO: 15608 - protein, 174 aa, Artificial Sequence
  Synthetic sequence.
REIEEAAKDLDRLLEENKKLVKEVEEELRRLLKENRDLVKRDHMVLHEYVNAAGITGVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 15609 - protein, 177 aa, Artificial Sequence
  Synthetic sequence.
SEAEKVVEELKKLLREVEKKIRDHTEDVKRILEELERRLRRDHMVLHEYVNAAGITNSDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 15610 - protein, 174 aa, Artificial Sequence
  Synthetic sequence.
EELERILDKVRKVIEEVRKRLRDDLRTVEKVLKETEEVLRRDHMVLHEYVNAAGITARRGRDRREIKEELKKVLDDLRELLRALEEKNRRVNKENEDSLRKIEEDLRDVLRKLEEEIKGREVLRKVRELLRTIREEVERVLRKSNELSTRIKKRIDDVLETLERLLKELDDKLR

SEQ ID NO: 15611 - protein, 178 aa, Artificial Sequence
  Synthetic sequence.
SSKDEIRRRVEEVVERSDEIVKRSREHVKTVVDELDRVVKRDHMVLHEYVNAAGITRKDGGSEETLKRVLDELREILKELKEEVKKVKRKLEKVVKENRDTIREVEERNRKILDELRKRGVEERALREVEEISRKSEEKLRRVLKESEDIAKEAEDRLKTVLERVERIADEVLKRLTK

SEQ ID NO: 15612 - protein, 178 aa, Artificial Sequence
  Synthetic sequence.
SKVEKLEEEIARLVERSRRLVEELKKEVTKVKEKVDEIVERDHMVLHEYVNAAGITKRRGGSEEVLRRVTEELKKVLEDNRRVIEEVLRDLERILEELKRKAEEVTKRNRDDLKRLRDSGVDEEVLRRVEETSDRSEKELRTVLRDVTEDIKRIAEELKKALEDSTEIIRRAEDELRT

SEQ ID NO: 15613 - protein, 182 aa, Artificial Sequence
  Synthetic sequence.
SDADRVAEELKKLVEDSRRENERVIEESKRLVKENEDRNRRDHMVLHEYVNAAGITLEKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 15614 - protein, 175 aa, Artificial Sequence
  Synthetic sequence.
SEVDEVLREAKRIVDEVHKDNERATEESRRLVKKVHEENERDHMVLHEYVNAAGITNIDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 15615 - protein, 175 aa, Artificial Sequence
  Synthetic sequence.
SEMDDVLKKLAETVKRIIERLKKLTDDSRRLVEEVHRRNDRDHMVLHEYVNAAGITNIDEKDVRKLLEDLKKKSEEVAERNKRILDTLREISKRAEDEVRKVLKELEKTLKELEDRRPDVRELSEEVKKLLDEVRKALKRHKDENDKLLKEIEDSLRRHKEENDRLLEKLKESTR

SEQ ID NO: 15616 - protein, 178 aa, Artificial Sequence
  Synthetic sequence.
SEEEKLKEVKDRIREVLRKLEEHTDKVKKEVEKVLRDIRRRDHMVLHEYVNAAGITRRKKKDAEDLLRELEKIIEEIERELDRVLEENDKMAEEWKKLLDKVLDDNRKSIRDIEKELDDREPTDELVTEVEKLLRDDEETNRDVVKKVREAVKKDADTNRKVIEEVKKVLEDAARRLD

SEQ ID NO: 15617 - protein, 186 aa, Artificial Sequence
  Synthetic sequence.
SEVDEVRKTLEDLLRRLDEENKDIIRRNKELLDDLDRKVRRDHMVLHEYVNAAGITLEKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 15618 - protein, 186 aa, Artificial Sequence
  Synthetic sequence.
SRVDEVIERLERLLRELDKINRDMIEDDKRLNTELNKENKRDHMVLHEYVNAAGITRKKLSDEKTLEEIIERVERRLEELIERSKRRNREILERSKELIERSKKTNEEILRRAEELIKRLREEVKDIKEALDKIRRLEERARRVIEELDEKNRRALERSKENVKRLDERNERLRKELEEKVRRLRK

SEQ ID NO: 15619 - protein, 186 aa, Artificial Sequence
  Synthetic sequence.
DEIRELEERVRRILDELRRLVERNREVIERSIRELEKLLDRDHMVLHEYVNAAGITTRRGGDDKKTMLDDVRRLLREAEDHSRRSSETAKRIHRENEEHSKDSSRKVRKLIEELRELAKKVEKEITDERVKEAIKELVKDVDRVMREVDRANRELTKTSKKVLEDVDRTNRRLVKEVRDVVERARK

SEQ ID NO: 15620 - protein, 186 aa, Artificial Sequence
  Synthetic sequence.
KEVEDLERTVRTILKRMRELITRNEEEIRRSIEELKKLLKRDHMVLHEYVNAAGITKKEGGDDKKRLVEEIKRLLDELRENSKRSSDRAKEIHERNKRHSEESSRTIEKLLKELRDLVRDVERKLRDEDAKRKLDELTKRVEKVVREADERNKRLTKRSKEVLDEVHRANEEALKEVEEVVRRVTK

SEQ ID NO: 15621 - protein, 178 aa, Artificial Sequence
  Synthetic sequence.
KAAEEIRKKVEDYKRESEKILEEVEDHSRRSKETLKRLLDRDHMVLHEYVNAAGITKRRPRTEEIAKRAEEAVRRAAERIKKVIDDVERHIRENAKELKRLLEEDREASRRLEDEIDKEVKAREVADELKKRLKRANEESERVLRELAERNKTALEEAERVLRRLKEEIEKVLRKLKK

SEQ ID NO: 15622 - protein, 176 aa, Artificial Sequence
  Synthetic sequence.
REAEEAKEEVEELNRRNKKELDDARRRVDELDKRNKDRLKRDHMVLHEYVNAAGITKEEGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 15623 - protein, 179 aa, Artificial Sequence
  Synthetic sequence.
DEAEKAKRDSEKVVEDNRKMLEDSTRRAERLNEENKKELKRDHMVLHEYVNAAGITKRRGTDDEVVKDLIRRVEELLERSRKKLEDLTRDNERVLDESRRRLEKLIRDNERIVKDLTDRVVRVDEVLKRLKEEHRRLIEELEEVLRRNEEIIRRSIEDLERVLDRNRRELEDVIRRLKE

SEQ ID NO: 15624 - protein, 174 aa, Artificial Sequence
  Synthetic sequence.
SEEEVLREAAKTVEKLLDEIRRSLEKVSKRVEDSNRELKERDHMVLHEYVNAAGITRKNNVDRTLLEDVRRKLERIEERNEEMNDRSRRKLEELRERNRKILEDIRRTLEDLKRRQLPKDDVERTLREIAKLVDEVDKENKRALRENEERVKTLNRENEEMLKRIEEEVRRATK

SEQ ID NO: 15625 - protein, 182 aa, Artificial Sequence
  Synthetic sequence.
SELEKTLEDLKRHSEENKKKLEEDLRDMERNLKENKDRLKRDHMVLHEYVNAAGITFREGDIDERELERVRRKMEEIKKRLDENVERNRRKAEDIKRKLDENVKRSEDRVKEIKEDIRRRVRDKDKAEELERRLDELVKENREIHERVKKALDDIVKELEELHERLKRRLEEILRRIAETVR

SEQ ID NO: 15626 - protein, 186 aa, Artificial Sequence
  Synthetic sequence.
SEIEKLIEELRRELEKVKDELERSIEEMDRELDDVRRDSKRDHMVLHEYVNAAGITTKRGDRPEEVLRKELEDIKRKLRRILEEHHEKIRRIKEKLRRENKRVRDELKRIKDEIDEKVKDVRRKGADEELLKRLEEVAEDVKRALEELLKKHTRVVERVEKALDELDKELERIVREAEKELDRREK

SEQ ID NO: 15627 - protein, 179 aa, Artificial Sequence
  Synthetic sequence.
RLEDEVRKMEKEVREEVKRLEDESRKVLEESRRNLDKLRERDHMVLHEYVNAAGITRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 15628 - protein, 174 aa, Artificial Sequence
  Synthetic sequence.
SESDEVIRDLARLLDELARHVDDSVRRMDEVVKRSTREADRDHMVLHEYVNAAGITPGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 15629 - protein, 174 aa, Artificial Sequence
  Synthetic sequence.
SESDDVIRKLRELLEELRTHVEKSIRDLRKILEDSTRHAKRDHMVLHEYVNAAGITPGDEEVRKTVEEISRRVAENVKRLEDLYRRMEEEVKKNLDRLRKRVEDIIREVEEARKKGVDEEKLKDLIRKLRDILRRAAEAHKKLIDDARESLERAKREHEKLIDRLKKILEELER

SEQ ID NO: 15630 - protein, 172 aa, Artificial Sequence
  Synthetic sequence.
SRAETVLKEVTDKIKKLADSSDELLRRNKENIDELKKSSERDHMVLHEYVNAAGITSVDEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 15631 - protein, 177 aa, Artificial Sequence
  Synthetic sequence.
DEVRELLERNRRLLEEIKKTVKDLIRANEELLKRIEDDAKRDHMVLHEYVNAAGITLSDDETIREAKERLKASLEDVKRRVEEVKRLLEKSLEEVETIIREAEKRNRDSLREMERRGSSEELEELRRVVEESDETIKRLLEEAKESVDRSLDRIRKLLEDVRRSVERSAKRIDEKRK

SEQ ID NO: 15632 - protein, 180 aa, Artificial Sequence
  Synthetic sequence.
STEEVLDEIRKLHKTLTEDIKRVLREIEELHRRTIEENKERDHMVLHEYVNAAGITRTKDTPNVEKLLKDLEKSAKENIEHNERTLREDDRVLKEIRRRATELLKANEEMLRRIEEVARKGGVDAEELLRESKEAIKEVKRVLEELRKESKRVVDETRKLSEENLEHSERVLRKVEEDLR

SEQ ID NO: 15633 - protein, 188 aa, Artificial Sequence
  Synthetic sequence.
SEIEKILKEIEDLARRDEEVSKKIVEDIRRLAKEVEDTSRRDHMVLHEYVNAAGITLRKDGSKEELEKEVREVVKTLEELVKDNHRLIRRAVEEMKRLVEENHRHSREVVKELEDLVRELRKGSGSEDSERLVREVEDLVRRLVRRSEKSNEEVKRTVEELVRRMEESNDRVRDLVRRLVEELKRAVD

SEQ ID NO: 15634 - protein, 186 aa, Artificial Sequence
  Synthetic sequence.
SEAERLEARARELLRANEELMDDLRAKAEELLKRNDRLVKRDHMVLHEYVNAAGITKRRGEPKEEVARKIEEILRRLEETLRRIKEESDRLDEELKRELERVKRESEELDRELRKLIEDVERRGSGSKRLEELLRRLNEEHKRISDELRKLLDEALEAHRELSRRLEEELERLLREIERLVEEVTR

SEQ ID NO: 15635 - protein, 184 aa, Artificial Sequence
  Synthetic sequence.
DDLERAREEVADLIRKHEEKTRRILEESRRLNERHRELSARDHMVLHEYVNAAGITIKRERGKDELRRKVEDLEARVEDLIRRLEEHLRRVHDKDRRLIEDLRRHLKRVVEELKRLIDELRRGVPKEELDRIEEELKRLIDTLREKNREVEKRARDSNRDLKRTNDEIAKEVRELIKKLREDLK

SEQ ID NO: 15636 - protein, 174 aa, Artificial Sequence
  Synthetic sequence.
DEEEDLERAIKKLLDENRELLKRIAEELRRLLEELRRLTERDHMVLHEYVNAAGITGVPEEDLADVAEKVKKVLKESEDSNADVARKLEKLLRDLERSTERLEREARKVRKLLRGGKDAETLLRELEKLSRDNKELLKKIEKEIRDLIKEDKERNIELSERLRKLVEELKKKAT

SEQ ID NO: 15637 - protein, 184 aa, Artificial Sequence
  Synthetic sequence.
DEIRKVVKEITDLLKASNDKNRKVVEEIRDLLRKSKKLADRDHMVLHEYVNAAGITIDKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 15638 - protein, 184 aa, Artificial Sequence; identical to SEQ ID NO: 15637
  Synthetic sequence.

SEQ ID NO: 15639 - protein, 176 aa, Artificial Sequence
  Synthetic sequence.
STAETVEKKVEEVIRENEKSMRESEEKVDRSTKRIEDVLRRDHMVLHEYVNAAGITVKGERVKEVLEENRRLLEEAKKLVDEVLETNKKLLEDDKRLNEEVSKTLKKLLEEIKSVDTREDATRVIEEAKRILDEARKLNEETIRRSEELVRRIERVIEEIIKRSEKLLEDVARESK

SEQ ID NO: 15640 - protein, 186 aa, Artificial Sequence
  Synthetic sequence.
SRVEEIIEDLRRLLEEIRKENEDSIRRSKELLDRVKEINDRDHMVLHEYVNAAGITVREKGSESEEVKKALRAVLEELEKLLRRVAEINEEVLRRNSKLVEEDERRNREVLKELARLVEELIREIGDEDKARKVAEVAEKVLRDIDKLDRESKEAFRATNEEIAKLDEDTARVAERVKKAIEDLAK

SEQ ID NO: 15641 - protein, 186 aa, Artificial Sequence; identical to SEQ ID NO: 15640
  Synthetic sequence.

SEQ ID NO: 15642 - protein, 180 aa, Artificial Sequence
  Synthetic sequence.
REVEEMIKELEELLKDLKEKNERASKRNRELVRRLEEENKRDHMVLHEYVNAAGITVRSGEDEEVLREVLKRLEEVLERVRALNERVLEAIEKSLEEVKASNEAVKRRLKELLEEAERGVDSEKLKELRDVIAEVAKRIDELDEYTRESIRRAKKEIERLNRETKKVIEEVVKRIEEERK

SEQ ID NO: 15643 - protein, 181 aa, Artificial Sequence
  Synthetic sequence.
SEVDDVLRRLEELIKTLEDINAKSLEDIKKLIDDLAKILERDHMVLHEYVNAAGITKKGIDSREAEEIAKRVLEELKRTSDDLRKKVERVDEDLRRLLRENHERNKKILRDLERLLRDAARRGVPKEALDRMREEIRRLEEESRKSDETIERLIRELRRRVEEVLKTSTDLIRELEEEVKK

SEQ ID NO: 15644 - protein, 183 aa, Artificial Sequence
  Synthetic sequence.
SKLEEVEKAVRKVIEDSRRVNEEVNRRSEEVVRELEKVHRRDHMVLHEYVNAAGITLKGSGDERLAAEVERIIEEIRELNERDRKRVEEIRKEIEDLNRDLNRRSKESEDRLRKLLEDATRGGVTKEADEVVERAERISEENKRRVEDVARKSKELVEDVRRHSEEVVRRVEELVKEVEERVR

SEQ ID NO: 15645 - protein, 180 aa, Artificial Sequence
  Synthetic sequence.
DEVEDVLRKIEKILDDHRKRIEKNSRDMARIIDEHRRKVERDHMVLHEYVNAAGITVDRGEGDEETAEDVKAKLEKSNRELEKHSEEVKRALDESNEDLRRHSEEVKERIERLVKKLREDGVEREEELKEVADRVKEKLDRLNRENEKSSEELKRELDKINDENRETSERLKREIDETTR

SEQ ID NO: 15646 - protein, 185 aa, Artificial Sequence
  Synthetic sequence.
SSVEELLERLRRISEENKRRIEKLLREVEKVLRELKDRHRRDHMVLHEYVNAAGITIKSGLPEEAVKRVLERVRERVKEVLEEADRLNDEMRRIVTEVEKELDKSDKEVEDAVRDILKKIEEGVRDRETAERARETLKRLLDENRDRSKKVKEEIRRILEDLTRTTERVKREIAKLLKELEDTAR

SEQ ID NO: 15647 - protein, 238 aa, Artificial Sequence
  Synthetic sequence.
EEDERLTKRVEEIKRENRELLRRLEEEVKELERKSEKIVRRDHMVLHEYVNAAGITKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 15648 - protein, 238 aa, Artificial Sequence
  Synthetic sequence.
SKEDKARELEKRLRDNLKKLEEVVRELAEVLKRNLEKLRRRDHMVLHEYVNAAGITRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRDIRRELKELEERARKILRDDERDLRALEKRIRDIIREDREELERLKERARK

SEQ ID NO: 15649 - protein, 244 aa, Artificial Sequence
  Synthetic sequence.
SAEETLRRITEESKRVLEEITKKYEDLERESREVLRKLRERDHMVLHEYVNAAGITGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 15650 - protein, 244 aa, Artificial Sequence; identical to SEQ ID NO: 15649
  Synthetic sequence.

SEQ ID NO: 15651 - protein, 247 aa, Artificial Sequence
  Synthetic sequence.
SEKEELLKLIKRVIELLKRVLEEHLRLVEDVIRRLKELLDRDHMVLHEYVNAAGITLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRNLEDVRRVIEDVKRKSARILEEARRLIEEVERELEKIRK

SEQ ID NO: 15652 - protein, 247 aa, Artificial Sequence; identical to SEQ ID NO: 15651
  Synthetic sequence.

SEQ ID NO: 15653 - protein, 238 aa, Artificial Sequence
  Synthetic sequence.
SEAEKIREALETNLRLLEELIKRLKEILDTHNELLRRVIERDHMVLHEYVNAAGITGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 15654 - protein, 238 aa, Artificial Sequence; identical to SEQ ID NO: 15653
  Synthetic sequence.

SEQ ID NO: 15655 - protein, 242 aa, Artificial Sequence
  Synthetic sequence.
SEKERLMRLLDKLKDLNRRLVERIKELLDKALELHKKLVKRDHMVLHEYVNAAGITGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLREALKKLEDDLRKIERDAEREYKKLKDELEELTERYRREIRKLKEELKADRK

SEQ ID NO: 15656 - protein, 242 aa, Artificial Sequence; identical to SEQ ID NO: 15655
  Synthetic sequence.

SEQ ID NO: 15657 - protein, 247 aa, Artificial Sequence
  Synthetic sequence.
SEAEDLEELIKELAELLKDVIRKLEKINRRLVKILEDIIRRDHMVLHEYVNAAGITTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRETHKKIEKELREALKRVRDRST

SEQ ID NO: 15658 - protein, 240 aa, Artificial Sequence
  Synthetic sequence.
SDKEEIKRRVEKTARDLETEHDKIKKRLEDTVRDIKRELDRDHMVLHEYVNAAGITLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 15659 - protein, 240 aa, Artificial Sequence; identical to SEQ ID NO: 15658
  Synthetic sequence.

SEQ ID NO: 15660 - protein, 248 aa, Artificial Sequence
  Synthetic sequence.
DEEERVKKLLTDLRRLLRKLHEESKKLLDELRKKLRELRRRDHMVLHEYVNAAGITEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDENLKMVERLIRELEKVLDDHERKVRRLIEELLEVLDRDAK

SEQ ID NO: 15661 - protein, 248 aa, Artificial Sequence
  Synthetic sequence.
DEDRIIEEIARLLEELLRELLELIKKLIETNRRLNEEHERRDHMVLHEYVNAAGITVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 15662 - protein, 238 aa, Artificial Sequence
  Synthetic sequence.
DADELLRRLAEEVERVIREAEDLLRRWKETIKKVLDDLKRRDHMVLHEYVNAAGITTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 15663 - protein, 236 aa, Artificial Sequence
  Synthetic sequence.
STREKAKKVLDTLRADNEDMKRVVEKILRALKRTNERAEKRDHMVLHEYVNAAGITGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 15664 - protein, 236 aa, Artificial Sequence; identical to SEQ ID NO: 15663
  Synthetic sequence.

SEQ ID NO: 15665 - protein, 247 aa, Artificial Sequence
  Synthetic sequence.
SKAEKLLKDLREALEKVKRRYEELERRLDEVLKEHEEIVKRDHMVLHEYVNAAGITGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTIERLIEESIRVNEELLEVIERLLDRARK

SEQ ID NO: 15666 - protein, 247 aa, Artificial Sequence; identical to SEQ ID NO: 15665
  Synthetic sequence.

SEQ ID NO: 15667 - protein, 243 aa, Artificial Sequence
  Synthetic sequence.
DLERVVEDIVDKAKRLLDKNLEVLKRIVDEVLRLLERLLRRDHMVLHEYVNAAGITVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDEDLLTELEKKLRKLKRDSEKVVDDLKKELERIKREVKRLIEENARTLADIKRAVDEARK

SEQ ID NO: 15668 - protein, 239 aa, Artificial Sequence
  Synthetic sequence.
SERELIERWLELHKEILRLIRELVERLLKLHREILDTIKKRDHMVLHEYVNAAGITGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERTLKKLLDDSARMAEEVKKTLKELLERSEKVAEDVRK

SEQ ID NO: 15669 - protein, 246 aa, Artificial Sequence
  Synthetic sequence.
KEIEETLKELEDLNREMVETNRRVLEETRRLNKETVDRVKRDHMVLHEYVNAAGITVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVEELEKALEEIKRRLKEVIDRYEDELRKLRKEYKEKIDKYERKLEEIERRERT

SEQ ID NO: 15670 - protein, 231 aa, Artificial Sequence
  Synthetic sequence.
SKEEEVEKVLRKWEEILRRLIEENKRANDKIRREYEELVKRDHMVLHEYVNAAGITGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 15671 - protein, 247 aa, Artificial Sequence
  Synthetic sequence.
RDRDVLRKVKAEIEELVARIEKVSRDALSEVKRLLDENRKRDHMVLHEYVNAAGITRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 15672 - protein, 231 aa, Artificial Sequence
  Synthetic sequence.
SKDEELARLLEELVERWRKIVEDLERDHRRLVKEIRELVERDHMVLHEYVNAAGITGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 15673 - protein, 231 aa, Artificial Sequence; identical to SEQ ID NO: 15672
  Synthetic sequence.

SEQ ID NO: 15674 - protein, 238 aa, Artificial Sequence
  Synthetic sequence.
SEIEDVIRRLRKILEDLERVSEKLLREIKKILDEARRLNERDHMVLHEYVNAAGITFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKRIKEASDKVREDVDRLIKELKEAAD

SEQ ID NO: 15675 - protein, 237 aa, Artificial Sequence
  Synthetic sequence.
KEKEDALKKLEDLARKSREDLERVLRKHKKILDKIEELLKRDHMVLHEYVNAAGITTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 15676 - protein, 237 aa, Artificial Sequence; identical to SEQ ID NO: 15675
  Synthetic sequence.

SEQ ID NO: 15677 - protein, 229 aa, Artificial Sequence
  Synthetic sequence.
SKEERLREVAEKHKKDLEDIVKRVDEAAKETARRLEEILKRDHMVLHEYVNAAGITPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 15678 - protein, 246 aa, Artificial Sequence
  Synthetic sequence.
SEREELLERIKEILKRVKDKLDEDLKRLKEILEKLKEKADRDHMVLHEYVNAAGITLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETVRELIERLKRVLEEAIEVVERVAR

SEQ ID NO: 15679 - protein, 246 aa, Artificial Sequence; identical to SEQ ID NO: 15678
  Synthetic sequence.

SEQ ID NO: 15680 - protein, 240 aa, Artificial Sequence
  Synthetic sequence.
DREKSVRDIEEDLKRVLDKLRRRVETSKEELKKVLKADKERDHMVLHEYVNAAGITDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 15681 - protein, 240 aa, Artificial Sequence; identical to SEQ ID NO: 15680
  Synthetic sequence.

SEQ ID NO: 15682 - protein, 237 aa, Artificial Sequence
  Synthetic sequence.
REDEVLRDIERLLREIEEKIRRILEESTAELRKVEEEVKRRDHMVLHEYVNAAGITERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 15683 - protein, 243 aa, Artificial Sequence
  Synthetic sequence.
SEAERLADEVRKAVKKSEEDNETLVREVEKAVRELKKNNKRDHMVLHEYVNAAGITLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 15684 - protein, 243 aa, Artificial Sequence; identical to SEQ ID NO: 15683
  Synthetic sequence.

SEQ ID NO: 15685 - protein, 245 aa, Artificial Sequence
  Synthetic sequence.
SEKDEVTRRIRELLKEAEETNREAIERIKRLLDRVREAVERDHMVLHEYVNAAGITLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 15686 - protein, 245 aa, Artificial Sequence; identical to SEQ ID NO: 15685
  Synthetic sequence.

SEQ ID NO: 15687 - protein, 232 aa, Artificial Sequence
  Synthetic sequence.
SEKELVDDIRRILEEILRLLRSLLEEVIRLLEENEKLVRRRDHMVLHEYVNAAGITDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDDLLKTSRDLVKRVLDLVDEVVKRVEDLVERVKEKIDT

SEQ ID NO: 15688 - protein, 247 aa, Artificial Sequence
  Synthetic sequence.
DEERLAEELERVLDRNRKLLEEALRELRRVIEENRKSVKRRDHMVLHEYVNAAGITRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTEEDVERAVKEIRDRLRKLLEDYERAVRRLEDKLRRVRERYEAVLKRIKDKLEETKR

SEQ ID NO: 15689 - protein, 240 aa, Artificial Sequence
  Synthetic sequence.
DKDKRLEELLKRLKELNDKTFEELERILEELKRANEASLRRDHMVLHEYVNAAGITNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 15690 - protein, 240 aa, Artificial Sequence
  Synthetic sequence.
SKEETLKRLLDELEKRNRETVERLERLLKELEDRNRASLERDHMVLHEYVNAAGITGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 15691 - protein, 240 aa, Artificial Sequence; identical to SEQ ID NO: 15690
  Synthetic sequence.

SEQ ID NO: 15692 - protein, 243 aa, Artificial Sequence
  Synthetic sequence.
DEEETLRRLLERKVELAKEYLDVSKEVIDRTTKLLDEYLKRDHMVLHEYVNAAGITDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 15693 - protein, 243 aa, Artificial Sequence
  Synthetic sequence.
SEAERTKESLKKVLKALVDLNRELLRKLEENMRELTKLNERDHMVLHEYVNAAGITGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 15694 - protein, 182 aa, Artificial Sequence
  Synthetic sequence.
DEAEKLLKELRDLLEESRKDLERLLKELEDLLEESKRDLERRDHMVLHEYVNAAGITERRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 15695 - protein, 184 aa, Artificial Sequence
  Synthetic sequence.
SLEEVIKTVRKLLEEVERRLREVVERAERMLEEVRRRTREVRDHMVLHEYVNAAGITDKNVSEEIEEKLRKIKEELERDNEKVNRDNERSVETLRRLLDRVRKEVKDIAKELEERLKEVERKSRDDRIVEKLLRDAERIVKRLRELIEKLREEVEKIVDENRKTVEELRRRNEEIVRRLRREIE

SEQ ID NO: 15696 - protein, 181 aa, Artificial Sequence
  Synthetic sequence.
SLDEVVKRLEDLLREVEEKSKESSKRMEDLNREVNERLRRSRDHMVLHEYVNAAGITDAGRDDKIRRTLERLSEDTKRKSDKTNEDLKRLSDETRERSKRLNEELRRLVEEVRRRLEDLRRKGSPVEEIKKLADKVVTELEKLVEDDRRLAEESFERARKIVEEDERLARESVDRARRLVD

SEQ ID NO: 15697 - protein, 181 aa, Artificial Sequence
  Synthetic sequence.
SEVERVLEDLRRLVRDVEEKLRRIIERDRRLVEEVERENRKRDHMVLHEYVNAAGITKDISDKKTIERIVREIIKEARDLVRRNHERNREIVDESRRLVEELRRIVEEIIRRLRELLERVKSGELAERIEDVVREAEKRLRELLKELEKTSRDLKKRLEELDRELKALVEKVERDLEELRK

SEQ ID NO: 15698 - protein, 177 aa, Artificial Sequence
  Synthetic sequence.
KEEEDLEREVKRLEDKVREDAKKLEEVVKTVEKLVRDDARRRDHMVLHEYVNAAGITERKLDEETLRKVKEDLKRTLERLKRENEKSLEELRDILRRLKKENDDTLKELRDELKRLTDSGASEDVIRKMEEIIKRLEEVSREVEKRLRRIIRELERVSKEVLDRLREIIEKLDRDAT

SEQ ID NO: 15699 - protein, 174 aa, Artificial Sequence
  Synthetic sequence.
SEDETIRRIVRTVHEESRKSTEDVRREVERVLRESEEVVKKRDHMVLHEYVNAAGITISEELEERMRRIIREIREHLKDNLRRVREVIERIERKLEETERRDEKVLREIEKKIRDGDGREEVAREVTKIARDTIRENEEIAKEVREIVERSIKNLEEVAEEVERVVRELIEARR

SEQ ID NO: 15700 - protein, 174 aa, Artificial Sequence
  Synthetic sequence.
SRDEKIRDILRRVLKEVRDSTKKVEEDLEDVHRRTEEELRKRDHMVLHEYVNAAGITASEELKRRMEEVVRRIEELLKKLLKEDRDVVKEIRDKLDETRKEMEEVAERIKDKIRRGDGREKVAEEVKRIADRLIDLNRRIAEEVDKIVRDSIKKVEEIVTEVEKIVEKLIRDVR

SEQ ID NO: 15701 - protein, 179 aa, Artificial Sequence
  Synthetic sequence.
STREDARRLVERVRKEVKRLLKKNSDLLREVTERVKTLNERRDHMVLHEYVNAAGITDSDERDVERLLDRARKLVKESEDLIRKLLKDLRELVRRSEKDIDELRKELKRLLDELRARATDKDLERVVREIEKEIRDLIRELEENVKTSEKLIEDLIRELEKSVDESRKRVEELVKELRT

SEQ ID NO: 15702 - protein, 174 aa, Artificial Sequence
  Synthetic sequence.
SELEKVVKEVADLLRRNLEKSKRVLEEVRRRLEENLRESEKRDHMVLHEYVNAAGITREGKDKRDLTRLLEEDDKRVKEALDKSRENNERILKEVRRALRESEEDNRRILKEVREKVDSRLLEELEERVRESIERSRRFIEELEKIVEETLTESEKLARASSEITKTVLDEIRK

SEQ ID NO: 15703 - protein, 178 aa, Artificial Sequence
  Synthetic sequence.
DDLERVLKEIKKAADKIREDNKRTADKIRKRVKELDDETRDRDHMVLHEYVNAAGITRGREEARKVIEELKKLVDEVRKRNEKSIEELKKLLKEDRDLMRRVIEELEDLVRRLREEVRDDEALRRVEEEVERLIRDLRRVLKETSDRVRELIDKHRRLSEEVEKDVKRLIDELKKKTD

SEQ ID NO: 15704 - protein, 187 aa, Artificial Sequence
  Synthetic sequence.
DEEEELRKRLEKLSKEVRELLRRDEEEDRRLNRELEELLKDRDHMVLHEYVNAAGITRKARRKVSEEELTRLRKKLRDLEEESKEALRELRRRVEELNKENKKSLDDLERRLKELEDRAREVEKRDRREDELRELLRRLEDVIRKLAEDLKRNTEDLRRVIKELAERLEELNKRLKREIRRLKEELR

SEQ ID NO: 15705 - protein, 177 aa, Artificial Sequence
  Synthetic sequence.
SVLEEVRRRVEELLKTVKESVDRSHERSERLIEEVRESLKERDHMVLHEYVNAAGITIPEDRVKRIEDKLREELERLERENRKIEEDLKRSNDELRRENERIAERLEELLRELSRDTNDKVARDVLEEIERLIREANERNKRNLEDVERVIRELNKENERVLREVEKKIEKLIRETE

SEQ ID NO: 15706 - protein, 178 aa, Artificial Sequence
  Synthetic sequence.
SSIERVEKEVRRLLRESDESLKRVMEEAKELIKSVRESTKRRDHMVLHEYVNAAGITGDEREDLRRVLEELRKLIEDNRREDKRSEDELRKLIRDNKEENDRARREAEKLLEDLSRGRSEEEVERVLEEVRRIIEKLKEDDKRSLERIERIVRRNNELNKESVDRIRKIIKEMEERAD

SEQ ID NO: 15707 - protein, 183 aa, Artificial Sequence
  Synthetic sequence.
KDAEDLERRVRELVEENNRVSKRLAEEVTRLVKENEDKVRERDHMVLHEYVNAAGITRRGEVREEEVKRVLREIEELLREITEHSKEVLKTIEKLLRDSLEHSRRVLEEIERLLETILRKSKDSERLKKLVDELRETLERSLRENEKVADELRKRAEKSLEDVKRVVDELRKIVDDVLKRVED

SEQ ID NO: 15708 - protein, 183 aa, Artificial Sequence
  Synthetic sequence.
SEIEKLVEDVRKLVEDNLRHSEEVHRRNRRLIEENERKIDERDHMVLHEYVNAAGITERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 15709 - protein, 177 aa, Artificial Sequence
  Synthetic sequence.
REIEELRKEIETLIRENEELNRRSKETSEELIRRLKKLNRDRDHMVLHEYVNAAGITAPEEDVRRAEERVKKLIEDNKRHSDEVAKTDKKLNEDSERHTRRVEERLRELLDRLSRSDKDEVVRRVAEEARRLSKRNKDAIREVNETSRRLATRDAKHTRDVLREIKRLADEIRERTR

SEQ ID NO: 15710 - protein, 181 aa, Artificial Sequence
  Synthetic sequence.
EEIERALREMRELSRTHKELVEKILRDIAELAKTHERINEDRDHMVLHEYVNAAGITRKEDKKEELKRKIDELRRRAEELLKESKEHLKRLEDTVRELIERLKETLKKVEEDLKRILEKLEKSRELDEIAKDVKRLIDENRELLKRVEDEVRRLIRKLEELNRRTEEEVKKLIKKLEDDLK

SEQ ID NO: 15711 - protein, 174 aa, Artificial Sequence
  Synthetic sequence.
SEIEELEKRIDELLKELRDLSRRIAEEVKRLLEELKKLSKDRDHMVLHEYVNAAGITVPEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 15712 - protein, 174 aa, Artificial Sequence
  Synthetic sequence.
DELRDVKRELDRLLRENEEIVERIAETVRRLLEELKKLTKERDHMVLHEYVNAAGITVPEKELKEVADTLRKLLKDIERSNKEVEDRLRKLLEEIKESTDRLREELEEVEKLLRGGKDVETVLRRVRELSRDNKRRMRRVLEEAKRLAKEDKERIDKIRKEIEELIKRLKDKAT

SEQ ID NO: 15713 - protein, 174 aa, Artificial Sequence
  Synthetic sequence.
DEEEDLERRIKKLLDENRELLKRIAEELRRLLEELRRLTEERDHMVLHEYVNAAGITVPEKDLRDVAEKVKKVLKESEDSNRDVKRKLEKLLRDLERSTERLEREARKVRKLLRDGKDIETLLRELEKLSRDNKELLKKIEKEIRDLIKEDKERNRELSERLRKLVEELKKKAT

SEQ ID NO: 15714 - protein, 174 aa, Artificial Sequence
  Synthetic sequence.
REIEEAAKDLDRLLEENKKLVKEVEEELRRLLKENRDLVKERDHMVLHEYVNAAGITVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 15715 - protein, 177 aa, Artificial Sequence
  Synthetic sequence.
SEAEKVVEELKKLLREVEKKIRDHTEDVKRILEELERRLRKRDHMVLHEYVNAAGITSDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 15716 - protein, 182 aa, Artificial Sequence
  Synthetic sequence.
DEIETVLDEVRRLHEDAKRRLEEMIDEVRKLNEESVRELARRDHMVLHEYVNAAGITERAGLDKGKLEELEERLERVREDVERILREIKRRNEKTLEDSERILEENKERNRTVLKKLKELRDRGSDAREALKESRKVVEESRESVRRVLEKNRRVVEESKRLAEELLRRVKKVVDEIRKRVE

SEQ ID NO: 15717 - protein, 177 aa, Artificial Sequence
  Synthetic sequence.
DEVEDILRKVEEIVKKSITDARRLLKEAREIVEESIKTAEERDHMVLHEYVNAAGITKRTTDEEKKKKLEEESRRVLEKTKRDLDRTKDDNRKALEKIRKRVKETEEENREVVDRVRKAGVDKRVLEKIKKVVDDSVRVNREVLKRVEEVLEESKRVNEKVEEDVRRVHEEVRKEIK

SEQ ID NO: 15718 - protein, 175 aa, Artificial Sequence
  Synthetic sequence.
SEVDEVLREAKRIVDEVHKDNERATEESRRLVKKVHEENEERDHMVLHEYVNAAGITIDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 15719 - protein, 175 aa, Artificial Sequence
  Synthetic sequence.
SEMDDVLKKLAETVKRIIERLKKLTDDSRRLVEEVHRRNDKRDHMVLHEYVNAAGITIDEKDVRKLLEDLKKKSEEVAERNKRILDTLREISKRAEDEVRKVLKELEKTLKELEDRRPDVRELSEEVKKLLDEVRKALKRHKDENDKLLKEIEDSLRRHKEENDRLLEKLKESTR

SEQ ID NO: 15720 - protein, 186 aa, Artificial Sequence
  Synthetic sequence.
SEVDEVRKTLEDLLRRLDEENKDIIRRNKELLDDLDRKVRERDHMVLHEYVNAAGITEKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 15721 - protein, 183 aa, Artificial Sequence
  Synthetic sequence.
SEVDEVLERIKRLLERLAEHSDKVVRDIEKLLDDNRKENERRDHMVLHEYVNAAGITRRGDLREELLERVVREVEKEIRDIKRKNKRSVETVEKLVRDDRKELKRALEDVERLIRELETRLKDKEELRRKLEKVLREAEKVIDELLKKTDEVLKRARETIEDLNRKLDKVLKEVRDKLDRLRD

SEQ ID NO: 15722 - protein, 185 aa, Artificial Sequence
  Synthetic sequence.
DDIERLKREIERLLKEAEKISRDNEERSKELLDRLRKLSEDRDHMVLHEYVNAAGITDKIKDKEELTRRLKEVVDRVEKSVRDSERMLREVVREDEESVRRSKTKLEDLLRKVEELVRRLEKKVTDEKVKRDAREALRKAKKKVDELKRKNDEVHRRSREEVKRLLEENRKLLEDLRRMVREITQ

SEQ ID NO: 15723 - protein, 184 aa, Artificial Sequence
  Synthetic sequence.
ELIKKARKDVEEVRERSERLVDELRKRNKKLADESRRLIDKRDHMVLHEYVNAAGITRKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 15724 - protein, 186 aa, Artificial Sequence
  Synthetic sequence.
KEVEDLERRVKEILDRMKRLIDENRKKIEKSIRELERLIDERDHMVLHEYVNAAGITREGGDDARTLRERVRKIIEDVEEHSRRSTEEVRRIHKENKEHSERSSDEIRELLRRVEELIEEVKRRLRDKEMEKKLEDIVRRVREVVRRAHETNERLVDRSRKAVEKAERTNRRLVEEIRKVAEEVRK

SEQ ID NO: 15725 - protein, 186 aa, Artificial Sequence
  Synthetic sequence.
KEVEDLERTVRTILKRMRELITRNEEEIRRSIEELKKLLKERDHMVLHEYVNAAGITKEGGDDKKRLVEEIKRLLDELRENSKRSSDRAKEIHERNKRHSEESSRTIEKLLKELRDLVRDVERKLRDEDAKRKLDELTKRVEKVVREADERNKRLTKRSKEVLDEVHRANEEALKEVEEVVRRVTK

SEQ ID NO: 15726 - protein, 176 aa, Artificial Sequence
  Synthetic sequence.
REAEEAKEEVEELNRRNKKELDDARRRVDELDKRNKDRLKERDHMVLHEYVNAAGITEEGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 15727 - protein, 174 aa, Artificial Sequence
  Synthetic sequence.
SEEEVLREAAKTVEKLLDEIRRSLEKVSKRVEDSNRELKESRDHMVLHEYVNAAGITKNNVDRTLLEDVRRKLERIEERNEEMNDRSRRKLEELRERNRKILEDIRRTLEDLKRRQLPKDDVERTLREIAKLVDEVDKENKRALRENEERVKTLNRENEEMLKRIEEEVRRATK

SEQ ID NO: 15728 - protein, 182 aa, Artificial Sequence
  Synthetic sequence.
SELEKTLEDLKRHSEENKKKLEEDLRDMERNLKENKDRLKKRDHMVLHEYVNAAGITREGDIDERELERVRRKMEEIKKRLDENVERNRRKAEDIKRKLDENVKRSEDRVKEIKEDIRRRVRDKDKAEELERRLDELVKENREIHERVKKALDDIVKELEELHERLKRRLEEILRRIAETVR

SEQ ID NO: 15729 - protein, 186 aa, Artificial Sequence
  Synthetic sequence.
SEIEKLIEELRRELEKVKDELERSIEEMDRELDDVRRDSKRRDHMVLHEYVNAAGITKRGDRPEEVLRKELEDIKRKLRRILEEHHEKIRRIKEKLRRENKRVRDELKRIKDEIDEKVKDVRRKGADEELLKRLEEVAEDVKRALEELLKKHTRVVERVEKALDELDKELERIVREAEKELDRREK

SEQ ID NO: 15730 - protein, 179 aa, Artificial Sequence
  Synthetic sequence.
RLEDEVRKMEKEVREEVKRLEDESRKVLEESRRNLDKLREERDHMVLHEYVNAAGITRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 15731 - protein, 183 aa, Artificial Sequence
  Synthetic sequence.
RVDERLDTVLKRVEETVRENKKKNDELLERSKENIDRLKKRRDHMVLHEYVNAAGITREVTKEEVKKIIDEVLKEIEDLLRTVKEELDRALERNREVVEETKRRIDRVLKEIEKLIRDVKRDRKEEVVKEVEERIKKLLKEVNDTSKDAERRLRETNERLNEIVKEVEKRIRELSEEVRKRVK

SEQ ID NO: 15732 - protein, 183 aa, Artificial Sequence
  Synthetic sequence.
SIEDEIRKLKEDIKRVLDKVRRDNERLKERLDKVLEDIRRSRDHMVLHEYVNAAGITDKPVDERLVRKVEEAVKRLKEHNEDSTRRVEEVIRRLKEESEESVRKTEKVARDLERELDEVLTRGGEERVREVIEKLKETLERLKREDKEVADRAEKLLREAEEHNKRSLDESRRVLEELDEEIR

SEQ ID NO: 15733 - protein, 172 aa, Artificial Sequence
  Synthetic sequence.
DEVEKVLEEIKRALDDLRKKVEESKREIKEALKAVEKHTRDRDHMVLHEYVNAAGITKSKDTERVRKLVEELSEENERSLREVRRVAEELLEINERVLEEVERVVEALLDLVRRGGSERVVEEVRRVLEELRRRLEKVTEDSRRAIERLAREDARVSKKSIDVNKKLDDDVR

SEQ ID NO: 15734 - protein, 174 aa, Artificial Sequence
  Synthetic sequence.
SESDEVIRDLARLLDELARHVDDSVRRMDEVVKRSTREADERDHMVLHEYVNAAGITGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 15735 - protein, 174 aa, Artificial Sequence
  Synthetic sequence.
KEVEDAVKELEDLLRANEDKTRSIVEDMRASNKDLEDHSRARDHMVLHEYVNAAGITVPRDSLKRLAEDVERVTRESRELLERVHRADRELIERLKESNERLRRAIEEIRKAIKGGSDIKTLLDRVRKLAEEDAERLDRLRRESEELNERVRRVDKKLLEEIRRKAKKVEDDTR

SEQ ID NO: 15736 - protein, 184 aa, Artificial Sequence
  Synthetic sequence.
DEIRKVVKEITDLLKASNDKNRKVVEEIRDLLRKSKKLADERDHMVLHEYVNAAGITDKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 15737 - protein, 176 aa, Artificial Sequence
  Synthetic sequence.
STAETVAEEVERVLKHSDDLIKEVEDVNRRVEEEIKRVIRERDHMVLHEYVNAAGITKGEILAEIEKRLADNSEKVREVAERAKKLLEENTARVKDILRESRKLVKDLLDEVRGTGSEEAAREIIKRLREVNKRTKEKLDELIKHSEEVLERVKRLIDELRKHSEEVLEDLRRRAK

SEQ ID NO: 15738 - protein, 186 aa, Artificial Sequence
  Synthetic sequence.
SRVEEIIEDLRRLLEEIRKENEDSIRRSKELLDRVKEINDTRDHMVLHEYVNAAGITREKGSESEEVKKALRAVLEELEKLLRRVAEINEEVLRRNSKLVEEDERRNREVLKELARLVEELIREIGDEDKARKVAEVAEKVLRDIDKLDRESKEAFRATNEEIAKLDEDTARVAERVKKAIEDLAK

SEQ ID NO: 15739 - protein, 186 aa, Artificial Sequence
  Synthetic sequence.
SEVDEIIKELERLLAEIARENERIIRESRKLADEVRKRNEDRDHMVLHEYVNAAGITRRKGSESEEVKKLIEDVLREIERLLKRIEEENREVVKRNSELVERVRAINEEILRRVAELVEKIARDIGDKDEVTKVKKVADDVLAEIKKLDDETRRVIEDTNKKIADLDKATRDVVRKVLEEVKKLEK

SEQ ID NO: 15740 - protein, 181 aa, Artificial Sequence
  Synthetic sequence.
SEVDDVLRRLEELIKTLEDINAKSLEDIKKLIDDLAKILEDRDHMVLHEYVNAAGITKGIDSREAEEIAKRVLEELKRTSDDLRKKVERVDEDLRRLLRENHERNKKILRDLERLLRDAARRGVPKEALDRMREEIRRLEEESRKSDETIERLIRELRRRVEEVLKTSTDLIRELEEEVKK

SEQ ID NO: 15741 - protein, 183 aa, Artificial Sequence
  Synthetic sequence.
SKLEEVEKAVRKVIEDSRRVNEEVNRRSEEVVRELEKVHRERDHMVLHEYVNAAGITKGSGDERLAAEVERIIEEIRELNERDRKRVEEIRKEIEDLNRDLNRRSKESEDRLRKLLEDATRGGVTKEADEVVERAERISEENKRRVEDVARKSKELVEDVRRHSEEVVRRVEELVKEVEERVR

SEQ ID NO: 15742 - protein, 173 aa, Artificial Sequence
  Synthetic sequence.
SAEEVKEELKRIATKLKEEIKENIRRLEESVEKIAKELAENRDHMVLHEYVNAAGITDERIVKTVEDIARRVVEDNERIMEEDKDVVRRLVERNEEIVRRVDETVKKIVELIDRGEPGEELVERLRRVVEEVRERLKDSSRELRKINEDSRKAVEDSSAEVAKVVEELERRDT

SEQ ID NO: 15743 - protein, 183 aa, Artificial Sequence
  Synthetic sequence.
SDVDRVLEEIRKLLEDLKRHSEKVSEENEDLLRANTELNKRRDHMVLHEYVNAAGITERGGISEEDLKRALDRVRKTVETVKEENKRSLEDVRRTVETNKRKLERVVEEIKKLIEDAKRRGSGDEEAKKKLDEVLERAKRTIDRLLETSDRSLEKVEADLRRLNEELDRSLERAERTIRELAK

SEQ ID NO: 15744 - protein, 180 aa, Artificial Sequence
  Synthetic sequence.
DEVEDVLRKIEKILDDHRKRIEKNSRDMARIIDEHRRKVEERDHMVLHEYVNAAGITDRGEGDEETAEDVKAKLEKSNRELEKHSEEVKRALDESNEDLRRHSEEVKERIERLVKKLREDGVEREEELKEVADRVKEKLDRLNRENEKSSEELKRELDKINDENRETSERLKREIDETTR

SEQ ID NO: 15745 - protein, 185 aa, Artificial Sequence
  Synthetic sequence.
SSVEELLERLRRISEENKRRIEKLLREVEKVLRELKDRHRKRDHMVLHEYVNAAGITKSGLPEEAVKRVLERVRERVKEVLEEADRLNDEMRRIVTEVEKELDKSDKEVEDAVRDILKKIEEGVRDRETAERARETLKRLLDENRDRSKKVKEEIRRILEDLTRTTERVKREIAKLLKELEDTAR

SEQ ID NO: 15746 - protein, 238 aa, Artificial Sequence
  Synthetic sequence.
EEDERLTKRVEEIKRENRELLRRLEEEVKELERKSEKIVRDRDHMVLHEYVNAAGITGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 15747 - protein, 244 aa, Artificial Sequence
  Synthetic sequence.
SAEETLRRITEESKRVLEEITKKYEDLERESREVLRKLREDRDHMVLHEYVNAAGITDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 15748 - protein, 250 aa, Artificial Sequence
  Synthetic sequence.
STEEILKRVKEILDELAKELRDIIRESLRTIEELLDELRRIRDHMVLHEYVNAAGITDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLEEKERRIRTRYEELRRRLRKRVKDYEDKLREIEKKVRRDAERIEEELERAKK

SEQ ID NO: 15749 - protein, 238 aa, Artificial Sequence
  Synthetic sequence.
SEAEKIREALETNLRLLEELIKRLKEILDTHNELLRRVIETRDHMVLHEYVNAAGITLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 15750 - protein, 247 aa, Artificial Sequence
  Synthetic sequence.
SEAEDLEELIKELAELLKDVIRKLEKINRRLVKILEDIIRRRDHMVLHEYVNAAGITVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRETHKKIEKELREALKRVRDRST

SEQ ID NO: 15751 - protein, 240 aa, Artificial Sequence
  Synthetic sequence.
SDKEEIKRRVEKTARDLETEHDKIKKRLEDTVRDIKRELDERDHMVLHEYVNAAGITREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 15752 - protein, 238 aa, Artificial Sequence
  Synthetic sequence.
DADELLRRLAEEVERVIREAEDLLRRWKETIKKVLDDLKRLRDHMVLHEYVNAAGITKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 15753 - protein, 236 aa, Artificial Sequence
  Synthetic sequence.
STREKAKKVLDTLRADNEDMKRVVEKILRALKRTNERAEKLRDHMVLHEYVNAAGITVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 15754 - protein, 236 aa, Artificial Sequence; identical to SEQ ID NO: 15753
  Synthetic sequence.

SEQ ID NO: 15755 - protein, 239 aa, Artificial Sequence
  Synthetic sequence.
SERELIERWLELHKEILRLIRELVERLLKLHREILDTIKKLRDHMVLHEYVNAAGITLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERTLKKLLDDSARMAEEVKKTLKELLERSEKVAEDVRK

SEQ ID NO: 15756 - protein, 246 aa, Artificial Sequence
  Synthetic sequence.
KEIEETLKELEDLNREMVETNRRVLEETRRLNKETVDRVKARDHMVLHEYVNAAGITRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVEELEKALEEIKRRLKEVIDRYEDELRKLRKEYKEKIDKYERKLEEIERRERT

SEQ ID NO: 15757 - protein, 231 aa, Artificial Sequence
  Synthetic sequence.
SKEEEVEKVLRKWEEILRRLIEENKRANDKIRREYEELVKERDHMVLHEYVNAAGITVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 15758 - protein, 231 aa, Artificial Sequence
  Synthetic sequence.
SKDEELARLLEELVERWRKIVEDLERDHRRLVKEIRELVERRDHMVLHEYVNAAGITIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 15759 - protein, 237 aa, Artificial Sequence
  Synthetic sequence.
KEKEDALKKLEDLARKSREDLERVLRKHKKILDKIEELLKRRDHMVLHEYVNAAGITGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 15760 - protein, 237 aa, Artificial Sequence; identical to SEQ ID NO: 15759
  Synthetic sequence.

SEQ ID NO: 15761 - protein, 229 aa, Artificial Sequence
  Synthetic sequence.
SKEERLREVAEKHKKDLEDIVKRVDEAAKETARRLEEILKRRDHMVLHEYVNAAGITDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 15762 - protein, 241 aa, Artificial Sequence
  Synthetic sequence.
SEKELLKEILDRIRELLEDDNRLLKRIVDEIRKLLEEWLRVRDHMVLHEYVNAAGITAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 15763 - protein, 246 aa, Artificial Sequence
  Synthetic sequence.
SEREELLERIKEILKRVKDKLDEDLKRLKEILEKLKEKADRRDHMVLHEYVNAAGITERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETVRELIERLKRVLEEAIEVVERVAR

SEQ ID NO: 15764 - protein, 240 aa, Artificial Sequence
  Synthetic sequence.
DREKSVRDIEEDLKRVLDKLRRRVETSKEELKKVLKADKENRDHMVLHEYVNAAGITRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 15765 - protein, 241 aa, Artificial Sequence
  Synthetic sequence.
SAEEAVEKLVRIARAIVKINEDLSREVVRILREIVRLNEETRDHMVLHEYVNAAGITDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKELEKLKRELERLLEESRRKLEKLKRDLERVLEETRR

SEQ ID NO: 15766 - protein, 237 aa, Artificial Sequence
  Synthetic sequence.
REDEVLRDIERLLREIEEKIRRILEESTAELRKVEEEVKRIRDHMVLHEYVNAAGITRKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 15767 - protein, 237 aa, Artificial Sequence; identical to SEQ ID NO: 15766
  Synthetic sequence.

SEQ ID NO: 15768 - protein, 243 aa, Artificial Sequence
  Synthetic sequence.
SEAERLADEVRKAVKKSEEDNETLVREVEKAVRELKKNNKTRDHMVLHEYVNAAGITRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 15769 - protein, 243 aa, Artificial Sequence; identical to SEQ ID NO: 15768
  Synthetic sequence.

SEQ ID NO: 15770 - protein, 245 aa, Artificial Sequence
  Synthetic sequence.
SEKDEVTRRIRELLKEAEETNREAIERIKRLLDRVREAVEERDHMVLHEYVNAAGITDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 15771 - protein, 245 aa, Artificial Sequence; identical to SEQ ID NO: 15770
  Synthetic sequence.

SEQ ID NO: 15772 - protein, 249 aa, Artificial Sequence
  Synthetic sequence.
DAEEVVKRLADVLRENDETIRKVVEDLVRIAEENDRLWKKLRDHMVLHEYVNAAGITRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 15773 - protein, 240 aa, Artificial Sequence
  Synthetic sequence.
DKDKRLEELLKRLKELNDKTFEELERILEELKRANEASLRERDHMVLHEYVNAAGITLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 15774 - protein, 240 aa, Artificial Sequence
  Synthetic sequence.
SKEETLKRLLDELEKRNRETVERLERLLKELEDRNRASLEERDHMVLHEYVNAAGITLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 15775 - protein, 243 aa, Artificial Sequence
  Synthetic sequence.
SEAERTKESLKKVLKALVDLNRELLRKLEENMRELTKLNEERDHMVLHEYVNAAGITIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 15776 - protein, 243 aa, Artificial Sequence; identical to SEQ ID NO: 15775
  Synthetic sequence.

SEQ ID NO: 15777 - protein, 182 aa, Artificial Sequence
  Synthetic sequence.
DEAEKLLKELRDLLEESRKDLERLLKELEDLLEESKRDLERLRDHMVLHEYVNAAGITRRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 15778 - protein, 182 aa, Artificial Sequence
  Synthetic sequence.
RVEDALRKLLDDVRRLVEEAERRLRTSNDKSRRLVEEAKRRLRDHMVLHEYVNAAGITRIRDEDVKRVLEELLKRDHDVVRRVLERIDEMLERNSRLVKRVLEDIRRLLKRVREVVERIKRVRSKVVEEVLKELEELIKTAKKIIEDVLRASEDTIRRLEEIIRKVEEDSKRIIEEIERAAR

SEQ ID NO: 15779 - protein, 181 aa, Artificial Sequence
  Synthetic sequence.
SEVERVLEDLRRLVRDVEEKLRRIIERDRRLVEEVERENRKTRDHMVLHEYVNAAGITDISDKKTIERIVREIIKEARDLVRRNHERNREIVDESRRLVEELRRIVEEIIRRLRELLERVKSGELAERIEDVVREAEKRLRELLKELEKTSRDLKKRLEELDRELKALVEKVERDLEELRK

SEQ ID NO: 15780 - protein, 174 aa, Artificial Sequence
  Synthetic sequence.
SRDEKIRDILRRVLKEVRDSTKKVEEDLEDVHRRTEEELRKVRDHMVLHEYVNAAGITSEELKRRMEEVVRRIEELLKKLLKEDRDVVKEIRDKLDETRKEMEEVAERIKDKIRRGDGREKVAEEVKRIADRLIDLNRRIAEEVDKIVRDSIKKVEEIVTEVEKIVEKLIRDVR

SEQ ID NO: 15781 - protein, 174 aa, Artificial Sequence
  Synthetic sequence.
SELEKVVKEVADLLRRNLEKSKRVLEEVRRRLEENLRESEKVRDHMVLHEYVNAAGITEGKDKRDLTRLLEEDDKRVKEALDKSRENNERILKEVRRALRESEEDNRRILKEVREKVDSRLLEELEERVRESIERSRRFIEELEKIVEETLTESEKLARASSEITKTVLDEIRK

SEQ ID NO: 15782 - protein, 178 aa, Artificial Sequence
  Synthetic sequence.
DDLERVLKEIKKAADKIREDNKRTADKIRKRVKELDDETRDMRDHMVLHEYVNAAGITGREEARKVIEELKKLVDEVRKRNEKSIEELKKLLKEDRDLMRRVIEELEDLVRRLREEVRDDEALRRVEEEVERLIRDLRRVLKETSDRVRELIDKHRRLSEEVEKDVKRLIDELKKKTD

SEQ ID NO: 15783 - protein, 187 aa, Artificial Sequence
  Synthetic sequence.
DEEEELRKRLEKLSKEVRELLRRDEEEDRRLNRELEELLKDHRDHMVLHEYVNAAGITKARRKVSEEELTRLRKKLRDLEEESKEALRELRRRVEELNKENKKSLDDLERRLKELEDRAREVEKRDRREDELRELLRRLEDVIRKLAEDLKRNTEDLRRVIKELAERLEELNKRLKREIRRLKEELR

SEQ ID NO: 15784 - protein, 175 aa, Artificial Sequence
  Synthetic sequence.
SEEDELRRLLKEVNERVERLLDEIRKELEKIAEELRDLLKKNRDHMVLHEYVNAAGITDEEIKKDAERALTELKEEHERLDREAKKDLDRIRKELERLEEEHRRVSERIEEVLDKESDKTEDIAREIRELMERTRRVIEEIKKELRDILEKLRRVSEELNKKLDEILKRIEDRTR

SEQ ID NO: 15785 - protein, 171 aa, Artificial Sequence
  Synthetic sequence.
SEKEKVIKEARELLERLRKRLKDVNDDVTRLLDELRKENEKSRDHMVLHEYVNAAGITVEDVIRELKRRLEEVDKKNRDILETLKRELDEVSRRTREELEKLRKELEEVEKAGLPAEELKRVADRLRRRLERLVEENERVVKKILDEIRRSVEENKRIVDKVRKDLDERRK

SEQ ID NO: 15786 - protein, 177 aa, Artificial Sequence
  Synthetic sequence.
SAIEKVKEVVERVLETVRDSVRRSHEESKRLIDKVRKRLEEVRDHMVLHEYVNAAGITPERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 15787 - protein, 183 aa, Artificial Sequence
  Synthetic sequence.
SEIEKLVEDVRKLVEDNLRHSEEVHRRNRRLIEENERKIDELRDHMVLHEYVNAAGITRGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 15788 - protein, 174 aa, Artificial Sequence
  Synthetic sequence.
DELRDVKRELDRLLRENEEIVERIAETVRRLLEELKKLTKELRDHMVLHEYVNAAGITPEKELKEVADTLRKLLKDIERSNKEVEDRLRKLLEEIKESTDRLREELEEVEKLLRGGKDVETVLRRVRELSRDNKRRMRRVLEEAKRLAKEDKERIDKIRKEIEELIKRLKDKAT

SEQ ID NO: 15789 - protein, 174 aa, Artificial Sequence
  Synthetic sequence.
DEEEDLERRIKKLLDENRELLKRIAEELRRLLEELRRLTEESRDHMVLHEYVNAAGITPEKDLRDVAEKVKKVLKESEDSNRDVKRKLEKLLRDLERSTERLEREARKVRKLLRDGKDIETLLRELEKLSRDNKELLKKIEKEIRDLIKEDKERNRELSERLRKLVEELKKKAT

SEQ ID NO: 15790 - protein, 177 aa, Artificial Sequence
  Synthetic sequence.
SEAEKVVEELKKLLREVEKKIRDHTEDVKRILEELERRLRKHRDHMVLHEYVNAAGITDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 15791 - protein, 182 aa, Artificial Sequence
  Synthetic sequence.
DEIETVLDEVRRLHEDAKRRLEEMIDEVRKLNEESVRELARVRDHMVLHEYVNAAGITRAGLDKGKLEELEERLERVREDVERILREIKRRNEKTLEDSERILEENKERNRTVLKKLKELRDRGSDAREALKESRKVVEESRESVRRVLEKNRRVVEESKRLAEELLRRVKKVVDEIRKRVE

SEQ ID NO: 15792 - protein, 174 aa, Artificial Sequence
  Synthetic sequence.
EELERILDKVRKVIEEVRKRLRDDLRTVEKVLKETEEVLRRARDHMVLHEYVNAAGITRGRDRREIKEELKKVLDDLRELLRALEEKNRRVNKENEDSLRKIEEDLRDVLRKLEEEIKGREVLRKVRELLRTIREEVERVLRKSNELSTRIKKRIDDVLETLERLLKELDDKLR

SEQ ID NO: 15793 - protein, 178 aa, Artificial Sequence
  Synthetic sequence.
SSKDEIRRRVEEVVERSDEIVKRSREHVKTVVDELDRVVKELRDHMVLHEYVNAAGITDGGSEETLKRVLDELREILKELKEEVKKVKRKLEKVVKENRDTIREVEERNRKILDELRKRGVEERALREVEEISRKSEEKLRRVLKESEDIAKEAEDRLKTVLERVERIADEVLKRLTK

SEQ ID NO: 15794 - protein, 182 aa, Artificial Sequence
  Synthetic sequence.
SDADRVAEELKKLVEDSRRENERVIEESKRLVKENEDRNRELRDHMVLHEYVNAAGITKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 15795 - protein, 175 aa, Artificial Sequence
  Synthetic sequence.
SEVDEVLREAKRIVDEVHKDNERATEESRRLVKKVHEENEEMRDHMVLHEYVNAAGITDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 15796 - protein, 175 aa, Artificial Sequence
  Synthetic sequence.
SEMDDVLKKLAETVKRIIERLKKLTDDSRRLVEEVHRRNDKLRDHMVLHEYVNAAGITDEKDVRKLLEDLKKKSEEVAERNKRILDTLREISKRAEDEVRKVLKELEKTLKELEDRRPDVRELSEEVKKLLDEVRKALKRHKDENDKLLKEIEDSLRRHKEENDRLLEKLKESTR

SEQ ID NO: 15797 - protein, 186 aa, Artificial Sequence
  Synthetic sequence.
SEVDEVRKTLEDLLRRLDEENKDIIRRNKELLDDLDRKVREARDHMVLHEYVNAAGITKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 15798 - protein, 183 aa, Artificial Sequence
  Synthetic sequence.
SEVDEVLERIKRLLERLAEHSDKVVRDIEKLLDDNRKENERLRDHMVLHEYVNAAGITRGDLREELLERVVREVEKEIRDIKRKNKRSVETVEKLVRDDRKELKRALEDVERLIRELETRLKDKEELRRKLEKVLREAEKVIDELLKKTDEVLKRARETIEDLNRKLDKVLKEVRDKLDRLRD

SEQ ID NO: 15799 - protein, 184 aa, Artificial Sequence
  Synthetic sequence.
ELIKKARKDVEEVRERSERLVDELRKRNKKLADESRRLIDKLRDHMVLHEYVNAAGITKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 15800 - protein, 182 aa, Artificial Sequence
  Synthetic sequence.
SELEKTLEDLKRHSEENKKKLEEDLRDMERNLKENKDRLKKIRDHMVLHEYVNAAGITEGDIDERELERVRRKMEEIKKRLDENVERNRRKAEDIKRKLDENVKRSEDRVKEIKEDIRRRVRDKDKAEELERRLDELVKENREIHERVKKALDDIVKELEELHERLKRRLEEILRRIAETVR

SEQ ID NO: 15801 - protein, 186 aa, Artificial Sequence
  Synthetic sequence.
SEIEKLIEELRRELEKVKDELERSIEEMDRELDDVRRDSKRLRDHMVLHEYVNAAGITRGDRPEEVLRKELEDIKRKLRRILEEHHEKIRRIKEKLRRENKRVRDELKRIKDEIDEKVKDVRRKGADEELLKRLEEVAEDVKRALEELLKKHTRVVERVEKALDELDKELERIVREAEKELDRREK

SEQ ID NO: 15802 - protein, 178 aa, Artificial Sequence
  Synthetic sequence.
DREREVKKRLDEVRERIERLLRRVEEESRRVAEEIRRLIEEVRDHMVLHEYVNAAGITGLKDKEEVRRVLERLRKLNAESDELLERILERLRRLVEATNRLVKAIIEELRRLVEKIVREVPDSEELREELKKLERKIEKVAKEIHDHDKEVTERLEDLLRRITEHARKSDREIEETAR

SEQ ID NO: 15803 - protein, 172 aa, Artificial Sequence
  Synthetic sequence.
SRAETVLKEVTDKIKKLADSSDELLRRNKENIDELKKSSEELRDHMVLHEYVNAAGITDEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 15804 - protein, 188 aa, Artificial Sequence
  Synthetic sequence.
SEIEKILKEIEDLARRDEEVSKKIVEDIRRLAKEVEDTSRDIRDHMVLHEYVNAAGITKDGSKEELEKEVREVVKTLEELVKDNHRLIRRAVEEMKRLVEENHRHSREVVKELEDLVRELRKGSGSEDSERLVREVEDLVRRLVRRSEKSNEEVKRTVEELVRRMEESNDRVRDLVRRLVEELKRAVD

SEQ ID NO: 15805 - protein, 178 aa, Artificial Sequence
  Synthetic sequence.
SEAEKAKETIDRLADRVRKLLEEIKRSLDDSRRKSKETVEENRDHMVLHEYVNAAGITGSVSEEELERLIRKLKKTLDELRRRHEKLVEDLRRNLERIKRRLEELTREMRETLERLAREGLDEEVLRTLEEIIRRLTKELEDVLREYERELRRLEEENKRVIDKTEEEIRRLADRLRR

SEQ ID NO: 15806 - protein, 179 aa, Artificial Sequence
  Synthetic sequence.
SEVEELIKRLAKVLKELVDKVRKVIEDTKELLERLKRRSEDHRDHMVLHEYVNAAGITDDEELKEILDRLRKTLEELEEELKKALEDDREEAKRLVDDARRVLKELEEEVREIRERRGESEELDRRIEKVLKEIEEKIREVIKEWERVHREVEELLKRLIDENRKVLDEIRKLLEEKSK

SEQ ID NO: 15807 - protein, 184 aa, Artificial Sequence
  Synthetic sequence.
DEIRKVVKEITDLLKASNDKNRKVVEEIRDLLRKSKKLADELRDHMVLHEYVNAAGITKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 15808 - protein, 184 aa, Artificial Sequence; identical to SEQ ID NO: 15807
  Synthetic sequence.

SEQ ID NO: 15809 - protein, 176 aa, Artificial Sequence
  Synthetic sequence.
STAETVEKKVEEVIRENEKSMRESEEKVDRSTKRIEDVLRRLRDHMVLHEYVNAAGITGERVKEVLEENRRLLEEAKKLVDEVLETNKKLLEDDKRLNEEVSKTLKKLLEEIKSVDTREDATRVIEEAKRILDEARKLNEETIRRSEELVRRIERVIEEIIKRSEKLLEDVARESK

SEQ ID NO: 15810 - protein, 186 aa, Artificial Sequence
  Synthetic sequence.
SRVEEIIEDLRRLLEEIRKENEDSIRRSKELLDRVKEINDTIRDHMVLHEYVNAAGITEKGSESEEVKKALRAVLEELEKLLRRVAEINEEVLRRNSKLVEEDERRNREVLKELARLVEELIREIGDEDKARKVAEVAEKVLRDIDKLDRESKEAFRATNEEIAKLDEDTARVAERVKKAIEDLAK

SEQ ID NO: 15811 - protein, 180 aa, Artificial Sequence
  Synthetic sequence.
REVEEMIKELEELLKDLKEKNERASKRNRELVRRLEEENKRVRDHMVLHEYVNAAGITSGEDEEVLREVLKRLEEVLERVRALNERVLEAIEKSLEEVKASNEAVKRRLKELLEEAERGVDSEKLKELRDVIAEVAKRIDELDEYTRESIRRAKKEIERLNRETKKVIEEVVKRIEEERK

SEQ ID NO: 15812 - protein, 181 aa, Artificial Sequence
  Synthetic sequence.
DAVEEAEKLIRKVIADSEKLLRDLADLNAKSIRRSEKLVEDDRDHMVLHEYVNAAGITNGGSEEELRALLKEVEDTNRASHETNKRLLDEDRALNKEVHDRNEKLLRDIKRLVEEVAKGIDSEELLRRIKKLLDEIKKAIEDSSREIKRLLEESERVMKRSSEDIKRTLDDTRRVVEEVRR

SEQ ID NO: 15813 - protein, 181 aa, Artificial Sequence
  Synthetic sequence.
SEVDDVLRRLEELIKTLEDINAKSLEDIKKLIDDLAKILEDARDHMVLHEYVNAAGITGIDSREAEEIAKRVLEELKRTSDDLRKKVERVDEDLRRLLRENHERNKKILRDLERLLRDAARRGVPKEALDRMREEIRRLEEESRKSDETIERLIRELRRRVEEVLKTSTDLIRELEEEVKK

SEQ ID NO: 15814 - protein, 175 aa, Artificial Sequence
  Synthetic sequence.
SEIERVKKRLEELLAEVEESTRRLEERLKRLLEEAKRSSEEVRDHMVLHEYVNAAGITRDEKLVSELEARVKELLEDSRASLEELKKRVRKLAEDSARLLEEVKREVEKLKAKLDRGGDADDVLARVEELAKRAHDENERLIREVEELVRAHNKRNKELVDEVKRLVEKVIEEER

SEQ ID NO: 15815 - protein, 183 aa, Artificial Sequence
  Synthetic sequence.
SDVDRVLEEIRKLLEDLKRHSEKVSEENEDLLRANTELNKRVRDHMVLHEYVNAAGITRGGISEEDLKRALDRVRKTVETVKEENKRSLEDVRRTVETNKRKLERVVEEIKKLIEDAKRRGSGDEEAKKKLDEVLERAKRTIDRLLETSDRSLEKVEADLRRLNEELDRSLERAERTIRELAK

SEQ ID NO: 15816 - protein, 180 aa, Artificial Sequence
  Synthetic sequence.
DEVEDVLRKIEKILDDHRKRIEKNSRDMARIIDEHRRKVEENRDHMVLHEYVNAAGITRGEGDEETAEDVKAKLEKSNRELEKHSEEVKRALDESNEDLRRHSEEVKERIERLVKKLREDGVEREEELKEVADRVKEKLDRLNRENEKSSEELKRELDKINDENRETSERLKREIDETTR

SEQ ID NO: 15817 - protein, 238 aa, Artificial Sequence
  Synthetic sequence.
EEDERLTKRVEEIKRENRELLRRLEEEVKELERKSEKIVRDLRDHMVLHEYVNAAGITSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 15818 - protein, 238 aa, Artificial Sequence; identical to SEQ ID NO: 15817
  Synthetic sequence.

SEQ ID NO: 15819 - protein, 240 aa, Artificial Sequence
  Synthetic sequence.
SDKEEIKRRVEKTARDLETEHDKIKKRLEDTVRDIKRELDELRDHMVLHEYVNAAGITEGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 15820 - protein, 240 aa, Artificial Sequence; identical to SEQ ID NO: 15819
  Synthetic sequence.

SEQ ID NO: 15821 - protein, 248 aa, Artificial Sequence
  Synthetic sequence.
DEDRIIEEIARLLEELLRELLELIKKLIETNRRLNEEHERAVRDHMVLHEYVNAAGITKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 15822 - protein, 248 aa, Artificial Sequence; identical to SEQ ID NO: 15821
  Synthetic sequence.

SEQ ID NO: 15823 - protein, 246 aa, Artificial Sequence
  Synthetic sequence.
KEIEETLKELEDLNREMVETNRRVLEETRRLNKETVDRVKATRDHMVLHEYVNAAGITKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVEELEKALEEIKRRLKEVIDRYEDELRKLRKEYKEKIDKYERKLEEIERRERT

SEQ ID NO: 15824 - protein, 231 aa, Artificial Sequence
  Synthetic sequence.
SKEEEVEKVLRKWEEILRRLIEENKRANDKIRREYEELVKEIRDHMVLHEYVNAAGITSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 15825 - protein, 247 aa, Artificial Sequence
  Synthetic sequence.
RDRDVLRKVKAEIEELVARIEKVSRDALSEVKRLLDENRKIARDHMVLHEYVNAAGITTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 15826 - protein, 231 aa, Artificial Sequence
  Synthetic sequence.
SKDEELARLLEELVERWRKIVEDLERDHRRLVKEIRELVERIRDHMVLHEYVNAAGITDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 15827 - protein, 237 aa, Artificial Sequence
  Synthetic sequence.
KEKEDALKKLEDLARKSREDLERVLRKHKKILDKIEELLKRVRDHMVLHEYVNAAGITTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 15828 - protein, 229 aa, Artificial Sequence
  Synthetic sequence.
SKEERLREVAEKHKKDLEDIVKRVDEAAKETARRLEEILKRLRDHMVLHEYVNAAGITDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 15829 - protein, 246 aa, Artificial Sequence
  Synthetic sequence.
SEREELLERIKEILKRVKDKLDEDLKRLKEILEKLKEKADRDRDHMVLHEYVNAAGITRTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETVRELIERLKRVLEEAIEVVERVAR

SEQ ID NO: 15830 - protein, 252 aa, Artificial Sequence
  Synthetic sequence.
SLEEITKRLLELVEENLARHEEILRELLELAKRLAKEDRDILRDHMVLHEYVNAAGITNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLREVVRKVLEEAKRLLDELEEVHKRVKKELEDIIEENRRVVKRVRDELREIKRELDE

SEQ ID NO: 15831 - protein, 237 aa, Artificial Sequence
  Synthetic sequence.
REDEVLRDIERLLREIEEKIRRILEESTAELRKVEEEVKRIIRDHMVLHEYVNAAGITKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 15832 - protein, 237 aa, Artificial Sequence; identical to SEQ ID NO: 15831
  Synthetic sequence.

SEQ ID NO: 15833 - protein, 243 aa, Artificial Sequence
  Synthetic sequence.
SEAERLADEVRKAVKKSEEDNETLVREVEKAVRELKKNNKTWRDHMVLHEYVNAAGITDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 15834 - protein, 243 aa, Artificial Sequence; identical to SEQ ID NO: 15833
  Synthetic sequence.

SEQ ID NO: 15835 - protein, 245 aa, Artificial Sequence
  Synthetic sequence.
SEKDEVTRRIRELLKEAEETNREAIERIKRLLDRVREAVEEVRDHMVLHEYVNAAGITRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 15836 - protein, 245 aa, Artificial Sequence; identical to SEQ ID NO: 15835
  Synthetic sequence.

SEQ ID NO: 15837 - protein, 243 aa, Artificial Sequence
  Synthetic sequence.
SRVEELKKLIEDILRISREVVERIARVAEDIHRINRRVLDDLRDHMVLHEYVNAAGITRKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 15838 - protein, 249 aa, Artificial Sequence
  Synthetic sequence.
DAEEVVKRLADVLRENDETIRKVVEDLVRIAEENDRLWKKLVRDHMVLHEYVNAAGITGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 15839 - protein, 240 aa, Artificial Sequence
  Synthetic sequence.
DKDKRLEELLKRLKELNDKTFEELERILEELKRANEASLREARDHMVLHEYVNAAGITDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 15840 - protein, 240 aa, Artificial Sequence
  Synthetic sequence.
SKEETLKRLLDELEKRNRETVERLERLLKELEDRNRASLEELRDHMVLHEYVNAAGITSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 15841 - protein, 240 aa, Artificial Sequence; identical to SEQ ID NO: 15840
  Synthetic sequence.

SEQ ID NO: 15842 - protein, 243 aa, Artificial Sequence
  Synthetic sequence.
DEEETLRRLLERKVELAKEYLDVSKEVIDRTTKLLDEYLKTSRDHMVLHEYVNAAGITGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 15843 - protein, 243 aa, Artificial Sequence
  Synthetic sequence.
SEAERTKESLKKVLKALVDLNRELLRKLEENMRELTKLNEEVRDHMVLHEYVNAAGITVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 15844 - protein, 243 aa, Artificial Sequence; identical to SEQ ID NO: 15843
  Synthetic sequence.

SEQ ID NO: 15845 - protein, 186 aa, Artificial Sequence
  Synthetic sequence.
SAEDSIRELLERDERLLEEARKEAKRLNEENERLLERIEETVRRDHMVLHEYVNAAGITIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 15846 - protein, 182 aa, Artificial Sequence
  Synthetic sequence.
RVEDALRKLLDDVRRLVEEAERRLRTSNDKSRRLVEEAKRRLERDHMVLHEYVNAAGITIRDEDVKRVLEELLKRDHDVVRRVLERIDEMLERNSRLVKRVLEDIRRLLKRVREVVERIKRVRSKVVEEVLKELEELIKTAKKIIEDVLRASEDTIRRLEEIIRKVEEDSKRIIEEIERAAR

SEQ ID NO: 15847 - protein, 184 aa, Artificial Sequence
  Synthetic sequence.
KLDEVIEEIRKLLRRMEEELRRSVEEIDKLLREVRELLRESSERDHMVLHEYVNAAGITGVPEEVKERLDRLVETLRRLSEETLKELDKLVREVKELSKESLKRLRELVERLRRELEEIKKRGEDEKLVEDLKRRAEEVIRELREIVKRNTEIAREVVERAKRIVEKNEKLLKDVVEEAKKIVK

SEQ ID NO: 15848 - protein, 181 aa, Artificial Sequence
  Synthetic sequence.
SEVERVLEDLRRLVRDVEEKLRRIIERDRRLVEEVERENRKTIRDHMVLHEYVNAAGITISDKKTIERIVREIIKEARDLVRRNHERNREIVDESRRLVEELRRIVEEIIRRLRELLERVKSGELAERIEDVVREAEKRLRELLKELEKTSRDLKKRLEELDRELKALVEKVERDLEELRK

SEQ ID NO: 15849 - protein, 177 aa, Artificial Sequence
  Synthetic sequence.
ELREDVERVVDEIRRLVEENVRRIDEVAKDIKRLADDNVRRVKRDHMVLHEYVNAAGITGVTEVVDELREEVRKLSEDNRRHSRELIERVKKLLKELEEHSRDLKRRVKELLEDLKRKGVDERVLKKLKEVIEDVERKSRDALRRLEEAIRRVRRESERVNRELDEVIKRVTEELKK

SEQ ID NO: 15850 - protein, 173 aa, Artificial Sequence
  Synthetic sequence.
SLEELLEEARKTVERLIRESERVLRESEERVRRLIEELERVVRRDHMVLHEYVNAAGITEALKELEKLLREDSKRVKEVLDDLRRDLERNKRRNEKVLRELEELLKRLEELVREGVREEELEKLLREIEERVKEMLKRDEDTLREIERKVKEAVRDSERTLEEIEKRVTEEKT

SEQ ID NO: 15851 - protein, 179 aa, Artificial Sequence
  Synthetic sequence.
STREDARRLVERVRKEVKRLLKKNSDLLREVTERVKTLNERNRRDHMVLHEYVNAAGITDERDVERLLDRARKLVKESEDLIRKLLKDLRELVRRSEKDIDELRKELKRLLDELRARATDKDLERVVREIEKEIRDLIRELEENVKTSEKLIEDLIRELEKSVDESRKRVEELVKELRT

SEQ ID NO: 15852 - protein, 180 aa, Artificial Sequence
  Synthetic sequence.
STEEVLDEIRKLHKTLTEDIKRVLREIEELHRRTIEENKEVLDRDHMVLHEYVNAAGITDTPNVEKLLKDLEKSAKENEEHNERTLREDDRVLKEIRRRATELLKANEEMLRRIEEVMRAGKVDAEELLRESKEAIKEVKRVLEELRKESKRVVDETRKLSEENLEHSERVLRKVEEDLR

SEQ ID NO: 15853 - protein, 180 aa, Artificial Sequence
  Synthetic sequence.
SKEEVLREIERLHKETIRRIEEVLREATELHKRLTETNKRVLERDHMVLHEYVNAAGITDTPNVEELLRELKDALDKVRDHNRKTLKKNEDVVREIEKEVRELLKEDEDVLRRIEKVMRDGRVDARELLEESRREVERSEKEVERLLRKSRKVVEEVRKLSEENDREVKKILEEVKRRLD

SEQ ID NO: 15854 - protein, 178 aa, Artificial Sequence
  Synthetic sequence.
DDLERVLKEIKKAADKIREDNKRTADKIRKRVKELDDETRDMLRDHMVLHEYVNAAGITREEARKVIEELKKLVDEVRKRNEKSIEELKKLLKEDRDLMRRVIEELEDLVRRLREEVRDDEALRRVEEEVERLIRDLRRVLKETSDRVRELIDKHRRLSEEVEKDVKRLIDELKKKTD

SEQ ID NO: 15855 - protein, 187 aa, Artificial Sequence
  Synthetic sequence.
SEKERLKEELEKLSKEIEDILRDDKRSDDELRRRLRELLEKDRRDHMVLHEYVNAAGITARKRVSEDELRAIKKEIEDLNRRNEESLRAIEEKIKRLNDENRKSLEEIRRRLKRLVEEVDELRKRDNREELLRRLLEKLKRMAEKLKRDIEDNNRKLRKVATELAKEIEDNSEKLREDAKRLSEKIK

SEQ ID NO: 15856 - protein, 175 aa, Artificial Sequence
  Synthetic sequence.
SEKEDLERELEEVRRRVEESLRKNEEDVKRVRDELKKLLDENRRDHMVLHEYVNAAGITKRVLDEADRLLKELEDDHKKLEEDAKKALDELREEHKRLEETLRRMLKRIKEVLDRESDKMEEIKKEIEKILRDIERVSRELNKKLEEIVRRLKKVSDELNRRIEEIAERVRRRRK

SEQ ID NO: 15857 - protein, 175 aa, Artificial Sequence
  Synthetic sequence.
SEEDELRRLLKEVNERVERLLDEIRKELEKIAEELRDLLKKNERDHMVLHEYVNAAGITEEIKKDAERALTELKEEHERLDREAKKDLDRIRKELERLEEEHRRVSERIEEVLDKESDKTEDIAREIRELMERTRRVIEEIKKELRDILEKLRRVSEELNKKLDEILKRIEDRTR

SEQ ID NO: 15858 - protein, 177 aa, Artificial Sequence
  Synthetic sequence.
SAIEKVKEVVERVLETVRDSVRRSHEESKRLIDKVRKRLEEVRRDHMVLHEYVNAAGITERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 15859 - protein, 174 aa, Artificial Sequence
  Synthetic sequence.
SEIEELEKRIDELLKELRDLSRRIAEEVKRLLEELKKLSKDSERDHMVLHEYVNAAGITEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 15860 - protein, 174 aa, Artificial Sequence
  Synthetic sequence.
DEEEDLERRIKKLLDENRELLKRIAEELRRLLEELRRLTEESARDHMVLHEYVNAAGITEKDLRDVAEKVKKVLKESEDSNRDVKRKLEKLLRDLERSTERLEREARKVRKLLRDGKDIETLLRELEKLSRDNKELLKKIEKEIRDLIKEDKERNRELSERLRKLVEELKKKAT

SEQ ID NO: 15861 - protein, 177 aa, Artificial Sequence
  Synthetic sequence.
SEAEKVVEELKKLLREVEKKIRDHTEDVKRILEELERRLRKHSRDHMVLHEYVNAAGITDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 15862 - protein, 174 aa, Artificial Sequence
  Synthetic sequence.
EELERILDKVRKVIEEVRKRLRDDLRTVEKVLKETEEVLRRAARDHMVLHEYVNAAGITGRDRREIKEELKKVLDDLRELLRALEEKNRRVNKENEDSLRKIEEDLRDVLRKLEEEIKGREVLRKVRELLRTIREEVERVLRKSNELSTRIKKRIDDVLETLERLLKELDDKLR

SEQ ID NO: 15863 - protein, 178 aa, Artificial Sequence
  Synthetic sequence.
SSKDEIRRRVEEVVERSDEIVKRSREHVKTVVDELDRVVKELERDHMVLHEYVNAAGITGGSEETLKRVLDELREILKELKEEVKKVKRKLEKVVKENRDTIREVEERNRKILDELRKRGVEERALREVEEISRKSEEKLRRVLKESEDIAKEAEDRLKTVLERVERIADEVLKRLTK

SEQ ID NO: 15864 - protein, 175 aa, Artificial Sequence
  Synthetic sequence.
SEVDEVLREAKRIVDEVHKDNERATEESRRLVKKVHEENEEMVRDHMVLHEYVNAAGITEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 15865 - protein, 186 aa, Artificial Sequence
  Synthetic sequence.
SEVDEVRKTLEDLLRRLDEENKDIIRRNKELLDDLDRKVREAIRDHMVLHEYVNAAGITLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 15866 - protein, 184 aa, Artificial Sequence
  Synthetic sequence.
ELIKKARKDVEEVRERSERLVDELRKRNKKLADESRRLIDKLRRDHMVLHEYVNAAGITRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 15867 - protein, 186 aa, Artificial Sequence
  Synthetic sequence.
KEVEDLERRVKEILDRMKRLIDENRKKIEKSIRELERLIDENRRDHMVLHEYVNAAGITGGDDARTLRERVRKIIEDVEEHSRRSTEEVRRIHKENKEHSERSSDEIRELLRRVEELIEEVKRRLRDKEMEKKLEDIVRRVREVVRRAHETNERLVDRSRKAVEKAERTNRRLVEEIRKVAEEVRK

SEQ ID NO: 15868 - protein, 186 aa, Artificial Sequence
  Synthetic sequence.
DEIRELEERVRRILDELRRLVERNREVIERSIRELEKLLDRNRRDHMVLHEYVNAAGITGGDDKKTMLDDVRRLLREAEDHSRRSSETAKRIHRENEEHSKDSSRKVRKLIEELRELAKKVEKEITDERVKEAIKELVKDVDRVMREVDRANRELTKTSKKVLEDVDRTNRRLVKEVRDVVERARK

SEQ ID NO: 15869 - protein, 186 aa, Artificial Sequence
  Synthetic sequence.
KEVEDLERTVRTILKRMRELITRNEEEIRRSIEELKKLLKENKRDHMVLHEYVNAAGITGGDDKKRLVEEIKRLLDELRENSKRSSDRAKEIHERNKRHSEESSRTIEKLLKELRDLVRDVERKLRDEDAKRKLDELTKRVEKVVREADERNKRLTKRSKEVLDEVHRANEEALKEVEEVVRRVTK

SEQ ID NO: 15870 - protein, 185 aa, Artificial Sequence
  Synthetic sequence.
SAEELLRTIEKRIEDNHRRLEEILEEIARLIEDMLRTDERIVRRDHMVLHEYVNAAGITGVPEEVLERVRRELERLKKELEELRRRSEEKVKELKRRLEEIRRKLEEEHRDLRRKLEELRRDLGDKEEVVKKLVEDVERELERSLREAEDLLRRVEEVIRTSKKESKDVLEKIERLLRDLERRTR

SEQ ID NO: 15871 - protein, 176 aa, Artificial Sequence
  Synthetic sequence.
REAEEAKEEVEELNRRNKKELDDARRRVDELDKRNKDRLKESSRDHMVLHEYVNAAGITGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 15872 - protein, 182 aa, Artificial Sequence
  Synthetic sequence.
DLERRLDELLKRIEDRVRELVRTLEESLRELERRVREIIRRLERDHMVLHEYVNAAGITNKPDKAVKDDVRRLRENADRLNKRVREELKKLREDVKRVNEDVKRELDKLAEEAKDMLRKLREAGIDERVIKKAEEDVRRLLREIEEVSERHKREVDRLEREIEEVSREHKERVEKLLREIER

SEQ ID NO: 15873 - protein, 179 aa, Artificial Sequence
  Synthetic sequence.
RLEDEVRKMEKEVREEVKRLEDESRKVLEESRRNLDKLREESKRDHMVLHEYVNAAGITGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 15874 - protein, 183 aa, Artificial Sequence
  Synthetic sequence.
SVDERLDEVLERVKEDMDRNRRKNDESLREDEENVRRNKKETDRDHMVLHEYVNAAGITVKDERVKEFLDRVLEEIRKSAEEVKTIIDEVHKESEETVRRTKKIIEEVLRRIEELIRRVKKDRKEEVVKTVEEDIKRLLKEVNKVSDEAHKRNKELNERVNRVNKEAHKRNEDLLREAERKVR

SEQ ID NO: 15875 - protein, 183 aa, Artificial Sequence
  Synthetic sequence.
SIEDEIRKLKEDIKRVLDKVRRDNERLKERLDKVLEDIRRSSERDHMVLHEYVNAAGITPVDERLVRKVEEAVKRLKEHNEDSTRRVEEVIRRLKEESEESVRKTEKVARDLERELDEVLTRGGEERVREVIEKLKETLERLKREDKEVADRAEKLLREAEEHNKRSLDESRRVLEELDEEIR

SEQ ID NO: 15876 - protein, 183 aa, Artificial Sequence
  Synthetic sequence.
SIEERVRELMRDLERVLKEIREHSKRVIEEAKRVLEEIERNSERDHMVLHEYVNAAGITPVDETLVREVEEAVKKLKEHNKRSSDTVRDAVRKLVERLKESSDRATELVKDLKRKLEEVLRRGGEKELEEVERRLRKVLEDLRRNNKEVVDRLKEVLERLKEHNRRSLDESRKVLRELKERIR

SEQ ID NO: 15877 - protein, 174 aa, Artificial Sequence
  Synthetic sequence.
SESDEVIRDLARLLDELARHVDDSVRRMDEVVKRSTREADELARDHMVLHEYVNAAGITERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 15878 - protein, 172 aa, Artificial Sequence
  Synthetic sequence.
SRAETVLKEVTDKIKKLADSSDELLRRNKENIDELKKSSEELLRDHMVLHEYVNAAGITEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 15879 - protein, 174 aa, Artificial Sequence
  Synthetic sequence.
DEEEDLERAIKKLLDENRELLKRIAEELRRLLEELRRLTEESARDHMVLHEYVNAAGITEEDLADVAEKVKKVLKESEDSNADVARKLEKLLRDLERSTERLEREARKVRKLLRGGKDAETLLRELEKLSRDNKELLKKIEKEIRDLIKEDKERNIELSERLRKLVEELKKKAT

SEQ ID NO: 15880 - protein, 184 aa, Artificial Sequence
  Synthetic sequence.
DEIRKVVKEITDLLKASNDKNRKVVEEIRDLLRKSKKLADELVRDHMVLHEYVNAAGITSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 15881 - protein, 181 aa, Artificial Sequence
  Synthetic sequence.
DAVEEAEKLIRKVIADSEKLLRDLADLNAKSIRRSEKLVEDDRRDHMVLHEYVNAAGITGGSEEELRALLKEVEDTNRASHETNKRLLDEDRALNKEVHDRNEKLLRDIKRLVEEVAKGIDSEELLRRIKKLLDEIKKAIEDSSREIKRLLEESERVMKRSSEDIKRTLDDTRRVVEEVRR

SEQ ID NO: 15882 - protein, 177 aa, Artificial Sequence
  Synthetic sequence.
SEDEDLDRVAEKLAREHKKSVEEIKRVLKSADEESKKLVRDTERDHMVLHEYVNAAGITNIDEELVERLKKKIEDILRTLEERHKKLIKELREILKRLSDESRRLAEETEKVLEDLERKGVDEEVLKKLAEIVRRVKEENRKVNEEVEKRLRELEEENKKVIEDLKSTVEELVERLR

SEQ ID NO: 15883 - protein, 177 aa, Artificial Sequence
  Synthetic sequence.
SKEDRLREELKKLLARLAEEIERLKRALEESNKDLKRTIDASERDHMVLHEYVNAAGITEELLRELERSTAENKERAKELLKRHEDLVRKVEKELADLLRRLEEIVARVDEALKRGISEEELDKLLKEARDLIREIEKRLEELLKRVEKLTEDAKRDLERSNREHKELADRIKETAR

SEQ ID NO: 15884 - protein, 238 aa, Artificial Sequence
  Synthetic sequence.
EEDERLTKRVEEIKRENRELLRRLEEEVKELERKSEKIVRDLKRDHMVLHEYVNAAGITTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 15885 - protein, 245 aa, Artificial Sequence
  Synthetic sequence.
TEEEVLRKVEKLIKDLLDVLRDLLRASEEVVREALRVLEELIERDHMVLHEYVNAAGITSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDLTETKKELEKRHEDLRRELEKLLRDYKRELEEIERALEEIEKTLKRRADETRR

SEQ ID NO: 15886 - protein, 250 aa, Artificial Sequence
  Synthetic sequence.
STEEILKRVKEILDELAKELRDIIRESLRTIEELLDELRRILERDHMVLHEYVNAAGITVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLEEKERRIRTRYEELRRRLRKRVKDYEDKLREIEKKVRRDAERIEEELERAKK

SEQ ID NO: 15887 - protein, 247 aa, Artificial Sequence
  Synthetic sequence.
SEKEELLKLIKRVIELLKRVLEEHLRLVEDVIRRLKELLDSNERDHMVLHEYVNAAGITVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRNLEDVRRVIEDVKRKSARILEEARRLIEEVERELEKIRK

SEQ ID NO: 15888 - protein, 238 aa, Artificial Sequence
  Synthetic sequence.
SEAEKIREALETNLRLLEELIKRLKEILDTHNELLRRVIETLERDHMVLHEYVNAAGITEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 15889 - protein, 247 aa, Artificial Sequence
  Synthetic sequence.
SEAEDLEELIKELAELLKDVIRKLEKINRRLVKILEDIIRRLKRDHMVLHEYVNAAGITDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRETHKKIEKELREALKRVRDRST

SEQ ID NO: 15890 - protein, 240 aa, Artificial Sequence
  Synthetic sequence.
SDKEEIKRRVEKTARDLETEHDKIKKRLEDTVRDIKRELDELLRDHMVLHEYVNAAGITGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 15891 - protein, 240 aa, Artificial Sequence; identical to SEQ ID NO: 15890
  Synthetic sequence.

SEQ ID NO: 15892 - protein, 248 aa, Artificial Sequence
  Synthetic sequence.
DEDRIIEEIARLLEELLRELLELIKKLIETNRRLNEEHERAVRRDHMVLHEYVNAAGITGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 15893 - protein, 248 aa, Artificial Sequence; identical to SEQ ID NO: 15892
  Synthetic sequence.

SEQ ID NO: 15894 - protein, 238 aa, Artificial Sequence
  Synthetic sequence.
DADELLRRLAEEVERVIREAEDLLRRWKETIKKVLDDLKRLLDRDHMVLHEYVNAAGITKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 15895 - protein, 231 aa, Artificial Sequence
  Synthetic sequence.
DKAEVLREALKLLKDLLEELIKIHEESLKRILDLIDTLVKVHERDHMVLHEYVNAAGITERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDVARRSEEELRRIIKKLKEVVKEIRKKLK

SEQ ID NO: 15896 - protein, 231 aa, Artificial Sequence; identical to SEQ ID NO: 15895
  Synthetic sequence.

SEQ ID NO: 15897 - protein, 236 aa, Artificial Sequence
  Synthetic sequence.
STREKAKKVLDTLRADNEDMKRVVEKILRALKRTNERAEKLARRDHMVLHEYVNAAGITEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 15898 - protein, 236 aa, Artificial Sequence; identical to SEQ ID NO: 15897
  Synthetic sequence.

SEQ ID NO: 15899 - protein, 239 aa, Artificial Sequence
  Synthetic sequence.
SERELIERWLELHKEILRLIRELVERLLKLHREILDTIKKLIRRDHMVLHEYVNAAGITKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERTLKKLLDDSARMAEEVKKTLKELLERSEKVAEDVRK

SEQ ID NO: 15900 - protein, 239 aa, Artificial Sequence; identical to SEQ ID NO: 15899
  Synthetic sequence.

SEQ ID NO: 15901 - protein, 231 aa, Artificial Sequence
  Synthetic sequence.
SKEEEVEKVLRKWEEILRRLIEENKRANDKIRREYEELVKEIRRDHMVLHEYVNAAGITEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 15902 - protein, 231 aa, Artificial Sequence; identical to SEQ ID NO: 15901
  Synthetic sequence.

SEQ ID NO: 15903 - protein, 245 aa, Artificial Sequence
  Synthetic sequence.
DEDELIRKLLEDLKDIVRKILELIERDLRDIERVVRRIVKVIRRDHMVLHEYVNAAGITVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRIRKLIEDLERHTAKVLEDVKRAITELRKNSKDILEEVRKLIDELRKRIKEVED

SEQ ID NO: 15904 - protein, 247 aa, Artificial Sequence
  Synthetic sequence.
RDRDVLRKVKAEIEELVARIEKVSRDALSEVKRLLDENRKIAERDHMVLHEYVNAAGITRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 15905 - protein, 247 aa, Artificial Sequence; identical to SEQ ID NO: 15904
  Synthetic sequence.

SEQ ID NO: 15906 - protein, 231 aa, Artificial Sequence
  Synthetic sequence.
SKDEELARLLEELVERWRKIVEDLERDHRRLVKEIRELVERIRRDHMVLHEYVNAAGITERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 15907 - protein, 238 aa, Artificial Sequence
  Synthetic sequence.
SEIEDVIRRLRKILEDLERVSEKLLREIKKILDEARRLNEEVIRDHMVLHEYVNAAGITGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKRIKEASDKVREDVDRLIKELKEAAD

SEQ ID NO: 15908 - protein, 237 aa, Artificial Sequence
  Synthetic sequence.
KEKEDALKKLEDLARKSREDLERVLRKHKKILDKIEELLKRVLRDHMVLHEYVNAAGITESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 15909 - protein, 237 aa, Artificial Sequence; identical to SEQ ID NO: 15908
  Synthetic sequence.

SEQ ID NO: 15910 - protein, 241 aa, Artificial Sequence
  Synthetic sequence.
SEKELLKEILDRIRELLEDDNRLLKRIVDEIRKLLEEWLRVHKRDHMVLHEYVNAAGITEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 15911 - protein, 241 aa, Artificial Sequence; identical to SEQ ID NO: 15910
  Synthetic sequence.

SEQ ID NO: 15912 - protein, 240 aa, Artificial Sequence
  Synthetic sequence.
DREKSVRDIEEDLKRVLDKLRRRVETSKEELKKVLKADKENADRDHMVLHEYVNAAGITIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 15913 - protein, 240 aa, Artificial Sequence; identical to SEQ ID NO: 15912
  Synthetic sequence.

SEQ ID NO: 15914 - protein, 237 aa, Artificial Sequence
  Synthetic sequence.
REDEVLRDIERLLREIEEKIRRILEESTAELRKVEEEVKRIIERDHMVLHEYVNAAGITGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 15915 - protein, 237 aa, Artificial Sequence; identical to SEQ ID NO: 15914
  Synthetic sequence.

SEQ ID NO: 15916 - protein, 243 aa, Artificial Sequence
  Synthetic sequence.
SEAERLADEVRKAVKKSEEDNETLVREVEKAVRELKKNNKTWVRDHMVLHEYVNAAGITGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 15917 - protein, 245 aa, Artificial Sequence
  Synthetic sequence.
SEKDEVTRRIRELLKEAEETNREAIERIKRLLDRVREAVEEVARDHMVLHEYVNAAGITGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 15918 - protein, 239 aa, Artificial Sequence
  Synthetic sequence.
SAEDLVRRVKDLVDKLEDKLRKVVRTNERLWEEIRKRLEELVRRDHMVLHEYVNAAGITDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLVELVRRHNKVLKELVEELEKLVRDHNRVVEEVVRELVELLSRAVEVIKEVVK

SEQ ID NO: 15919 - protein, 247 aa, Artificial Sequence
  Synthetic sequence.
DEERLAEELERVLDRNRKLLEEALRELRRVIEENRKSVKRLLDRDHMVLHEYVNAAGITSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTEEDVERAVKEIRDRLRKLLEDYERAVRRLEDKLRRVRERYEAVLKRIKDKLEETKR

SEQ ID NO: 15920 - protein, 243 aa, Artificial Sequence
  Synthetic sequence.
SRVEELKKLIEDILRISREVVERIARVAEDIHRINRRVLDDLRRDHMVLHEYVNAAGITKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 15921 - protein, 249 aa, Artificial Sequence
  Synthetic sequence.
DAEEVVKRLADVLRENDETIRKVVEDLVRIAEENDRLWKKLVERDHMVLHEYVNAAGITGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 15922 - protein, 240 aa, Artificial Sequence
  Synthetic sequence.
DKDKRLEELLKRLKELNDKTFEELERILEELKRANEASLREAERDHMVLHEYVNAAGITKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 15923 - protein, 240 aa, Artificial Sequence; identical to SEQ ID NO: 15922
  Synthetic sequence.

SEQ ID NO: 15924 - protein, 240 aa, Artificial Sequence
  Synthetic sequence.
SKEETLKRLLDELEKRNRETVERLERLLKELEDRNRASLEELERDHMVLHEYVNAAGITKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 15925 - protein, 240 aa, Artificial Sequence; identical to SEQ ID NO: 15924
  Synthetic sequence.

SEQ ID NO: 15926 - protein, 243 aa, Artificial Sequence
  Synthetic sequence.
SEAERTKESLKKVLKALVDLNRELLRKLEENMRELTKLNEEVKRDHMVLHEYVNAAGITDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 15927 - protein, 178 aa, Artificial Sequence
  Synthetic sequence.
REVEEIERRLRELVRRSDELVRTVAEELEKLVRRNKKLVEDVMKRLRDLVERLRELVDAGLDKKEAEEDVRRLEEEIRRLLETLKEHSDRTRKKIRELVERLRDVNRKVNEEVKKLIRDRDEVRKVLKDVTELSKTSEDKLEKVVREVKRKLDEVNRDLERVVREAKKLLREVRERLE

SEQ ID NO: 15928 - protein, 178 aa, Artificial Sequence; identical to SEQ ID NO: 15927
  Synthetic sequence.

SEQ ID NO: 15929 - protein, 178 aa, Artificial Sequence
  Synthetic sequence.
DEVDEIRRRLKKLLDDSRKTSKDIERRLRELLDRNRRLVERVEEELRKLIKELEELVRSGLDREDVKRMVKKIEDEIRKLLEDLREHSKRTLEEVKRLLEEDRRTNEDLNREIERLDRRREEVEKVLKEARDVSEDSKRETTEVLKEAKKALEDINKRLREIVETVREALERVERALT

SEQ ID NO: 15930 - protein, 178 aa, Artificial Sequence; identical to SEQ ID NO: 15929
  Synthetic sequence.

SEQ ID NO: 15931 - protein, 178 aa, Artificial Sequence
  Synthetic sequence.
DEKETVKDVVRRLVEKLEEVVKESKKLVDDLVKRAKEIVRESEELVRRNVRRAEEVARERNDEETAKRLIEDIRRTTKEIIDTSRRLIEELRRLLEELKRRSEELIREIEKELKDVADRLVRDEKVLKELEDAVREVKERIKKTNKELEEMVRRVEEEIRESDERLKKASEEVEEKIR

SEQ ID NO: 15932 - protein, 178 aa, Artificial Sequence; identical to SEQ ID NO: 15931
  Synthetic sequence.

SEQ ID NO: 15933 - protein, 178 aa, Artificial Sequence
  Synthetic sequence.
SEMETVLDDVRRVVEESEELVKRARDRVKKLVDDLKRLVEKNEEDVKRVVDELDKLVEKVRTEELLERVRKTIERLADEIRRSTETIEREITKIEEEIERIVKTIEDRDRRLLEEIERRGAGEEVLEEARRLSERSREELRRVLEEARRLIRRVREELKRVHDKARRLVERVEEKLRT

SEQ ID NO: 15934 - protein, 178 aa, Artificial Sequence; identical to SEQ ID NO: 15933
  Synthetic sequence.

SEQ ID NO: 15935 - protein, 178 aa, Artificial Sequence
  Synthetic sequence.
DEVEEVLERVKKVVADSEELVKRNRERVKKVVDDIRDLIRRNAETVKEVVKTIRELVKKVRTRELLEDVKRRIKKLLDEIRESTKRIKDTIRRLREEIERTSRKIEDDDRKLVEEIRKSGLGEEALKDAERRSDESRKKLKKVHDDADRMVREVTRRLDEVHKEAEKRVREVLAELDT

SEQ ID NO: 15936 - protein, 178 aa, Artificial Sequence; identical to SEQ ID NO: 15935
  Synthetic sequence.

SEQ ID NO: 15937 - protein, 177 aa, Artificial Sequence
  Synthetic sequence.
SIEEVLKEAHELNKEANKRLRDVEEDAKRLIEEVLRRLEDVLRESERLAREVLEELKRKGVDEKILREIKKLLDENRKHSEEVKRRIEELLRRLKDLVRRILKKDTDSNRELKRLVEEGLDAKELRRRVERSVEESKRLVDELRKDVKRVVDEIRKVVEEDLRHAKRVVDEIREKVR

SEQ ID NO: 15938 - protein, 177 aa, Artificial Sequence; identical to SEQ ID NO: 15937
  Synthetic sequence.

SEQ ID NO: 15939 - protein, 175 aa, Artificial Sequence
  Synthetic sequence.
DEAEEVKRVVEESVRRNEELVRRNEELVRDVLRRLKEVVDENERLVKEVVDRLRDLVRRGADKEEVRREIEKILRDLHEHSKRTEEEIRRLLEELHKHSEETLKDSKRSHEELRRRGAEERVLKEVEELDRRVLEELKRVNDEARKRVRTLLEELRRVNEKVEELVRRILEELKK

SEQ ID NO: 15940 - protein, 175 aa, Artificial Sequence; identical to SEQ ID NO: 15939
  Synthetic sequence.

SEQ ID NO: 15941 - protein, 172 aa, Artificial Sequence
  Synthetic sequence.
DEAEDVVRKVMDEIRKLIEVSKEILKELRRLVEELKKHSDRTVEELRRVVTELLKKEASEEEAKEVVDRIRELVTRLVEENKKLVEEIRRRVEELIRRSEEELKRIEREVDTKLKDITDAVRRVRELLETVRRTSEEVLKTLEEFLRRVEKSTRRAEEELEEFLKRVEDRVK

SEQ ID NO: 15942 - protein, 172 aa, Artificial Sequence; identical to SEQ ID NO: 15941
  Synthetic sequence.

SEQ ID NO: 15943 - protein, 183 aa, Artificial Sequence
  Synthetic sequence.
KEADKLAKELEETIERLKRDSERLVTDLERLLERLERRSRELVKRLRRHVEELLKTVRRDGGESEELKKRLKELKDSNKRLNEDSERVTRKLVTDVERLLEKAEERTKELSERVKRRIDEVRKDVPELREVIKKVEDLLREVEETSKRILDRVRELLKKVEDSSRRINEESKKLLKRVEEEAR

SEQ ID NO: 15944 - protein, 183 aa, Artificial Sequence; identical to SEQ ID NO: 15943
  Synthetic sequence.

SEQ ID NO: 15945 - protein, 175 aa, Artificial Sequence
  Synthetic sequence.
SELEKILEDLKRVAERVAKALDRSLRELEKVLRRVEEELTRSNERLREVVKEVEDAADKLREVIKKLRELLRDLEEKTKRLVDELRKLAKRLAEDTKRLVEDIKRLLDELRKRIRDVDRDEEVRKLVEDLARRLDDIVRRSEELSRKLAEDVEEIVERSKRLSEELAREARELVR

SEQ ID NO: 15946 - protein, 175 aa, Artificial Sequence; identical to SEQ ID NO: 15945
  Synthetic sequence.

SEQ ID NO: 15947 - protein, 180 aa, Artificial Sequence
  Synthetic sequence.
SEIEDVVRKVETLARESDERVKTLMEENKDLAEKLKKLVRDVVEKVKREVTRLLDEVRRRPEREVLDRIRETIKRIEDELRELLKTIDRLSRDLERKNRELRETSKKIIDDIRRELDKLPEDEELKKVKERLDEAERRSKELIDEADRLNREMLKRVKEAIKKVKETLDKALEDVERAVR

SEQ ID NO: 15948 - protein, 180 aa, Artificial Sequence; identical to SEQ ID NO: 15947
  Synthetic sequence.

SEQ ID NO: 15949 - protein, 173 aa, Artificial Sequence
  Synthetic sequence.
SDLERVEERLERAVREVEKLHEDSRRELRRVVKEVHDSTRKVEERNRKLVKRVEEADIREEMLEELRRRSEESIRRTRKVNEDLHRAIEEIERKDKELLDRAKKEVEELLKEVRERGDKKVIKKLEDMLREWAKLVEKSIKELKELLEELRKVSKKLVDDNDRLAEELKRRVD

SEQ ID NO: 15950 - protein, 173 aa, Artificial Sequence; identical to SEQ ID NO: 15949
  Synthetic sequence.

SEQ ID NO: 15951 - protein, 183 aa, Artificial Sequence
  Synthetic sequence.
DEVKALVDKVRELVRKLKEESDDLVRRNEELAKEVEKRSREVVEKVRDTVRKLLEELERADKSDKERLDRLITRIREKIDEVRRRIEELNREIEEVSKKSLKENKDTNREIRERIERLRKELDDKGVDKKVRDDLRKALEDVNRSSKRVEERDKEVLDEAHRSSTRVLETLKRMLERLDEKIR

SEQ ID NO: 15952 - protein, 183 aa, Artificial Sequence; identical to SEQ ID NO: 15951
  Synthetic sequence.

SEQ ID NO: 15953 - protein, 183 aa, Artificial Sequence
  Synthetic sequence.
DEVEKLVKKVEDLVKRLIEVSEDVVREVEKRLRELEKVHREALRKNRKLLEDLLRRLREADKTSDEEVKRLKEEIDEVSERSRRENDRLNEEVNRVTKEVTDKIRKVNEDIRRKIKELKKELDEKGVDDKVREKLKRALDRVNKSSREVEETLRRADKRLNDLVKEIKDEDKRMLERLERETQ

SEQ ID NO: 15954 - protein, 183 aa, Artificial Sequence; identical to SEQ ID NO: 15953
  Synthetic sequence.

SEQ ID NO: 15955 - protein, 183 aa, Artificial Sequence
  Synthetic sequence.
KEVEELVKEVRKLATKVIETSKRVVEELEKLAERLLRTSKEVVKRNKELVDDLLRRVREVSDGDEEKVRRLEEDIRRRSKKSEEDNDRLNEDINRKSKKVADELKKLNDDIRRELDELERELDREGVEEEVRKELRELLRRVNESSKDVKRRLEDLDREINRLSKRVKEEDRRALKEVEEEIK

SEQ ID NO: 15956 - protein, 183 aa, Artificial Sequence; identical to SEQ ID NO: 15955
  Synthetic sequence.

SEQ ID NO: 15957 - protein, 177 aa, Artificial Sequence
  Synthetic sequence.
SKEEEVKRVLREALERVEELNKRLNEEDKRMLDEVRKVNRDAERVLREALKRVEELLSRVSDKDRVKKLREDVKRIAEEVERLSRKSEEDVKKVHRESKRLSDENRKEVKRVEDRVRDKPKTDELVTDVERVVRELLDHVRRLVRESKELARELIRRSEEIVRTVEEVVRKLEKDVR

SEQ ID NO: 15958 - protein, 177 aa, Artificial Sequence; identical to SEQ ID NO: 15957
  Synthetic sequence.

SEQ ID NO: 15959 - protein, 177 aa, Artificial Sequence
  Synthetic sequence.
DKAKKVEELLRKAIEEVEKLNDEVNRTDEKMLRRVKELNDDVHRTLEEAIKRVRELLSRVSDEDRVRDLRKKVEDARREIEKLSEENEERVRRVHERSRKLSDDNRRRVKEVEDRIRKKEKTDEVVTEVEKLMRELLEHVKRLIDESRKLAADLEKHSRDIVEEVRRLVEELLRTVK

SEQ ID NO: 15960 - protein, 177 aa, Artificial Sequence; identical to SEQ ID NO: 15959
  Synthetic sequence.

SEQ ID NO: 15961 - protein, 177 aa, Artificial Sequence
  Synthetic sequence.
SKERDVERKVREVIKRVEDLNKRVHKTLEDVIREVEKLNEEVKTRVEKLIREVEELLKRVSDKDKVRRLRELVERVRRRIEELSRENKKRVEEVRKTIEDLSRENRELVERVRREIEKKEKTDRVVEEVERLLRELEKHSKEIEEAVDRLVRKLEEHVKKVVEEVARLVAELKERVK

SEQ ID NO: 15962 - protein, 177 aa, Artificial Sequence; identical to SEQ ID NO: 15961
  Synthetic sequence.

SEQ ID NO: 15963 - protein, 177 aa, Artificial Sequence
  Synthetic sequence.
SVAEEVKKVKDKLKKDVERLNEEDRRVLEKAKRESKKLLDEIKRVLEELERKLEELLRRDDDKDRVRDLRRKLDEVRKRVKKLIDDSRKRTKDVEKRTEDLNRETEELVRRVEKRVEDLPKAKEVVTEIRRVVKELLDKVRESIKETERVVRELLERNRKILKEIREVVRKLLEDVR

SEQ ID NO: 15964 - protein, 177 aa, Artificial Sequence; identical to SEQ ID NO: 15963
  Synthetic sequence.

SEQ ID NO: 15965 - protein, 186 aa, Artificial Sequence
  Synthetic sequence.
DEARKLLEELKRLAERVLKTDTDLLDESRRILEEVLKTNKKSIEDSKRLAEDVLRKVAREGGESERAKDLIRKLLEDLKELLKRSHETNKRLLEELRRLDEEIHRTNEKLLRELKALLDRIREAGLEEEVLDRVREIMERVLTESKELNDRIHTISRKAEEDSKRLNEEDRAIMEDVRRELKRVVD

SEQ ID NO: 15966 - protein, 186 aa, Artificial Sequence; identical to SEQ ID NO: 15965
  Synthetic sequence.

SEQ ID NO: 15967 - protein, 186 aa, Artificial Sequence
  Synthetic sequence.
SEAEKLLEELRTIAKEVLDRVRKMLRESEKLAEDVLRENKKSIEDSRRIAKKVLDELRRDGGEDESLRERIKRLLEELRRLLEESHKKNEELKRELEELNRRIEETIRRLEKRLKELLDRIEEAGLEEEVLERIRRIFEDVLRKLRKLLDEIHRISEKVKKESEELNEEDKRIVDDAERRLEDLER

SEQ ID NO: 15968 - protein, 186 aa, Artificial Sequence; identical to SEQ ID NO: 15967
  Synthetic sequence.

SEQ ID NO: 15969 - protein, 177 aa, Artificial Sequence
  Synthetic sequence.
SVKDAVEKILREAEETVKRLNEETKRRLDEAREESKRLIDEVRRILEKLKEVLDEVLRRVSDEEKVKRLEDVLRRIEKRVRDLLKEVEDNTRRSVERVRKLNEDDKRRLDEIKEEVRREPGAEELLERVKRLMDELEETSRRILEEVERVIRRNKELADRILKEVAELLKRLEEELR

SEQ ID NO: 15970 - protein, 177 aa, Artificial Sequence; identical to SEQ ID NO: 15969
  Synthetic sequence.

SEQ ID NO: 15971 - protein, 180 aa, Artificial Sequence
  Synthetic sequence.
DEAEELRKTVEDIMKELREELKRLEEESRRIMEELKKRLEKLIEDSRKAAEDLKREADRLTDKEKVKRLKEELERLNRTINKISKELLEKLRRLNTEINKTVDRLRERLERLAEDIRRRVDKRLLEEIKERVDRVKKELDEADKRINDSSREVEKTLEDLDRKINKSSEEVRRVLEEAER

SEQ ID NO: 15972 - protein, 180 aa, Artificial Sequence; identical to SEQ ID NO: 15971
  Synthetic sequence.

SEQ ID NO: 15973 - protein, 181 aa, Artificial Sequence
  Synthetic sequence.
DVEETLTRLLKEILDVVRKALRDTREIVRDVRRVSEEVLKELEDLLREVDREVKRVLAELKGKELLEELKKLLEEIRKVVKEIEDRLKRVTEESEENIEESLRELKRLLKEIKDDVDRVRKSGVEDTEVVKRIRELVEKLRELVKRSNDNLKEHVKRNKELAKRLLDELRKLVEDLKRARK

SEQ ID NO: 15974 - protein, 181 aa, Artificial Sequence; identical to SEQ ID NO: 15973
  Synthetic sequence.

SEQ ID NO: 15975 - protein, 176 aa, Artificial Sequence
  Synthetic sequence.
DMEEEVKKLIDEVRRVLEEVLKRVEDIIDASRRTLKKVVDDVRRIDEDVERELKEAEKRGVPKEVVEEVRDRLRRNHETVKKRIRDLEKENRDLIREIRKLIDKLRREIEELERRLDELGKEEVLREVDRLVKKVEKTARELLRLLEESIEKSKREAEKLLRSNEDVVRRVRERVR

SEQ ID NO: 15976 - protein, 176 aa, Artificial Sequence; identical to SEQ ID NO: 15975
  Synthetic sequence.

SEQ ID NO: 15977 - protein, 174 aa, Artificial Sequence
  Synthetic sequence.
DAEEDAKRLLKEVKDLLDEVRERHRELNERSRKVLEDARKTHEDLNEESRKTLEDRNIPEDILRKIEKHTRDTHRRAERLVRELREHSKKVHDTARRLVEELDKRIKELEERVRRERVGREARELLKRILKDIERILETVVRLSERDVEEVRKIMEELKKLSDDDLKRVEEEAR

SEQ ID NO: 15978 - protein, 174 aa, Artificial Sequence; identical to SEQ ID NO: 15977
  Synthetic sequence.

SEQ ID NO: 15979 - protein, 174 aa, Artificial Sequence
  Synthetic sequence.
SAREEIEELIKRVKDTSKKILEDVRRMIERVKRKSKKIKEDAKRLIERVEKLLRDSNLREDLLKRLEEEIRRIKEDIDRLIEKDERDIRRIEKEIEDLVRRNEDEIRKIEERIDKIDDKDELRELIKRLEDHSRRVVEEVARLVKELDEHSERVLKTLEDLIRRLDELVKRVTT

SEQ ID NO: 15980 - protein, 174 aa, Artificial Sequence; identical to SEQ ID NO: 15979
  Synthetic sequence.

SEQ ID NO: 15981 - protein, 174 aa, Artificial Sequence
  Synthetic sequence.
KAEETVKELLDRVERISERARKEVRELLERSKESTKRILDEAREMIKRSRDELRRVGTDDKELKKVEDHSEEVRREVDELIKKSEKHTEDIRREVEELVRRDREELRKVEDKARREGDLEDLERLARELARHSEDVMRRLRDLARKDKELSEDLVRRLRELVKRDLDLVKTVKE

SEQ ID NO: 15982 - protein, 174 aa, Artificial Sequence; identical to SEQ ID NO: 15981
  Synthetic sequence.

SEQ ID NO: 15983 - protein, 181 aa, Artificial Sequence
  Synthetic sequence.
SMEDRLREVNEKNNRLIEDATRKSERVLDKIRELLKEVKRRSEDVLRRIKELVEKLPVEERVKKEIKEDIDRLRKHSEELVRDVERIIRDLKRHSEEVVERVRRKDEETRREVEELARRGSDEKTLKELVEKIEKVAEDSLREAEEDVKRIEDLVREIKKRADDDVRRLEDRVRRLRERLE

SEQ ID NO: 15984 - protein, 181 aa, Artificial Sequence; identical to SEQ ID NO: 15983
  Synthetic sequence.

SEQ ID NO: 15985 - protein, 182 aa, Artificial Sequence
  Synthetic sequence.
SSVEEVVEEIERLVDELRKRAEELVRESEKLVAELERRIRKLVEDSEKLVKDLKDRAAKGVSEEELERLLEKLKRVAEKTNRTSEELLRELHDFNRRSEKEIDDLLRELEKRVKEVRDRINSDDKVLRKIEDVDRRLKELVRRVKKKDRDSNERVKELVKRLNDENEKVLKRVEELVRRDKT

SEQ ID NO: 15986 - protein, 182 aa, Artificial Sequence; identical to SEQ ID NO: 15985
  Synthetic sequence.

SEQ ID NO: 15987 - protein, 174 aa, Artificial Sequence
  Synthetic sequence.
DEIKKVVKDLEDLVKRLKDEVDRHVRENERIVEELKRNVDRHVEENRRLVKTLEDEVRKGVSEDELRKLLEEVERVTRRSKEDIDRMSKRVDDVTRESDEHIKELLKRVRDMAEKLPDSEDLKRVLKAVEDVVREAKERLERVNRTIREVVKRAREKLKRVHDTIRKVVDDARR

SEQ ID NO: 15988 - protein, 174 aa, Artificial Sequence; identical to SEQ ID NO: 15987
  Synthetic sequence.

SEQ ID NO: 15989 - protein, 178 aa, Artificial Sequence
  Synthetic sequence.
DEVEEVLKELKRSVDETRKLLKKIEDEAKRNVRRNEELAERVKRTVDRLVEELRDLIRRGVDKEKLDRLLRKIEKDLRELKRELEESLKESEKTIRRLKEELEDMLRRSREKIEELRRRGVDNEKLKRAEKEDEEVVRRIRELIERLREENEDVIRRAEELLREVVKRIEEVITEARR

SEQ ID NO: 15990 - protein, 178 aa, Artificial Sequence; identical to SEQ ID NO: 15989
  Synthetic sequence.

SEQ ID NO: 15991 - protein, 181 aa, Artificial Sequence
  Synthetic sequence.
SVEDEIRRVIEELDRLLRKDKETIKRVIKELRDLLREVKKRTEEMIRRLDELLETVTRRIKDEETMDRIDKEIKRLKEELRELLERSDREIRKLEERLERLVRESEKKIRDLKRRLDKARRDGSDVDDVRRLAKEVLDEVKKSVDETKRLADEVKTRVRKNVKDNTDLAREVLRRVAERAR

SEQ ID NO: 15992 - protein, 181 aa, Artificial Sequence; identical to SEQ ID NO: 15991
  Synthetic sequence.

SEQ ID NO: 15993 - protein, 174 aa, Artificial Sequence
  Synthetic sequence.
SRLEKLVKEIRDVVRELAERVKESVDRARKVVKEDLEHAEESVRRVKKVVKELEELVRKLDREEELRKTVEEIRRRNERSNRENRKHSKKVLDDDERSNRELERTMREIKDRIDKLDDDKDIKEVEKRLKDVLDEAHKLNKRTNDELKRVNKESNDLNRKTEEDLKRVLERAED

SEQ ID NO: 15994 - protein, 174 aa, Artificial Sequence; identical to SEQ ID NO: 15993
  Synthetic sequence.

SEQ ID NO: 15995 - protein, 174 aa, Artificial Sequence
  Synthetic sequence.
KRKEDLVEEIRKIVKAVEDEVRRSVKESEDSVRENLKEAERIVRELEEIVKELEKLVRDGLDRRDLRRVAREVKERLRELVERLRESIRDSNRRNKELHDRLRELVRRVAEELKKLDQDELLEDVRKKLEDVLREVEKLNKTVEDKNREVLRRIDELIRRVEEAIEDVRRKVEK

SEQ ID NO: 15996 - protein, 174 aa, Artificial Sequence; identical to SEQ ID NO: 15995
  Synthetic sequence.

SEQ ID NO: 15997 - protein, 174 aa, Artificial Sequence
  Synthetic sequence.
DEKEELVKRVEDKVKDLRDKVEKSVRESTESVRDNERRVRESVERSRDLVRRLDELVRAGLDEEEVKKVVKRIEEDNKRLHDELRRSVEASNEKNKKLHEDLKRLADEIRKEIDKLDQDEELERVRKELEEVLRRAKRLNEDVLEKNREVVRRAAELNKEVKKLLKEVLDRAKT

SEQ ID NO: 15998 - protein, 174 aa, Artificial Sequence; identical to SEQ ID NO: 15997
  Synthetic sequence.

SEQ ID NO: 15999 - protein, 175 aa, Artificial Sequence
  Synthetic sequence.
DEKEDIDRRLRDMVRRDRELARRSVEEARKLVDKNRKLVERVFRELKKLVDELDELVRRRDGPEDDIRRAVKKIKDDLRKLLKELDDHSKDTRRRDEESNRELERHTRELEERIRRLEDDKLLKDLEEELRKTREEVHRLNEETNRRLDKVNKDARDLVRELEELIEDVLRKVET

SEQ ID NO: 16000 - protein, 175 aa, Artificial Sequence; identical to SEQ ID NO: 15999
  Synthetic sequence.

SEQ ID NO: 16001 - protein, 174 aa, Artificial Sequence
  Synthetic sequence.
DEKETVEERLDRLVRHHEKLVRESVKELEELVRHNRELIKKSVEDARRLVEDLKRLIDEGVPEDDVRRTVREIEERNRESHKELEDHNRELRRRNKESHEELKKHIDEIRKELDKLPKDKLLDELRERIDKVNEDARKLNEEVERRITESEKEVTDLNRKVDEDIKRVLEKVER

SEQ ID NO: 16002 - protein, 174 aa, Artificial Sequence; identical to SEQ ID NO: 16001
  Synthetic sequence.

SEQ ID NO: 16003 - protein, 178 aa, Artificial Sequence
  Synthetic sequence.
SVEKVVKDVTDTIKKVVDDARRLSEEVVERNERVNKKLERLSREVVERIKDVLKRLRDKKSEKEEVERRIEKLVREHEEKTKKISEENKRSIREHERTSKEVEERIRRLVETLKELVRRGVPVEDLKRDADRIVEDIKRVVKELVKHAEKSVEDLERVVKEIVKDAERIVREIEKRVK

SEQ ID NO: 16004 - protein, 178 aa, Artificial Sequence; identical to SEQ ID NO: 16003
  Synthetic sequence.

SEQ ID NO: 16005 - protein, 182 aa, Artificial Sequence
  Synthetic sequence.
DVEEVVRRAREENKRSHDEVRELVKEVNERNKTVLERIKELAERALREIREVLREVDERKKDAREDLERLRKRVEDLLRRLEELLKTLEKRVRDLNDESRKLLKRLEEVNRELKKEIDDLEENRVETEKLKEDLDRIVRTSEELVRRLLERARRMVRETEELMRELLTEVKRIVEEVARRVK

SEQ ID NO: 16006 - protein, 182 aa, Artificial Sequence; identical to SEQ ID NO: 16005
  Synthetic sequence.

SEQ ID NO: 16007 - protein, 178 aa, Artificial Sequence
  Synthetic sequence.
DKEELLKRVTEKLEKVSDKSRRLIEEVEREVEKVHREVEERVRKVREDVRDVLRKIRAQGSSEEELEEVRDLARRIEETLKRILDEIKRVTEETREELKRLLEENRRLSEEIKDRLRRLRDDTELVLREVERLVAENERSVEELKKELEKLVRRNRTLVRKIEEDVRRLVEKITKRRE

SEQ ID NO: 16008 - protein, 178 aa, Artificial Sequence; identical to SEQ ID NO: 16007
  Synthetic sequence.

SEQ ID NO: 16009 - protein, 175 aa, Artificial Sequence
  Synthetic sequence.
SDSERVKKEAEDVLREIKRLIERNKRLAEETSERIRRLLEELKDLADKIVETLKDLIDRGEDKDTVREKIKDDLRDLERLAREVEDRIKKLTDELREHTRESEKEIKKIVEELRRKMKGREVVDEVEKRIRELLERLKDVSKKVEESNKKLLDEIRETVERVKKRIKELLEELRR

SEQ ID NO: 16010 - protein, 175 aa, Artificial Sequence; identical to SEQ ID NO: 16009
  Synthetic sequence.

SEQ ID NO: 16011 - protein, 176 aa, Artificial Sequence
  Synthetic sequence.
SLEEVVEEVKRRLTKLLKEIEDVIRRAEEESRRLLEEIERVIREAEKESRRLLEEIRTAGVREEELDKLRKHSEDVKRRLRKILEDNRKRSEEVAKELKELLEELKERIRKVEEDARDLDEDLVRKLAKELLDTLREVLKRIEEIAKEVLDLNDESLKEIRRIVEEDLRKLEEKMR

SEQ ID NO: 16012 - protein, 176 aa, Artificial Sequence; identical to SEQ ID NO: 16011
  Synthetic sequence.

SEQ ID NO: 16013 - protein, 173 aa, Artificial Sequence
  Synthetic sequence.
SEEEEVKRLLDDVREKVKRVAEENRRTVEEVKRVVDEVRRRNKETVERDRRELEKVARDEDKDRVVKEVRKSSADVVREDRESVRRAEEEIRKVMEDDKRSAEEVERIVRRAEEEVKVEEVVREIRRIVEDVRRKVKESVDRVKKILEKVRKDVEDSVREVERTMKKVSDDVT

SEQ ID NO: 16014 - protein, 173 aa, Artificial Sequence; identical to SEQ ID NO: 16013
  Synthetic sequence.

SEQ ID NO: 16015 - protein, 183 aa, Artificial Sequence
  Synthetic sequence.
SKEETAKRLIEEVRKVIEEVKKRAEDSNDHNRRSIEEVEKTLKRLIDEVRRVVEEVKEKISRTTDKDDIKRVLEEIKRIAEEVVRKIRRLLEEITRNSERIVRENEKLLREIEEIVRRVLEELKRLDLKEAVEEIERLMRKIKKVVEDSVRNVERTMREVEEKVRKVEEDVRRLAEDVTRAVK

SEQ ID NO: 16016 - protein, 183 aa, Artificial Sequence; identical to SEQ ID NO: 16015
  Synthetic sequence.

SEQ ID NO: 16017 - protein, 172 aa, Artificial Sequence
  Synthetic sequence.
DEVEEVLRRVRKIVKEDRDEAKDVREENRRLVEDDKRKVERVKEENRRLVEELRKRDEERVEEVVRRIEESARRVAKLSEETARDAERSVEKVVKDSERTVREIDKLVRDVVTDGDRRLLEEVERRVEKLVKESREIAKRSNDRTKDLVRRSEEILRESNERTRRLLEETER

SEQ ID NO: 16018 - protein, 172 aa, Artificial Sequence; identical to SEQ ID NO: 16017
  Synthetic sequence.

SEQ ID NO: 16019 - protein, 172 aa, Artificial Sequence
  Synthetic sequence.
SEAEKVLKDIEKIVKDLERNAKEVLDRNKRNVEDDKRAAEEVLEKLERIVREIDRGDKESVKEVVKEIRRLAEEVARASDETVRRNEKLAREVVEANKDVVRKIRKLVEDVVRDGDRELLKKVIRTVEKLLEDVHKLNEDSERAAKKLTDESREIAREVEERVERLLREEER

SEQ ID NO: 16020 - protein, 172 aa, Artificial Sequence; identical to SEQ ID NO: 16019
  Synthetic sequence.

SEQ ID NO: 16021 - protein, 174 aa, Artificial Sequence
  Synthetic sequence.
REVEEAEKRLREIVKEVTERNKEVVERLRDIVRKSEDDSRKSVETNKEIVDRVRRDVSDERVVREVKKVADEVVRRNERSAEDSRRVVEELVERSRESMERVREMVKRLVEEARKVTDRDVLRELIRTLEEVLKRSEDTNRELEKRIKEVVEDNRRKLEESIKESEKVVDEIRK

SEQ ID NO: 16022 - protein, 174 aa, Artificial Sequence; identical to SEQ ID NO: 16021
  Synthetic sequence.

SEQ ID NO: 16023 - protein, 174 aa, Artificial Sequence
  Synthetic sequence.
SEVEEAERRLKEIAEESKEISKRSVETNAKILDEVRRENTRVLETLKKILEEVERRVSDERVVREVEERVKELVRRSEESLRRVEEVIRRVLEENKESMRRSEERVRRLLEEARKVTDKDELERLIEDIREVVERNKKIADESIKRSRDVVKRSKETNDELEKTIREVVKRIED

SEQ ID NO: 16024 - protein, 174 aa, Artificial Sequence; identical to SEQ ID NO: 16023
  Synthetic sequence.

SEQ ID NO: 16025 - protein, 174 aa, Artificial Sequence
  Synthetic sequence.
DEVEEVLKRLRDILREAKELVERSVKRNEEIAEESRKESEESVRRNEEIVDAVRKRVDDKDKVARVEEVIRRVVEENRKSAKESLDMIRDVVRKNKKVLREAEEVVKRLVEEVRKVTDRRVLERLIRELERVLEELREKLKRSIEESEDVVRKNREILRRSIEKSEDVVRKIET

SEQ ID NO: 16026 - protein, 174 aa, Artificial Sequence; identical to SEQ ID NO: 16025
  Synthetic sequence.

SEQ ID NO: 16027 - protein, 182 aa, Artificial Sequence
  Synthetic sequence.
DVDEVLDTVRRLVEELLKKVERTSRESVRLAEKLLDEVRESSKRSKDESRRLLEEVREIDDSRKVARVVEESRRLMKEDLETVTEVVKRNEDSAREDEERVKRVAEEIRKIVADVFRRVKDKKREKVDKVRRDVERLVEEVEKTVKRSVEENRRIAEEIKRTVEESVKTNEEVVKRIEETAR

SEQ ID NO: 16028 - protein, 182 aa, Artificial Sequence; identical to SEQ ID NO: 16027
  Synthetic sequence.

SEQ ID NO: 16029 - protein, 172 aa, Artificial Sequence
  Synthetic sequence.
RERELVEEVERRLRESNERVKESVDRSRKLLETSHRRVKELVDRLKRVLERVEREVRNTTDKDRVRELVEEVKDAVRRVKEEVKKSVDEVREVVDKDVRDVRRSVKEVEEVARRVKVDELVKRVKEVVDHNERLAEESKKEVDDVVRRNEDLVRKVVEEVKDVVRRIKETVR

SEQ ID NO: 16030 - protein, 172 aa, Artificial Sequence; identical to SEQ ID NO: 16029
  Synthetic sequence.

SEQ ID NO: 16031 - protein, 172 aa, Artificial Sequence
  Synthetic sequence.
RERELVEEVERELKRSTREVEESIEESRKRLEESHRLVAELVKRLEEVLERVRDDVRRTRDKRRADKLVKDVEKAVRDVKREVDKSVKEVEDVVKEDKKRVDDSVTRVDEVLKRVDVDELRKRVEEVVRTNEELARESVRKVKEVVRRNKELVARVADKVREVVKRIRETLK

SEQ ID NO: 16032 - protein, 172 aa, Artificial Sequence; identical to SEQ ID NO: 16031
  Synthetic sequence.

SEQ ID NO: 16033 - protein, 179 aa, Artificial Sequence
  Synthetic sequence.
SVKEIVKKVVEENKKSDDELREFARRVAERNKRVVEELKKRLEDLVRKNEEVVDRLRKRSREEVVEKVKEDSKASVDTAKKVVDEVEERSRRSVKEVERVARESERKSRESVDRVRKAVRSEIVKEVVDRVRKSEESSRKLLEEIVRLVEKSLEEVKRILDEIRRRVEKSERDVRRLRK

SEQ ID NO: 16034 - protein, 179 aa, Artificial Sequence; identical to SEQ ID NO: 16033
  Synthetic sequence.

SEQ ID NO: 16035 - protein, 181 aa, Artificial Sequence
  Synthetic sequence.
DIVEELKENVKRVEETIRKIVKEARENVDDVLKKNKDNVEHDKRTAEEVLKEVKKSIKSDELRRKVEEVVERSRKTAKENEELARRVRDENEKVVKEVERLVRTVAEANKRIVEEIRRIEDKDTVRRLLEEASKLNKDVIRRVRELLKRLHERNEESLRRARELNERSRREAERVLEEVRK

SEQ ID NO: 16036 - protein, 181 aa, Artificial Sequence; identical to SEQ ID NO: 16035
  Synthetic sequence.

SEQ ID NO: 16037 - protein, 185 aa, Artificial Sequence
  Synthetic sequence.
SIVDRIREIMKEVREKVKRVVEENRRNAERIKRRVDEVVKTNRKTVDDVRRKVEDVVRKIKEKGREIERLLRRVEETVEESVERVERIAEKVVREHDKSVKDVERIVKRVTEVAEEVVKRLRRVDREVVEELLRRLRKIVKDVERELKRSTEELNRRSREVLKELEKSTRDVEKVVRELEERLRK

SEQ ID NO: 16038 - protein, 185 aa, Artificial Sequence; identical to SEQ ID NO: 16037
  Synthetic sequence.

SEQ ID NO: 16039 - protein, 185 aa, Artificial Sequence
  Synthetic sequence.
SVVDKIREIVRKSREDVRRVVEEIKDNARDLKRKAEEVVKEVKRIVDEVRETVRDVVEKIKELGREIEKLMERVRKAVEEVIRDIERIMREVLRLHEEVVERIERIVTEDEKKVRDVVAKVRRVREEEARKLLEDVKKSSDDVRRELKRLLEEVNRVSREAEKKLRELLERVKRIIDTLKDELRK

SEQ ID NO: 16040 - protein, 185 aa, Artificial Sequence; identical to SEQ ID NO: 16039
  Synthetic sequence.

SEQ ID NO: 16041 - protein, 185 aa, Artificial Sequence
  Synthetic sequence.
SVKDEIRRIVKESEEANRDVVEKIRRNVERIRRKVERVVEEIKRIVKEVKEKVEDVVRKNKEKGERIKKLVTDVEREVERVVEEIRRIAEKVTDVHRRVAEESKRSADEDKKTVDRVVERVDKAEEEVVRKLLEEVKKSSDESKDRSRRLLEEVNRISRDVERKLEELLRKVEKVVRDLEEELRR

SEQ ID NO: 16042 - protein, 185 aa, Artificial Sequence; identical to SEQ ID NO: 16041
  Synthetic sequence.

SEQ ID NO: 16043 - protein, 185 aa, Artificial Sequence
  Synthetic sequence.
SAEDVVRELKKRVDRSREDNTRVLEELKKAVEESRRLNEESNRRLEKIVRDIKEDLKRITTRKKELEDTVRRLLEKAEKVVRDSIKTSEETVTRVTDVVRRVIERSRETVTDLARVVEEVIRNVTREEVLRELAKIREDIERENKRVLEELEDVLRKVKRVNEEALKNSEDILRDIKEKVDRRRK

SEQ ID NO: 16044 - protein, 185 aa, Artificial Sequence; identical to SEQ ID NO: 16043
  Synthetic sequence.

SEQ ID NO: 16045 - protein, 180 aa, Artificial Sequence
  Synthetic sequence.
SVEELLRKLEEVLRKIREENERSLKELRDRAREIVKRNRETNRELEEVIKELEKRLSRRDKEKVEELVRRIRRIVERVVEEDRRTVEEIEKIAREVVKRDRDSMDRVRRTVEDVLRKATGSEDIVRKIERIVETIEREVRESVKKVEEIARDIRRKVDESVKNVEKLLRDVDKKARDRKK

SEQ ID NO: 16046 - protein, 180 aa, Artificial Sequence; identical to SEQ ID NO: 16045
  Synthetic sequence.

SEQ ID NO: 16047 - protein, 174 aa, Artificial Sequence
  Synthetic sequence.
SEEEKVKEEIRKLIEDSRRHVDELKKRLEKLLRDSEKNVEDAHRTNEKLARELKEKVKKTGTDKKLEEDLRRLLKKTEEYVKEHHRTNRELLEKVREEVKDHERRNRKLLEDLKKRGVNEDVLREAEEMLRDSNRELREILEKIERDLRKSDEELKKSVDDLRRLIKEVEDRLK

SEQ ID NO: 16048 - protein, 174 aa, Artificial Sequence; identical to SEQ ID NO: 16047
  Synthetic sequence.

SEQ ID NO: 16049 - protein, 174 aa, Artificial Sequence
  Synthetic sequence.
SREEELKKELKKRIEDSDRHVKEEKDELDRLIRESEEHVKRLKEEARKKLERLKDLVRKDGPTDELRKRLKDLLDEVKKMVEEHERDNRRKLKELEKRARDHHKRNRELLDEVRKAGVDEKVLREAEELLKEVDRKLERILEEIKRRLEKSDRDLRRVLKELEELIDEVRRRLE

SEQ ID NO: 16050 - protein, 174 aa, Artificial Sequence; identical to SEQ ID NO: 16049
  Synthetic sequence.

SEQ ID NO: 16051 - protein, 175 aa, Artificial Sequence
  Synthetic sequence.
SEKEDIKERIKELLKRSEENVRKLREENRELVRRSEENVKEIHKENEDLIRKLEKLRTRDVDKKKEAEDELRRLLRRTEKLLEDHKKLLEDILRRSRELLKEHEELLREIERELRERIKDEDVLREAKEALEESLRRLRKIHEDSERRLRESLEELRRSVEEAKRLLERLKRELD

SEQ ID NO: 16052 - protein, 175 aa, Artificial Sequence; identical to SEQ ID NO: 16051
  Synthetic sequence.

SEQ ID NO: 16053 - protein, 182 aa, Artificial Sequence
  Synthetic sequence.
DELDRVIEEAEELIRRIEEKLRRINETAKRLLDENLRHSERVHEEINRALERVRKKVEDAGLPKEVVETIKRLLEEVKKESEDLLRENKKLLDDVTKESKDLHDTVKELLKRVADELERLRRSGSDVKDVKDRLRRIIEELERRVRELKKRHEDILRELNRRSKELKDRHKKILEDLDRRVR

SEQ ID NO: 16054 - protein, 182 aa, Artificial Sequence; identical to SEQ ID NO: 16053
  Synthetic sequence.

SEQ ID NO: 16055 - protein, 182 aa, Artificial Sequence
  Synthetic sequence.
EEVERVIDEARRLLRENERHSEEVIEEITKLIRDVEEKVKRINDRAREALEDIREEVKRKGLPEEELKRIEELLDTVRRESEKMHETIKEKLKRVEDEVRKALKENRDLLKKLEDELRELRKTGKDVDELRKELERLIRDLNRLSKRIKEELKRRIEELEEEVKRLKEEHERIIEELRRRVK

SEQ ID NO: 16056 - protein, 182 aa, Artificial Sequence; identical to SEQ ID NO: 16055
  Synthetic sequence.

SEQ ID NO: 16057 - protein, 177 aa, Artificial Sequence
  Synthetic sequence.
EEVERAKKELEDRIREWEEDSKRLKDELKRIIKEWEDESRRVKEELRKIIDDLRKAVEKGISEETLRKIEREIEEILRKIEKKDRDILKRVEEIIEEIERRDRKILRELEKVLDELKKAGIDERILEEARRLVRRVHESSKRVLDDARRKLKELHERSKRVLDDVRRKLKKVADDTR

SEQ ID NO: 16058 - protein, 177 aa, Artificial Sequence; identical to SEQ ID NO: 16057
  Synthetic sequence.

SEQ ID NO: 16059 - protein, 177 aa, Artificial Sequence
  Synthetic sequence.
SEVERIKEELKRIIEDWDRRSRRLKEELKKEIKDWEEDSRRLKRELEEELKKLKEKVERGISEDELRELLRTVEKKIEEIERRDRRIKEEVEKKIEEAERRDEKIKREVEERLKELERRGVDKKIIDEARRLLEELHRKSREVAKEIRKEVKRLHDTSKKVLEDIRRAVKKVADDVK

SEQ ID NO: 16060 - protein, 177 aa, Artificial Sequence; identical to SEQ ID NO: 16059
  Synthetic sequence.

SEQ ID NO: 16061 - protein, 177 aa, Artificial Sequence
  Synthetic sequence.
SEVEKIKRDLEEIIRRWEEDIKRVKKRLDEEIRRWEEESKKVKKKLEDLIRRLEKEVADGRSEEDLKRLLKKLREELEKIERDDRRIAERVKRRLDEIRRRDEDIKKKLEDRLRELRERGVDEKILEDARREAERLHKTSKDVLKKVEDLLRRVNEHSRRVLEEAERRIRDVAEKTR

SEQ ID NO: 16062 - protein, 177 aa, Artificial Sequence; identical to SEQ ID NO: 16061
  Synthetic sequence.

SEQ ID NO: 16063 - protein, 177 aa, Artificial Sequence
  Synthetic sequence.
SEVEDIKRRLEKIIEDWRRKSKELEKRLEDIIDEWDKRSRKLKEDLKRIIEEARKAVDDGIDREEVKELKKRLEDEIEKIRETDREIEKRVDEAIREAEERDKEIAERVKDTLEKLRKAGVDEKVIKEAEDLLRELNESSRRVAKKAKDDLRELNERSRRALKEIRELLREVRERVE

SEQ ID NO: 16064 - protein, 177 aa, Artificial Sequence; identical to SEQ ID NO: 16063
  Synthetic sequence.

SEQ ID NO: 16065 - protein, 177 aa, Artificial Sequence
  Synthetic sequence.
REVEKIITDLEEVIRRVEEYLKRSDEELEKELRRVKRYLDKSDKDLRDEIRRVKEELDKRGGSEDVTRRLKELLRESEEHSERLKRRLDKLLKDSRDHSEELRERLRRLLEEARRRLKEVDKDELRARVEDVVRRAEDELRRHSELNKRLVDEARKLLEDHSRRNEELMRELRKLVE

SEQ ID NO: 16066 - protein, 177 aa, Artificial Sequence; identical to SEQ ID NO: 16065
  Synthetic sequence.

SEQ ID NO: 16067 - protein, 177 aa, Artificial Sequence
  Synthetic sequence.
SELEDILRKLEKRMTDVERYLDESNKDLERAVRRVVETLKRIDDEIRRLLEEVERDLDRKGGNEDLKRKLRELLKRLEEHSERLKRRADELLERSREHSERLKEKLRRLLEEVRRRLDEVDKDELETRLREITKTAEDELRKHSRTNEDIVRELKELVDEHEKELRKVVREAEDESR

SEQ ID NO: 16068 - protein, 177 aa, Artificial Sequence; identical to SEQ ID NO: 16067
  Synthetic sequence.

SEQ ID NO: 16069 - protein, 177 aa, Artificial Sequence
  Synthetic sequence.
SELEEILKDLERMIREVEDYLRKSNERLEDVLRKVKKKLDEINDELRRVVEEVKKKLEDKGGKRELTEKIDRLLDDARRHSEELKKELDDLLRESRKHSEDLKRELRRLLDEVRRLLSQVDAEELKRRLEEIVKRARDLLKEHSDDNERLVERAERLVEEHRDKVRKIVEELEEEVR

SEQ ID NO: 16070 - protein, 177 aa, Artificial Sequence; identical to SEQ ID NO: 16069
  Synthetic sequence.

SEQ ID NO: 16071 - protein, 178 aa, Artificial Sequence
  Synthetic sequence.
SEIERILEEVERAVRESDERLKDIVRKDREVVKRVKELLDKILRKDEEAIKRVIEDLERRGSDETLIRKLKKHLDENRRKVEELKRRLDEHLRRNDETVKDLIRKNNKELEEVRRRLKDITDKDELKKEVDKWVKRARDIVKELEEHSRRSTDELRRTVEDLERHSEESVRRAEKTSE

SEQ ID NO: 16072 - protein, 178 aa, Artificial Sequence; identical to SEQ ID NO: 16071
  Synthetic sequence.

SEQ ID NO: 16073 - protein, 183 aa, Artificial Sequence
  Synthetic sequence.
SELEKILKKIEDALKKVEEDLDRILEEDRKTLEEVKERLERDNEDLKRVVERVEEELKRRGRRRSELDKIRKELRDRLRDASKTHEDIKDELEKIHREVEDTIRRLKEELRDLVRRLEEMVRRDIDKTDELRKDVDRLVKRLKKLVDDLRRKSKETADRLRELVKRSRELSRTLAEELRKKTE

SEQ ID NO: 16074 - protein, 183 aa, Artificial Sequence; identical to SEQ ID NO: 16073
  Synthetic sequence.

SEQ ID NO: 16075 - protein, 178 aa, Artificial Sequence
  Synthetic sequence.
SEDEEAKKRVEDLVRELKKSNDELRRKSEESLRRLKELNDELRKRVRDLEDRLRKLVEDNVDKKDLKKTLDDIRKRLEELERRLKEEHKDLEDRTRELKKRHEDLLKRIKEELKRLADEGKISERIIEELDKELKKSSEETDEIVKRDEDVLRRSDEESRRIIKKLEDVLRRADERVK

SEQ ID NO: 16076 - protein, 178 aa, Artificial Sequence; identical to SEQ ID NO: 16075
  Synthetic sequence.

SEQ ID NO: 16077 - protein, 177 aa, Artificial Sequence
  Synthetic sequence.
SKDEEAKKRVEELTRKLEETVREDKKRIEDLAEKLKKVVDKLRRDSERTRKKLEEVERKGVDDEVVRRLKEEVERINKESREELKKLTKEVEDIIRDSERKLRRLEEEVRKLIEDLRRRGVDERILRELEKVLREVKKKHKETLRTLEELLREVAKRAEDINEEDRKVLEDVVRKLT

SEQ ID NO: 16078 - protein, 177 aa, Artificial Sequence; identical to SEQ ID NO: 16077
  Synthetic sequence.

SEQ ID NO: 16079 - protein, 179 aa, Artificial Sequence
  Synthetic sequence.
SEVEEILEDIRRRMTRVEERLRKSNKELEDAIREVTKRLKKSLDDLKKIIEEVKDVADKKGIDDKVKEKLKRDLDKHRRESEELVKKLDKKLKDHKRDSKRVIDELKRKVEDLERIVRKGELDAEELRKMVEDLTKELEDLVEEDKERVKRWRDELEEIVKRDRDKVERWREEAEKIKK

SEQ ID NO: 16080 - protein, 179 aa, Artificial Sequence; identical to SEQ ID NO: 16079
  Synthetic sequence.

SEQ ID NO: 16081 - protein, 179 aa, Artificial Sequence
  Synthetic sequence.
SELEEILRDVERLVRKVKTDLDDSLRRLKEVIDDVERLLRESNEKLRRVIKDVEDLADKKGIDDKEKKKLREELKEHDDRSRELVKELRKELKEHADDTERLKKEIEELLERLERIVRRGDLSEEALKKLVEDLRKRLREVVEEDKEKVRRWTEKAKRIVEDDKRRVEEWERKLEETVR

SEQ ID NO: 16082 - protein, 179 aa, Artificial Sequence; identical to SEQ ID NO: 16081
  Synthetic sequence.

SEQ ID NO: 16083 - protein, 179 aa, Artificial Sequence
  Synthetic sequence.
DEVERVLDDVRRKLEKVRRDLRRIDEDLRRVVETVKRLLDESNKDLERAVRKVKDELDKKVRDKKELEKVKKELDEMLEEHKKRAEDLKRRLEELLRRHHEELKKMERKLREELKRLEDAQLPEEELRRVVKELKEDLERLVRELEETVREVKEELEKVVRDDEKLVEEWKKRLEERSR

SEQ ID NO: 16084 - protein, 179 aa, Artificial Sequence; identical to SEQ ID NO: 16083
  Synthetic sequence.

SEQ ID NO: 16085 - protein, 179 aa, Artificial Sequence
  Synthetic sequence.
EEVERVLDDIRRVVEEVKRRLDEIDKKLTEENERVKEELDRIDDRLRKLVEEVKRRLDEKVGDKEELERVKRELDERLKKHHEEIERLKRELDEINKEHHRRIEELKKDLERLLKELEDAQLPREELEKVVEDIKRKLEKAVRDLEKTVKENKDRNDDIVRRVKKTVDDAEERLRRAVK

SEQ ID NO: 16086 - protein, 179 aa, Artificial Sequence; identical to SEQ ID NO: 16085
  Synthetic sequence.

SEQ ID NO: 16087 - protein, 175 aa, Artificial Sequence
  Synthetic sequence.
KEVEDILRELRRAVEEHRRRSEELLRRMRKLVKDLEDRIREILERARRSVKEIKDRIEKDGPDKRMEDLLRKDNEDLKRLAEEIRKVLEKLRRDIERVKRKNETDLRKWEEDLRRLNIDEEVLKEVKKLLDEVRKRSKDIVDEVRKLLEEVLKEAERVLREWKKLNDEVEDRLRQ

SEQ ID NO: 16088 - protein, 175 aa, Artificial Sequence; identical to SEQ ID NO: 16087
  Synthetic sequence.

SEQ ID NO: 16089 - protein, 180 aa, Artificial Sequence
  Synthetic sequence.
SEVEEVLKEVRKLIEDWRANSERILRRIERAIRELRRKIREWLERSKKKIKRLEEVIDKEVDKKEELREKIKRVREDNERRLKRLEEEIEEVRKELEDALRDDTRKLKELEKRLEDVRRDGVIDEDVLREARKRVDELEKRSREVAKRARDLLKEVRDKIKEVADRSRDLLRKVEEAIEK

SEQ ID NO: 16090 - protein, 180 aa, Artificial Sequence; identical to SEQ ID NO: 16089
  Synthetic sequence.

SEQ ID NO: 16091 - protein, 184 aa, Artificial Sequence
  Synthetic sequence.
SAEEVDRRVEELLKELERRSEEVLETWKELNKKLNKDAKDVTDEVRELLKELAELIKRDGLPEEDVRRLLERVKRTIEELKKELEKLSEDDKRRLERVREENKRIAERLRETIERIREDIKRGRSEEVVRRLLEDLRRLIDEWRKRSKEVEEEVRKSIEDIKRRIEEILRRIRKLIEEIRRRIK

SEQ ID NO: 16092 - protein, 184 aa, Artificial Sequence; identical to SEQ ID NO: 16091
  Synthetic sequence.

SEQ ID NO: 16093 - protein, 174 aa, Artificial Sequence
  Synthetic sequence.
DEDERVKDLLRRVKKTVDELLEELKREVKKSREEAKRLLKELEDRLRRSRKEAEKLRSSTDEDRLREESDRDRRELEDVREKLKRVLREDNERLKEVEKKLRDILRRMEDTLRRANIPREVLEEAKKILDDARRAIEEIIREWEEVNKEVDDRIDRIVEEWRKVNDKVNKDLTT

SEQ ID NO: 16094 - protein, 174 aa, Artificial Sequence; identical to SEQ ID NO: 16093
  Synthetic sequence.

SEQ ID NO: 16095 - protein, 174 aa, Artificial Sequence
  Synthetic sequence.
SEEEKIVEDLRREVKRLAERVKELIETSKKLVEDSKRHVKDLARRLRDIIRKLKKDLRDKGPTEDLKRKVDKVLEEAAREIKKHLDKNKELLERDERVVRDVERRLRELLKKVEDRGVERRALEELEKVVREIRRELERVHEETRRVIEESNRELEEILREAKELLEEVKKEAE

SEQ ID NO: 16096 - protein, 174 aa, Artificial Sequence; identical to SEQ ID NO: 16095
  Synthetic sequence.

SEQ ID NO: 16097 - protein, 187 aa, Artificial Sequence
  Synthetic sequence.
RELEKALEEAKRLLDKVRKELKKIHEESRRLLKETRDETRRVLEEAERLLREIKKLIDRLREDRDETEVKRLEDALKRLKEKVEEDVRRNEEHNKKLEEDDEKLLRDLERTIDTLERRIKEKAKRDIREEDVRRLVEELRDLIRELERKVKEVVETSRRLAEKDKEDNKRILEELRRLIRELEEDVR

SEQ ID NO: 16098 - protein, 187 aa, Artificial Sequence; identical to SEQ ID NO: 16097
  Synthetic sequence.

SEQ ID NO: 16099 - protein, 182 aa, Artificial Sequence
  Synthetic sequence.
EEIERVEKLVEEVVRRAEDELRRSAEHVDRVVERAERLVERSREHSKDLMRRLEEVLRRGEPRREVLTEVKEELDRHREENKRLVEELRKIVEDHERDNRRLVKKMREDIKRVEDRVRRELKDEDKAREIIERLRDVLRKIEEALERISRKLKEVLRRVEKKLEEDSRTLTRVVEEAKKKLD

SEQ ID NO: 16100 - protein, 182 aa, Artificial Sequence; identical to SEQ ID NO: 16099
  Synthetic sequence.

SEQ ID NO: 16101 - protein, 182 aa, Artificial Sequence
  Synthetic sequence.
KEIEELDEEVRRLVEELKRLSDESRKHSKRLVEELKKLLEDSKRHSEELARRARKVLREGRERDKVLKELEELVKRHEEDNKRIVDELRKLIEDHRRKVEELTERVRRLLETLTRKVKDKLKRREDAERIIKKLEDVMKRAEETNRRDIKKLEDVLKDVEDKLREDSKRLREVLEEVKKRLE

SEQ ID NO: 16102 - protein, 182 aa, Artificial Sequence; identical to SEQ ID NO: 16101
  Synthetic sequence.

SEQ ID NO: 16103 - protein, 182 aa, Artificial Sequence
  Synthetic sequence.
SEVEEILRDIERASEESKKTLDRILKKIEDASRRSKELSDKSLKEIRDAMEEIKKELDKGPDDEKVKRIKERLEELLRRLEEHNRRLKEEDDRLLKELRDKVRELKERDKKLLKDLERMVRRDVRKSEELDRRVKELVRKSEEELKDLDREVKELVRRSEELLEDDKRLVKEVVDEARERRR

SEQ ID NO: 16104 - protein, 182 aa, Artificial Sequence; identical to SEQ ID NO: 16103
  Synthetic sequence.

SEQ ID NO: 16105 - protein, 178 aa, Artificial Sequence
  Synthetic sequence.
DELEDVKRRVDEIVRELERLNEKLRRDVEEIVKRLKELNKRLLEEVRRTAEELKTKNVDRDRAKEELDEVRRKLKEVFDRAKRVHDEVRKRLEELKRRSKEVLDRVREDLKRLEREIPETEELREILKELKRVLDESRKLSKEIEEELERVLRDSERATEEILRELEKIIEEVERKVR

SEQ ID NO: 16106 - protein, 178 aa, Artificial Sequence; identical to SEQ ID NO: 16105
  Synthetic sequence.

SEQ ID NO: 16107 - protein, 178 aa, Artificial Sequence
  Synthetic sequence.
DELEEVRKRVERIMEELKRHLEKIAKDSKKSVDELKKHLEDADRKSEESVRKLERDNVDRDEARKLLEDNEREVRKVERNVEERNKRNEDEMKKVEDDVRRLNDEVRRDLERLAREIPRTRELEDILRRLEEVSERHRRSIEEILRRNEEASRRHRESIRRILEKNRRVLERVERKVE

SEQ ID NO: 16108 - protein, 178 aa, Artificial Sequence; identical to SEQ ID NO: 16107
  Synthetic sequence.

SEQ ID NO: 16109 - protein, 177 aa, Artificial Sequence
  Synthetic sequence.
EEDERAKERVKRVVEENDKVNEDVEREVRKVVKENEDVLEEIKRTVDKIVEDLERLVREGVSEEIVKKVKKDVKDVLKELEKKLRALSRKNKELLDRMEEVTRDLSRRNKELLDELKARNVDERILKELEDANEKSKKRSREILERLREANERIEETARRILKKLEEVLEEVERRTT

SEQ ID NO: 16110 - protein, 177 aa, Artificial Sequence; identical to SEQ ID NO: 16109
  Synthetic sequence.

SEQ ID NO: 16111 - protein, 174 aa, Artificial Sequence
  Synthetic sequence.
KEREDVKREVEKSVEDLRRHVRDVEEKVRKIKKELEDHVRELKKRVEEIRRRLKDLADRNVDREVVRKELEKLERELREEEKDVKRKNDDIRRRLKEIEDDVDRKNKESEERLRRSDIDESVLEELKRANERHKREIERIRKELEDVSKEHEDRIRRVLEELERVLEEVKRRVD

SEQ ID NO: 16112 - protein, 174 aa, Artificial Sequence; identical to SEQ ID NO: 16111
  Synthetic sequence.

SEQ ID NO: 16113 - protein, 175 aa, Artificial Sequence
  Synthetic sequence.
SEEERAKEEVEKHKRRLEKLVRDAERSSTEHERKLREIVERVKRELDKHEEKLRDIERKGDLTEELKRELDESTKRFKEKIERLKREIRRSSDEHRKRIKEIEDELKESTKRIKERLKRLEEVIREVEKISREVTKLLRDNLKRVEEVTERVERTLDELLERVKEVTKEVKERLR

SEQ ID NO: 16114 - protein, 175 aa, Artificial Sequence; identical to SEQ ID NO: 16113
  Synthetic sequence.

SEQ ID NO: 16115 - protein, 175 aa, Artificial Sequence
  Synthetic sequence.
SERERAEELVRRHEDRLEKLVRELEESSDRHKKRLKRLVEEVRRLIEEHRRRLDEIKKEGEQTEELTKELEDSDRAVEETIRRIEEELKRSSDRHRRKVTEIKRELDKSTRDIEEELKTLEEVLRKVRTVSTEVKKRLDRNLEEVKKLTEDVTRKLRRLLEEVNKITRDVKREIK

SEQ ID NO: 16116 - protein, 175 aa, Artificial Sequence; identical to SEQ ID NO: 16115
  Synthetic sequence.

SEQ ID NO: 16117 - protein, 175 aa, Artificial Sequence
  Synthetic sequence.
SELDEVRERLKRIVDDLRRRSEEVNKRLEEILREITERLREVNERLADIIRKIREDRKDAEESLRRLTKILEDAHRRSREVIEDLKRTLEELERRSRELIRRLEEILEKIRKDLEEGRREEVLKKLVEELRKRVEDMARTHDRLVEELKRKADEIVRRHEELVKDLKRKLEEVKT

SEQ ID NO: 16118 - protein, 175 aa, Artificial Sequence; identical to SEQ ID NO: 16117
  Synthetic sequence.

SEQ ID NO: 16119 - protein, 173 aa, Artificial Sequence
  Synthetic sequence.
SEEEKAKELVKELRKEAKKIVDEMRKLVEDHAKLVEELVRDHKRLVDEHRRLIEELKDREEKERILEELRRSDEKLKEDSERAKRELDRSTKELRETAERAKRRLTKLLDEIRREGVSEDVLRELEEIVRDIRKKIDDVIRKLEDISRKARKDSDDVNKRLNELTDDVRRKLT

SEQ ID NO: 16120 - protein, 173 aa, Artificial Sequence; identical to SEQ ID NO: 16119
  Synthetic sequence.

SEQ ID NO: 16121 - protein, 173 aa, Artificial Sequence
  Synthetic sequence.
EEEERARDLVRRLEEIVRRLVKEHEDLVRRHKELVDKLVREHEKLLEDHRKLVEELKDRERKEEILEELRRSTEEIERRSEEAKKRLRESDERLKEMSKRAKEEIKRLLEEIKRRGVSEEILERARKIVERLKTESDRVNKRLNEITRELEKRSDEVNTEVRRITKKVTEELK

SEQ ID NO: 16122 - protein, 173 aa, Artificial Sequence; identical to SEQ ID NO: 16121
  Synthetic sequence.

SEQ ID NO: 16123 - protein, 173 aa, Artificial Sequence
  Synthetic sequence.
SEEERADKLVKELKKMAEDIKREMDKLVEELKRTIDELRKKHKELVDRHRRLVEELARREDSERIERELKESDDRIKEESDRAKRKLEKLLKDLTDRAREAKKRLRRLLEEIERDGVSEEVLKTLKEIVRKIEEEIDRVEKRLRELVKELKDDSDEVNKEVNKITRKVKEELR

SEQ ID NO: 16124 - protein, 173 aa, Artificial Sequence; identical to SEQ ID NO: 16123
  Synthetic sequence.

SEQ ID NO: 16125 - protein, 175 aa, Artificial Sequence
  Synthetic sequence.
RTEEEAERTVEDVARKVKEWREELEEVVKEVRERVKRWKEEMRKLDEDTKKKLDDASDIDEELLKRLITEIKKINEDSKKKDKELEKEIRRLLEELKRKDEKLAEEIKRIIEDLRRRGVPEEVIERIERILKDLHRDSERVLRELKRILDELHRESKESNERNKKLVEDAERRTK

SEQ ID NO: 16126 - protein, 175 aa, Artificial Sequence; identical to SEQ ID NO: 16125
  Synthetic sequence.

SEQ ID NO: 16127 - protein, 175 aa, Artificial Sequence
  Synthetic sequence.
DTEKDAKRTVDDVRRKIREWEERLKKIVEEVKELVRELVERAKRLDEETEREAREAKDIDDDTLRKLKEKVERENRKSRKELEEIERRIEKLLEDMTEEDKKLEKEIRDILRDLRRRGVPEEVIKELEDLLRRLHEESKRVLDTLRRILEELRDRVRRSNKRNEEIVKELEDRSR

SEQ ID NO: 16128 - protein, 175 aa, Artificial Sequence; identical to SEQ ID NO: 16127
  Synthetic sequence.

SEQ ID NO: 16129 - protein, 175 aa, Artificial Sequence
  Synthetic sequence.
SEEDKAREVLKRVRDEVEKWRKELERLDEESKKKVDDLVRELEELDKKTDEELRRMQDATSEVLKDLERKIKERNEESKRKLKRIAEDAERTNRESKKKDEKLAEDIERILERLKEEGVPEEILKKIRRILEKLHEDSRRSNETNRRILEELEKRVRESNKRNEDILREVKRKAK

SEQ ID NO: 16130 - protein, 175 aa, Artificial Sequence; identical to SEQ ID NO: 16129
  Synthetic sequence.

SEQ ID NO: 16131 - protein, 175 aa, Artificial Sequence
  Synthetic sequence.
KTEEKVERDVERVKRDVDELIRRAEEVVKRVEDEVRKWIKELKELDDETERLVREASTVSSEDVKRLEEEAREINRESKKKDDELAKEVRRLLEDLRRLLRELAEKIRKIIEDLRREGVPEEVIKRIKKILDDVRRAVKEVLDRIRRILEKVHEDSRRSNKRNKEILDKVREDTR

SEQ ID NO: 16132 - protein, 175 aa, Artificial Sequence; identical to SEQ ID NO: 16131
  Synthetic sequence.

SEQ ID NO: 16133 - protein, 175 aa, Artificial Sequence
  Synthetic sequence.
SDEERVKEELKRILDEARRLLEESDEKLKRILDELRERLKESDERLKRILDKVRKDGLPEEVLRRLEKLVREHHKRNRELLKRVEDYVKEHHDRNRRLLEDVEKKVRELEELIDRGDLSSEELEKEVRELKKRLKKLIDESDKNVKEAEKELRELLRRSEEHVKELKKDADRESK

SEQ ID NO: 16134 - protein, 175 aa, Artificial Sequence; identical to SEQ ID NO: 16133
  Synthetic sequence.

SEQ ID NO: 16135 - protein, 175 aa, Artificial Sequence
  Synthetic sequence.
DDERRVKEKLKRILDESRDMLRRSDERVERSVRTLEDALRRSDEKLERILKKAEDDGVPREELERVRRYVKRHHEENRRLLKETREYAERHHRENRRLLKEDEEKIRRWEEILDRGELDSKELDDAVKKNKKESKETVDRSEKNVKELHDRNEELLRRSEKNVDDAKRRLDDTSR

SEQ ID NO: 16136 - protein, 175 aa, Artificial Sequence; identical to SEQ ID NO: 16135
  Synthetic sequence.

SEQ ID NO: 16137 - protein, 175 aa, Artificial Sequence
  Synthetic sequence.
DDEERVKKALDEILDRSRRRLEESDEKLDRSLKTLKKLLEESDRDLERILEKAERDGVPREVLEELKKLVEKHKKDNRELLRATEERVKRHKDTNRRLLEEDRRKIETWKEIIDRGELSREELEEAVRRNDEESKKTVDDSRRHVDELHRRNEKLIEESKDHVRRLEEELRKKSK

SEQ ID NO: 16138 - protein, 175 aa, Artificial Sequence; identical to SEQ ID NO: 16137
  Synthetic sequence.

SEQ ID NO: 16139 - protein, 175 aa, Artificial Sequence
  Synthetic sequence.
DEKEELSERVERVIRTAEKLLDEIKRKLEEIHKKANEDLERSLRKLEKVVKEVRDAGVSEDVERRLKRLVDEHRKKLEDIVRRSREELRELEKTLRDIKDEVKKELDRLEEVLRRGELREDELREDVERVKRRLEELIERLRKKVDEVKERHERMLKRSEEHVKELKDEVTEEAK

SEQ ID NO: 16140 - protein, 175 aa, Artificial Sequence; identical to SEQ ID NO: 16139
  Synthetic sequence.

SEQ ID NO: 16141 - protein, 174 aa, Artificial Sequence
  Synthetic sequence.
SEKEELEKEVEDLERRHREELEKLNRKSKKIDEDLKRIIEELNKVSKKIKEDLEREIRKGQRKDDLRRRLEEMLRRNKKDLDEVRKELEELLRENKRLLDKVEEDSKRRHEELERRNIDDEVRKRVEDINREVKEMLERNLRHTEEVIKKADREIEKNERHTREVIREAEERLR

SEQ ID NO: 16142 - protein, 174 aa, Artificial Sequence; identical to SEQ ID NO: 16141
  Synthetic sequence.

SEQ ID NO: 16143 - protein, 175 aa, Artificial Sequence
  Synthetic sequence.
SEVEEVDKKLETSHRDIEKRIREVLRELEESSRKLKRDVDEVLKKLEESHRRIAESLKTADEKLRRLEETTRTLIERLKRLVERVKELSDELARRLEEVEKELRERSRRLKEELKRVTDSKRLEELVKEHKRTLEEVKRRLEELVKKHRKDLEDLVREAEELVERHKRKLDETEK

SEQ ID NO: 16144 - protein, 175 aa, Artificial Sequence; identical to SEQ ID NO: 16143
  Synthetic sequence.

SEQ ID NO: 16145 - protein, 175 aa, Artificial Sequence
  Synthetic sequence.
SEVEEVDKEVERILDEARKALKRVEERVRKSHEDIRREIKRVEEDLERSSREIREKLKDQDRKLEELEKESKTLKDDLDRIRKEVEKLTRDVEKRLRELMERIKDEIRRVKEKLKRVTDAEKLKKLVEELEKEIRRLVDELDKLVRKHEEELDRLRKRMDELVKEHKKRLDDTAK

SEQ ID NO: 16146 - protein, 175 aa, Artificial Sequence; identical to SEQ ID NO: 16145
  Synthetic sequence.

SEQ ID NO: 16147 - protein, 184 aa, Artificial Sequence
  Synthetic sequence.
DDEERAKKRVKEAEKEIKDLAKESRDIVEKHRKEVEDVVREMERIVRELAEEAKDVVRKVKDDRDDDKIRELLERLKRKVEEILREIRKLLDDLRRKSEEVVRTNKELTDRLRKKIKDILDELEKEDVRTEVKDRLRDVLKKAEEMSKEVEDRLRKSSEDLREEVERVEEELKRVLRKIEEDIR

SEQ ID NO: 16148 - protein, 184 aa, Artificial Sequence; identical to SEQ ID NO: 16147
  Synthetic sequence.

SEQ ID NO: 16149 - protein, 184 aa, Artificial Sequence
  Synthetic sequence.
DDRERAKKTVDKVKEDLTRLVRRSEDLVRRHTEKLERVVEELERIVKELEERLKKVVDDVKDRRDREEIERLLRTLDREVKEIKKRIRELLKKLHDDSRRVVKENKELTDRAADEARRIEKRLEDEDVREDVKRTLREILRELEEASREVEERLKESDDRIRERVREVDEKLDRVLEELRKKMT

SEQ ID NO: 16150 - protein, 184 aa, Artificial Sequence; identical to SEQ ID NO: 16149
  Synthetic sequence.

SEQ ID NO: 16151 - protein, 174 aa, Artificial Sequence
  Synthetic sequence.
DELEKVRKELKEILDKLKDVLEESRERTDRLLRKAEEDLRRSDEETERLVKELKDAGVSEEALRRLEELVKRHKEELKKLLEELRRLIEEARDVHRRLLERIDRLIKELEEMLRRGTDKDELKKLVEDLDREVRKIVEELKELNKRIEDELRRIVDEARRSNEKVKELIDRLRK

SEQ ID NO: 16152 - protein, 174 aa, Artificial Sequence; identical to SEQ ID NO: 16151
  Synthetic sequence.

SEQ ID NO: 16153 - protein, 174 aa, Artificial Sequence
  Synthetic sequence.
DEVETVEREADRILKEDEDVLRRSKKITEDILDTLREMLERSERRTEEILKRLEEDGVSEEVKREIRERIKELKDRHRRIEEDVKRLADEHRERLKELLKDTKRIIEDIRRKLREGTDKDELKKLVDELKERSKETERELKESNDRLRKKVEDIRRELKRLNDEAEEAVRRLRT

SEQ ID NO: 16154 - protein, 174 aa, Artificial Sequence; identical to SEQ ID NO: 16153
  Synthetic sequence.

SEQ ID NO: 16155 - protein, 181 aa, Artificial Sequence
  Synthetic sequence.
SLIERIEEEIRRVIERVRRLVREIEDSDRKAKEDLERVVREDEETLRRVEKKLKDLNVPEEVLKRLREELEKVLRDSKELLKRMTEESERHNKEVRDEVRRLEKKLEKLVEDVKRTASRPTSEEEVKKLLEKVKRTARELEKVAEDMLRSNRELVKELLRTLEKSLRDSERTAEKLERAEK

SEQ ID NO: 16156 - protein, 181 aa, Artificial Sequence; identical to SEQ ID NO: 16155
  Synthetic sequence.

SEQ ID NO: 16157 - protein, 175 aa, Artificial Sequence
  Synthetic sequence.
DKEKEISDRLKDVLRKVRDVIEKDKRTNEEARKRVEDLVRKDEETLKRVLEEVRKGGLDEDKLRKLETEVRRILEESEKLLRDIRDRLRRSLEEIERLLEELERELRKIDEEVKRKEIPLEDLLRKVEKLAREITERLKESNERSRDLVEKLKREVKKSLRKSERLMEKARETLR

SEQ ID NO: 16158 - protein, 175 aa, Artificial Sequence; identical to SEQ ID NO: 16157
  Synthetic sequence.

SEQ ID NO: 16159 - protein, 174 aa, Artificial Sequence
  Synthetic sequence.
SEREEVKRTLTKAEEEARRLIKRDRDTNTEILKEATERSERDKDKLRKILEEVKKAGLPKELLDEVRERVRRHEEENKKVLEEVKKLIEDSKRETEELERRVKTKVDKLRDEIDKEPPDKDILDRVRRLVEELRRMIEELNDKSRKLVERLRKLLEDLNRHLEELVKRLRDKAK

SEQ ID NO: 16160 - protein, 174 aa, Artificial Sequence; identical to SEQ ID NO: 16159
  Synthetic sequence.

SEQ ID NO: 16161 - protein, 174 aa, Artificial Sequence
  Synthetic sequence.
SAKEELEDRIRDIVRRVRELITEVKKKNREILKRVEKVIKEVKETNERIEEEVRRGGLPEKLLRDITRKLRDHNRKVEEVMKRLRDLSRKHEKEVEDVLRELEKKAKELRDRLRKIEDIDKARKEVEDLVRDAKRVIEELERSLDELVRTLDELVRRLKKSSEDLMRELRKTTE

SEQ ID NO: 16162 - protein, 174 aa, Artificial Sequence; identical to SEQ ID NO: 16161
  Synthetic sequence.

SEQ ID NO: 16163 - protein, 174 aa, Artificial Sequence
  Synthetic sequence.
DEKKEVEKRLKEIEDEVRKMIKEVKETNRRILKKARDLIKKVEDTNKRILEEVRRGGRPEELLRRIEEELRKHNRDVDKVRKDVEDEVRKHDREVEEVLDRARRKVEEVARRVKRIEDIKKLEDEVRKLKDELRRELERLKRSSTDLARRLEEIIRRLERSSEDLERRLRERER

SEQ ID NO: 16164 - protein, 174 aa, Artificial Sequence; identical to SEQ ID NO: 16163
  Synthetic sequence.

SEQ ID NO: 16165 - protein, 174 aa, Artificial Sequence
  Synthetic sequence.
DEKEEVRKRLTDILRELEDLSRENERSNRRILDRVRELIERVKKTNKDILEEVERGGLPKDLLREIRERLRKHDKRVEEVLEEAERKVRDHDRENRRVTKEARELLEEARRRVERIEDIDKLRREVEELVRDLRRLIEELSRSSEELVKELEKLLRELEESSKKLAEELRKAVE

SEQ ID NO: 16166 - protein, 174 aa, Artificial Sequence; identical to SEQ ID NO: 16165
  Synthetic sequence.

SEQ ID NO: 16167 - protein, 181 aa, Artificial Sequence
  Synthetic sequence.
SSKERIKEKVDRIEERIREVVKEVEEELRRSTEEARRMVREVKRRLEDSNRKIKKFIDEKPEDEDLRRKEREIEELTRDIERKLRRIEEEIEKLSERLKRELDKISKTVEDLARKLEEKIKRITDSEELKRLLEDLRRKIEELAKELKKLLEEHKRRVDDVVRRMEELLKRHEELVRRIAK

SEQ ID NO: 16168 - protein, 181 aa, Artificial Sequence; identical to SEQ ID NO: 16167
  Synthetic sequence.

SEQ ID NO: 16169 - protein, 177 aa, Artificial Sequence
  Synthetic sequence.
SEAEEAKKTVEEISERLREALRRSEEETERILRENEKASERHKTEIEKITKELEDKLGDDKRVREEIERLRRNVEKLNKENREAAEELKRRAKEVHDRVRKKLRELEDKVDKLRRKGKDRDKDELKKVLKEIEDTVRRIVKELEDLNTEAEKASRKSVKELEEHLKRVEERVREEAK

SEQ ID NO: 16170 - protein, 177 aa, Artificial Sequence; identical to SEQ ID NO: 16169
  Synthetic sequence.

SEQ ID NO: 16171 - protein, 180 aa, Artificial Sequence
  Synthetic sequence.
ELKERLEKLLKDWADDSKRMRDELARLLKEWEDRSRKAKRDLEKILEENDDKVKKLDKVDKREAVEKELKELDERNKEVLKKLEDDDRKILEDAEELIERIERRDRKILEEVERDLSRISDEKVLREVKESAKKISRHSEKVLDEARKELERISEHSRRVLDRVRRESKKIVEDLRERKR

SEQ ID NO: 16172 - protein, 180 aa, Artificial Sequence; identical to SEQ ID NO: 16171
  Synthetic sequence.

SEQ ID NO: 16173 - protein, 178 aa, Artificial Sequence
  Synthetic sequence.
DIERELEEIVRRIKELIRRHKKRLEELVRELEELLRRHREELKKLVKRAAELVEELRRRNSRDETTLRRMREKLDRIRREIEKSTKEVEDELDKLLKEVDTSHKELEDRVRELAKELERKNVDDTVKDMLRKLLEEVKEASDRAREKLTDILRKIKKISEEVKREIDDIRKKIEDTAK

SEQ ID NO: 16174 - protein, 178 aa, Artificial Sequence; identical to SEQ ID NO: 16173
  Synthetic sequence.

SEQ ID NO: 16175 - protein, 178 aa, Artificial Sequence
  Synthetic sequence.
SIEEEAARIVEELRREVEEWERTLREIVERLRRLVEEHKRRLDELVAELKRLVDELRKENSKDETSLREIKERLERLEKEIDESDERMERELRKLTEEVKERNERLRRKVEEVKKELDDKNVREDIRRKLKEILDELDTITEKLKKELERIKREMKEASRRVREKIDRIRKEIEEVAR

SEQ ID NO: 16176 - protein, 178 aa, Artificial Sequence; identical to SEQ ID NO: 16175
  Synthetic sequence.

SEQ ID NO: 16177 - protein, 179 aa, Artificial Sequence
  Synthetic sequence.
DEIRELLKRIRDVAKRIKDKADRLNEKSRRKVEKLVRDVEKINEDTKRLLDRLRDSDQDRKDLERDVRRVKEDIKRLNEELDDRVRRILRELEKENEDSKREVDEIAKRIKDLLREIKLPEDVLRELERLLKEIEDLVRELNKTNKKIVDKARKDVKDVHRTNERLLREIERVVREKLK

SEQ ID NO: 16178 - protein, 179 aa, Artificial Sequence; identical to SEQ ID NO: 16177
  Synthetic sequence.

SEQ ID NO: 16179 - protein, 179 aa, Artificial Sequence
  Synthetic sequence.
SEAEELLRRLEKIIEDLERNARALLEKLKEEIRRLDKNLRDLLRRIEKIMRDLTRSDVDRDELRKEVDRLRKEIKKYLDDHREEVRKIVEEIKKELDDHRRRSKEIVDRIKRLLDEINLDEEVLKEIKRVLEEAEKVSEDLLREIKEVLDRAEELSRRLLKTLEDLLRDIERSVKERED

SEQ ID NO: 16180 - protein, 179 aa, Artificial Sequence; identical to SEQ ID NO: 16179
  Synthetic sequence.

SEQ ID NO: 16181 - protein, 174 aa, Artificial Sequence
  Synthetic sequence.
SSKEKVEELVKEIEEEDRRVLEDTRRLLEEIMRRDEDVLRKTDERIKEIEKELRDRVRDEELLRELLRELKEVLRRHREESKRSLEKLKKVMEDHDDESRRTLEELKEALRELKRDKDSKEAEDRLRDLVRRSREIAKRSRDHLRDLLRESEERVRASLEHVERLVKKLRKDAN

SEQ ID NO: 16182 - protein, 174 aa, Artificial Sequence; identical to SEQ ID NO: 16181
  Synthetic sequence.

SEQ ID NO: 16183 - protein, 178 aa, Artificial Sequence
  Synthetic sequence.
SEAEDLLRRLEEEIRRIKKRHKEVLDELRKLIKEVEDRHKELLDRLREEIRELEERDVSREDLKRLVEELRERVKRMNRESEKLVRDLEERAKELHRESEELVTRLERVIEDLERRIKGDRVKEELRRIVKEVRDEIRKANEKIKRLLDEVRERSKDMNRRLKEIVDRVTESLRRKAE

SEQ ID NO: 16184 - protein, 178 aa, Artificial Sequence; identical to SEQ ID NO: 16183
  Synthetic sequence.

SEQ ID NO: 16185 - protein, 180 aa, Artificial Sequence
  Synthetic sequence.
SEVDEALERIKRLIEDLERHVREWLKELREIIEDLRERVRKLLEDLERRIKELEEKARRTGPDRELEELLERLRRKIEEDIKKLEEDLREIEKRVEETNRRHEKKSRDVKREIDELLKRLRSKAVEDLERLVEELRKLSEEASRRSRKILEELRETVERVIKRLKELLKKLKEVVDELRR

SEQ ID NO: 16186 - protein, 180 aa, Artificial Sequence; identical to SEQ ID NO: 16185
  Synthetic sequence.

SEQ ID NO: 16187 - protein, 180 aa, Artificial Sequence
  Synthetic sequence.
DRAEKVLEDIRKLIEEMRKHAEEWERRAREAVKELRKEVTDWRRRLRKLLEDLEEKVRREGNDERLERLAEELLKEVKKVNEETKRRVKELLDRLRKENEEHDRLSKKLLDEIREKLKSLRSEVVRRLEKLVEDLRKINEDVNRRSRELVETLRDDVRKVNEESKRILEEVKKILDDSKR

SEQ ID NO: 16188 - protein, 180 aa, Artificial Sequence; identical to SEQ ID NO: 16187
  Synthetic sequence.

SEQ ID NO: 16189 - protein, 181 aa, Artificial Sequence
  Synthetic sequence.
DLRRELRRVLEESKKHVKELVRELDEDLTRWERRVEELVKRLRDVLRKLEKEVDELEKKPTREEELREAVERLRRVIRELEERNKRTLDEADKRVKDLKRKLRKVVEDHRRRIKELEDRVEGDRVKEELRELVRESDKIAEEIIEKLDRDVKKVKKDHERIDEELKRKLKEVEERVERIRT

SEQ ID NO: 16190 - protein, 181 aa, Artificial Sequence; identical to SEQ ID NO: 16189
  Synthetic sequence.

SEQ ID NO: 16191 - protein, 184 aa, Artificial Sequence
  Synthetic sequence.
SEVEETLREIKEDIKRSKKEWDDLLKTIKELIEDSKRKWDKLLRDVEELIRELLERLRRDGPTEEIDRTVKKIIDDVEELLRKLEKDDRDADERIDRLVKELVERDKRSLDKLKERLDKLKDRVPDRAERDVERIIREAKKLTDKVREDVERLREEWERLVREVKERIKRLLEDLRRLVEETRR

SEQ ID NO: 16192 - protein, 184 aa, Artificial Sequence; identical to SEQ ID NO: 16191
  Synthetic sequence.

SEQ ID NO: 16193 - protein, 184 aa, Artificial Sequence
  Synthetic sequence.
DEAERLLEEAERIIEKSREEWERLLERIKRLIETLRKRYEDDLRESEKRIEELLRKARRDGPTEELRREVEKINRDNKESLERWNREVEEILRELKELVERLEERDRRLIEELKRRLERLRERVSDRVAREVERILRELKKLTDDMKKRAKELIDELKRLSEEMHRRIEKSNEDLKRLVDDVDR

SEQ ID NO: 16194 - protein, 184 aa, Artificial Sequence; identical to SEQ ID NO: 16193
  Synthetic sequence.

SEQ ID NO: 16195 - protein, 185 aa, Artificial Sequence
  Synthetic sequence.
DEAEDILRRIRELIERSKRKWDELLREIKKLIEESRREWEELLRRIREIIERLKRLAERDVDDKDRLKEEVKRIKEELKREVDRLEERNRELLERLKKEVEKLKREDDEIVKELEELLTRAKDRVDERVKEEMKRLIEDLKRVSEEVKRELDKLIEELKEVSERASKRLKELIDDLDRLVKEVEK

SEQ ID NO: 16196 - protein, 185 aa, Artificial Sequence; identical to SEQ ID NO: 16195
  Synthetic sequence.

SEQ ID NO: 16197 - protein, 178 aa, Artificial Sequence
  Synthetic sequence.
SEDEKAIEELKKEIERLRRLLEELRKHVRRLIEEIKRLVEESKRHVEELIREIDDLRRRDQREEEVKRSVEKIKEDLERHERDVKRRLDEIREALKRHEEDTKRVDDELRERIERLDRRLKGRKEVTDIIRELKEVLDEIKRTSEELLRTIEEIVRDAERKNRELLKELKKVLDEVEK

SEQ ID NO: 16198 - protein, 178 aa, Artificial Sequence; identical to SEQ ID NO: 16197
  Synthetic sequence.

SEQ ID NO: 16199 - protein, 178 aa, Artificial Sequence
  Synthetic sequence.
DEDEELIKRLRDRIREIRKLVEDSARNVKRLIDEDERLARRSLRHLEETLKEIERKAREDQSEDTVREAVERIKRDLERHRRESKRLLETSDKLLRDHEEEVKKLLERIKRVIEDLDRKLRGRDEVREVLKEIRELVKELKERNDELLTRWKESIKRVEEEDERILREIERRVEEVER

SEQ ID NO: 16200 - protein, 178 aa, Artificial Sequence; identical to SEQ ID NO: 16199
  Synthetic sequence.

SEQ ID NO: 16201 - protein, 177 aa, Artificial Sequence
  Synthetic sequence.
RAEEEVKRLLKEDNETLKRIEDDVRRLLRKNNESIREAEKTNRELVKRVEDIIRRARERGVDESVLADLRRVLKELKEESDKVLDELRKLNEKLREEVRELKRELDEENKELDREIKEGQPLEELLERIKELNERTKKKVADLRRVAKRLDEETERKVRETERRWRDVLDKVRKKVK

SEQ ID NO: 16202 - protein, 177 aa, Artificial Sequence; identical to SEQ ID NO: 16201
  Synthetic sequence.

SEQ ID NO: 16203 - protein, 178 aa, Artificial Sequence
  Synthetic sequence.
REVEEVLERLKELLREHEKHAKEVEDRLRELIRENKEHAREMLERLEKILDELKKIRDSEEVLRETLKRIDEEVRRLIRHHEELSKEVLKEIEDIIRHHRKESRRSEEEVREIEKRITDEEALRELRRLLDEIRRVNRKVEERIKEVLKKIDEDNKEVVRRLEEALEKIREVIERTAT

SEQ ID NO: 16204 - protein, 178 aa, Artificial Sequence; identical to SEQ ID NO: 16203
  Synthetic sequence.

SEQ ID NO: 16205 - protein, 176 aa, Artificial Sequence
  Synthetic sequence.
KAKEDVKRALDEWKEVNDRVNEELKKAIDTWREVNRKVKEDVDRLVKEIEELIRRVRENGADERLLEKLKRELEKLTEDVKRRLKEDNDRLEKLLTDLKRESDKDREELKELARRLDELRREDVKRELKRVIEETRERAKRLLEDLRRLIEETKKLAEELLARAKEIIDRIREAAR

SEQ ID NO: 16206 - protein, 176 aa, Artificial Sequence; identical to SEQ ID NO: 16205
  Synthetic sequence.

SEQ ID NO: 16207 - protein, 182 aa, Artificial Sequence
  Synthetic sequence.
RAEEELDRLSREVEKVSKKAREDLEEMRKALEDVSRRVKEKLRRILEEIKEAIKDVKRRTNGSSKKLKEIEDLLRKLEEDLRDLERRVEESHERLEREVRRLLKEVDESSKRLREEVKRLRDEPPSRELIREVEKLIEDHRRRLEEIVETVRRLVDEHRRRLERIVREAAKLVKDIKRELEK

SEQ ID NO: 16208 - protein, 182 aa, Artificial Sequence; identical to SEQ ID NO: 16207
  Synthetic sequence.

SEQ ID NO: 16209 - protein, 182 aa, Artificial Sequence
  Synthetic sequence.
SVKEKLRRISKELEKASRDDERENRRILKEARDVIREAADKIRRIEEELRKIIDRVRKETNGSEDELRRIEELMRRADTELRKLEKTIEDLLREVEERVKESLERSRRSSERLRELVRDLDEKPPSEEIIEEVKRLVDEHKKRLDENVKRLKELVDRLRETLERLVDRLRKLVETLKRESDR

SEQ ID NO: 16210 - protein, 182 aa, Artificial Sequence; identical to SEQ ID NO: 16209
  Synthetic sequence.

SEQ ID NO: 16211 - protein, 182 aa, Artificial Sequence
  Synthetic sequence.
KVEEDLKRIKKEIKDAADEDREKNREIMKRLNDVTREVEERLRKILEDLERLVRRVKEEVNGRKEELDRIEELLRRAREELEKLEEDVRRDNKELRERVRESLERSDELVRRLEDELRRLEEKPPSEELIKRVKELVREAKERLKDNVRRLEELVKEWKRKLKEIVDRVRELVKDLERRLKE

SEQ ID NO: 16212 - protein, 182 aa, Artificial Sequence; identical to SEQ ID NO: 16211
  Synthetic sequence.

SEQ ID NO: 16213 - protein, 175 aa, Artificial Sequence
  Synthetic sequence.
SEKEKIVKDVEELIREAEELVRRLLKRLKELNDESEKTARDLVRKNEETLKELKDVVDRRVKDKDTLRKRVKELHDESRDDLRKLDELNRRVERELEKLVEELKRTIEELKKRLEEAPRARELDELIKKLDEVLRRAEKEAEELIRDHRRISREVKERIKDLNRRIERILREAEK

SEQ ID NO: 16214 - protein, 175 aa, Artificial Sequence; identical to SEQ ID NO: 16213
  Synthetic sequence.

SEQ ID NO: 16215 - protein, 181 aa, Artificial Sequence
  Synthetic sequence.
SLEEIVKRVEEDIRRIIEELRRRIEEADRKIAEIIDRLRKTVEKVNKEIEDLIRELKKKEGDDRDVERKLRELEELLRRHTERVRDVERRLKKLLEDHHREVREILKRAEKLLRDLSEELRTITDDKRVRELVEEVKKKLRDLVEEVRESVKRLEDTLRRVEEEIRTTARELLRRLREELE

SEQ ID NO: 16216 - protein, 181 aa, Artificial Sequence; identical to SEQ ID NO: 16215
  Synthetic sequence.

SEQ ID NO: 16217 - protein, 181 aa, Artificial Sequence
  Synthetic sequence.
SLEEEVRETVKRLRKEVEDWLREVEKVLEDLLRELKKSIEETKKVAKELEDKLRDVKRRNVDEDEVRRLKEEAKRTIEELEKKNKELERKIEKIVRELREKDKELDKRVEDVLDELRKRLTDERIRRTLEKAREEVKRLSAETKRLIEEVKRRLDELLKRDNDIIDDARRRVKKVLDEIET

SEQ ID NO: 16218 - protein, 181 aa, Artificial Sequence; identical to SEQ ID NO: 16217
  Synthetic sequence.

SEQ ID NO: 16219 - protein, 181 aa, Artificial Sequence
  Synthetic sequence.
DLEEELRKVVEDLERKLRESIRETEEVMRRLEESVEESIRKTEEVVKRLREKLEDVKRRNVDEEVVKKLEREVKEVIDRLREENRRHHETVKEIIKELEEKNRRLKKEAEDVIRELEKRLKSDEIRDTVRKAKEDVERLLEEDNRRIKEVLDRVAKLNKRDNETIERAEEEARKVLREIEK

SEQ ID NO: 16220 - protein, 181 aa, Artificial Sequence; identical to SEQ ID NO: 16219
  Synthetic sequence.

SEQ ID NO: 16221 - protein, 181 aa, Artificial Sequence
  Synthetic sequence.
DIEEEIREEVERLRRTLKELADRIKKLVDELREKLRRWLEEVEEVLRRLIEDLRRVKEENVDEKVVDDLEKKVRKLVEELKEKDKRLNEEAKEVIRKVEEEIKRHHDEVKKRLDELRKRVKTEELEKRVREAEEEVRRVNKKLKDDLDKAREDLKEFSDRTRRMIKAVERDVKRVLDEIRR

SEQ ID NO: 16222 - protein, 181 aa, Artificial Sequence; identical to SEQ ID NO: 16221
  Synthetic sequence.

SEQ ID NO: 16223 - protein, 177 aa, Artificial Sequence
  Synthetic sequence.
SVEETIKRILEEVEELIREVKERNERIERRAERLIEEVKRSNDEIKKEVRTAIEKVIRKREDDRVRKVLRELEKAVEDHDREVEKVVEEVRRLSKKHLDEVERALEELRRRLKEIKDRPVDKEKVDKLVKDLRRVIEELRKSLEDLERRLDDILRRLKESSDELVRELRRLLKEMEK

SEQ ID NO: 16224 - protein, 177 aa, Artificial Sequence; identical to SEQ ID NO: 16223
  Synthetic sequence.

SEQ ID NO: 16225 - protein, 177 aa, Artificial Sequence
  Synthetic sequence.
SVEEALDEIEKKVEEMIREVKETNDRVRRKVKELSEKSKTENERVVREARELIREVEREREEEEVRRILEEVERLSKKHLDENRRLVEEIDKEVEDHNREVERVLEEARRRLDDIKKKPVDKKDVDDLDRDLEKKLRDLKDSSRKLVKRVEDLVRESEDTVRKLIERLERLIRETKR

SEQ ID NO: 16226 - protein, 177 aa, Artificial Sequence; identical to SEQ ID NO: 16225
  Synthetic sequence.

SEQ ID NO: 16227 - protein, 177 aa, Artificial Sequence
  Synthetic sequence.
KVEEELDKILKEVEDLVRRDEEEIKRILEEVKELIRKVKETNDKVEREMRKLVEEVKKREEREEVKKVEREAEKKVRDHKREVKRVLEELARELKELLDETRRLLKDIRREVEDIKRKPVDEDSVRELVKRLRERAEESKKRTKDLEDKIRTKIEELERSSKELTDELRTLIREAER

SEQ ID NO: 16228 - protein, 177 aa, Artificial Sequence; identical to SEQ ID NO: 16227
  Synthetic sequence.

SEQ ID NO: 16229 - protein, 184 aa, Artificial Sequence
  Synthetic sequence.
SVEEAIKEILRELEKVNEDSKRLSDRNLKELEKALRDAKKSVEEILRELEKALDEVRKNGLSEELERRVREVLERIKEKLDRLRKTIKEALDRSRKKTEELSRENERLLRDIRRRVEEVRKDDSREDVERILKEIKDEVDRVRKENERVNRESEDESRKLVEELKKVLRRLKEEVRRIVEELRT

SEQ ID NO: 16230 - protein, 184 aa, Artificial Sequence; identical to SEQ ID NO: 16229
  Synthetic sequence.

SEQ ID NO: 16231 - protein, 182 aa, Artificial Sequence
  Synthetic sequence.
EVEERLEEILRRLERAVEDWKRKNEKILKELRDVVRESKKRTREIEKKIEDAARDVLREVNTDKKKLEEIKRLLEEVRKEIEDLLRTNEKLLEDLERLSKDDERRVRELLKEVRERVDKLKKDKVSKEVVKELEKDVRRIVEELKDSLRRLKEKVEEVARTVKKLNEELDDSVREIVERLRK

SEQ ID NO: 16232 - protein, 182 aa, Artificial Sequence; identical to SEQ ID NO: 16231
  Synthetic sequence.

SEQ ID NO: 16233 - protein, 182 aa, Artificial Sequence
  Synthetic sequence.
NVEEELDRIRREAEKVVKESRELTREILERAREAVEKSEEDTRRILERLERVVKRVKKDVNDREEKLKRIEDIVRRVRESVKKLEEDNKKILRELEESIRRWLEAIEKILEDLRREIKKLKDDRVSEEVLDELRKKVKKLVDELRTEDRRLEEEVKKIVRDAEKRNKELEDEIRRLAEELEK

SEQ ID NO: 16234 - protein, 182 aa, Artificial Sequence; identical to SEQ ID NO: 16233
  Synthetic sequence.

SEQ ID NO: 16235 - protein, 176 aa, Artificial Sequence
  Synthetic sequence.
SETETAVKKLKKLVDDLKREVERLVERLRELVRENSEKSRELVKRSDDLVRELLEKVKRRDLREDELRKEAEDLRETDDDLLRDDERHVKELEERMREELKRLREEARKLEEDIRKGEVDSELVKTVEEELKKVLEEVDRLVRKILEDLRRSLEESKRLSEESKKKLEDVLDRARR

SEQ ID NO: 16236 - protein, 176 aa, Artificial Sequence; identical to SEQ ID NO: 16235
  Synthetic sequence.

SEQ ID NO: 16237 - protein, 176 aa, Artificial Sequence
  Synthetic sequence.
RELEEAVKKLKKKVEDNTRTSRKLVTDLEREVEELKKEVEEVVRKSKELVRELKKKVDRRDLDKRELRKEVKELEERDERLLEKLERAVEELERKIRELLERDRRHVDKLRKDIEDGEVDSELVERVKEELKRSLEESDKLVEDVRRKLKEVLDDIRRLSEESKRELRDVLREADK

SEQ ID NO: 16238 - protein, 176 aa, Artificial Sequence; identical to SEQ ID NO: 16237
  Synthetic sequence.

SEQ ID NO: 16239 - protein, 182 aa, Artificial Sequence
  Synthetic sequence.
ELEEIVKDARRRIKELIDEARRTSEEVVERIKELLKRAEEISREARKRLTELLEELKKTVKDEDTLRRLLTELERLIREHDRLSREVLERLKKLIEDHKRKSDELLERLKRLLEELEDMVRRRIDKKEELRKIVEDILRTIKKLLEELRDDARRLLEEIKRLLEELERHVRKLLKEIDERIK

SEQ ID NO: 16240 - protein, 182 aa, Artificial Sequence; identical to SEQ ID NO: 16239
  Synthetic sequence.

SEQ ID NO: 16241 - protein, 182 aa, Artificial Sequence
  Synthetic sequence.
ELEEIARKAKEDIERLVEEARRISEEVKRELTELVERLRRISEEVRKRIEDLADELRKKVEDKDTLKRLEEEIRELAERHERKSRELEKRLKELVDTHRKKSEDLLRELKRLVEELERVLRRDIKDKKTLKEKVEDILRRIRELLRELRENARELVKEIERLIRELEKDAKRILKKIEDAIR

SEQ ID NO: 16242 - protein, 182 aa, Artificial Sequence; identical to SEQ ID NO: 16241
  Synthetic sequence.

SEQ ID NO: 16243 - protein, 181 aa, Artificial Sequence
  Synthetic sequence.
SVEELVKEIEKRLDELVREIEKTNKKVEDDIRKMLEDIKRVHDKSNEDLEKLVKELREKLKDEKRLEEITRRVEKMKRDNNEVLKELEERVRRILEHHRRLSDRVREEAEDIRRRLRELLERGLDLKDIEKVARDILRRVKKILEENRKHAEKARRELEKLLRESKRLVDELLRRAEEEKR

SEQ ID NO: 16244 - protein, 181 aa, Artificial Sequence; identical to SEQ ID NO: 16243
  Synthetic sequence.

SEQ ID NO: 16245 - protein, 175 aa, Artificial Sequence
  Synthetic sequence.
SREDRARELVKRILDEHKKILEDVEELAKELLRRHEELLKTLRELMRRIEEDLKRLEDEDVDREKAKRRVDELRKTLKKVLDELHKESRRLLKTLEEVLRRIDKRSREIKEELEKGEIDSEILKTVTRLSEELNRRIREVVRKVEEDLEDLNRRLKKIADEIEERIKEILRRIEK

SEQ ID NO: 16246 - protein, 175 aa, Artificial Sequence; identical to SEQ ID NO: 16245
  Synthetic sequence.

SEQ ID NO: 16247 - protein, 177 aa, Artificial Sequence
  Synthetic sequence.
SIEDVVRRIREEDRRLHEEIRKVVDEIRKRLEDALRSHEERVREVLERIKKLLEELKRRGTDKRVEKEVEDIERRLKEVLEESRDIVRRLEEELKRTLDKIRRENEKSEDELKKLTDERLDEKDLRKKLREIEEKNERLLRELERLLEEIRRTLEDLNRKLDEEIKKLERRLKERDR

SEQ ID NO: 16248 - protein, 177 aa, Artificial Sequence; identical to SEQ ID NO: 16247
  Synthetic sequence.

SEQ ID NO: 16249 - protein, 184 aa, Artificial Sequence
  Synthetic sequence.
SLKELIDEVERRLREVNRRARELVEEVKERLRRVNEESRELLREIEERLEDVLRELEEGDLREEELRRLAEDIKRVKDEVKKLFDDHRDTNRRIEDDLRKKVEEHHERNRRIIEELKRLLDRGNGEEEIKELVKRARELVKRSKEHVDELMETAKRLVDESRKHAEELFRELKKLIEELREKIR

SEQ ID NO: 16250 - protein, 184 aa, Artificial Sequence; identical to SEQ ID NO: 16249
  Synthetic sequence.

SEQ ID NO: 16251 - protein, 176 aa, Artificial Sequence
  Synthetic sequence.
SEVEKLVEDLRREVKRHSEKVERLVKELRDDLERWKERLEEIMRRLEKLVRDLEELLRRGDLSEESIKRLIDDAERRLRELLKRIREEIEEHRKKSEDLRREAKETVDELRERIERMNLDEELVREVKERLERSRERVDKLLRDNHKRLKEVLDEAKKLIDRVRKLLRRVLEEAKK

SEQ ID NO: 16252 - protein, 176 aa, Artificial Sequence; identical to SEQ ID NO: 16251
  Synthetic sequence.

SEQ ID NO: 16253 - protein, 176 aa, Artificial Sequence
  Synthetic sequence.
SDVERLITELADSVRDHSRDVRRVVEELEKLLRDWERDIEDIVEKLDRLVRTLEELLRRGELSEDLIREVVKDIDRKLKKVAREIEKKIRDHERKSRKLLEDVEKTSRENREEIKKANAREDLVRTVEKLNTESLDEVRKLVKKNHEDLKRVLDKAKKLIEEVRKKLEEVLDEARK

SEQ ID NO: 16254 - protein, 176 aa, Artificial Sequence; identical to SEQ ID NO: 16253
  Synthetic sequence.

SEQ ID NO: 16255 - protein, 178 aa, Artificial Sequence
  Synthetic sequence.
TLEEILKEVAERVKKANEDSRRILEKVKRDVETVNRENEKILKKAAEDVKRVLDEARKRNVDEKLLRELERLLEELKKEVEKLNRRNEKLLRDLARRVRELDERNKELLDRLADLVRRGDLSEKELREMIEKLKRDNERMLRELERRIEELKRDNDRVNEESKRLVDELKRDAEEKLK

SEQ ID NO: 16256 - protein, 178 aa, Artificial Sequence; identical to SEQ ID NO: 16255
  Synthetic sequence.

SEQ ID NO: 16257 - protein, 178 aa, Artificial Sequence
  Synthetic sequence.
TLEEILREVEKRVKEANERNRKISEELADLVRRVNEENKKILEDVAEEVRRALERARRRNVDERVLKKIRDLLRKLAEEVKKLNERNKEELKRLEKRDKELNDRNKELLKRLKETVERGDLSEEELRRMIEELEKRNRDVDRESKKLAEELEKTNRDVNRKSRELVRRLRRKLEEELR

SEQ ID NO: 16258 - protein, 178 aa, Artificial Sequence; identical to SEQ ID NO: 16257
  Synthetic sequence.

SEQ ID NO: 16259 - protein, 178 aa, Artificial Sequence
  Synthetic sequence.
ELEDILREVRKRVEDVNRRNKEILERVAEEVRRLNEENKRILEEARKRVEKVLEDLKRRNVDERLLRELEELLERLARRVEELNRENKRDLDRLRETVKRLNDENRELLRRLAETVKRGDLSEEELRRAIKELKDRNEDVDRRTKELIKRLEDKNRELNRESRERVEELKKRAEELAR

SEQ ID NO: 16260 - protein, 178 aa, Artificial Sequence; identical to SEQ ID NO: 16259
  Synthetic sequence.

SEQ ID NO: 16261 - protein, 178 aa, Artificial Sequence
  Synthetic sequence.
DLEEILKDVKRRVEEANRRNEKILEEAKEKVDRVNRSNEKILEEVKETVKEVLRRAREENVDDRVLEDLKRLLRELEERVKELNRRNRELLKELADRVKKLNDDNRKLLEELADTVRRGDLSEEELKEMIRRLEETNRRVDKETRKLIEELERRNREVDRESERLIRELKKKAKDDLD

SEQ ID NO: 16262 - protein, 178 aa, Artificial Sequence; identical to SEQ ID NO: 16261
  Synthetic sequence.

SEQ ID NO: 16263 - protein, 178 aa, Artificial Sequence
  Synthetic sequence.
TLEDILREIAKVVKEANKRNKRILEKVARDVEEVNKENKKILDEVKRDVERVLREAEKRNVPEDVLRKLAELLKRLEDRVRELNEETKRLLEELADRVRELNERSKDLLRRLADIVRRGDLSEDELRRMLEELERTLREVDRESDELVKKLKRDAERVNEETRRLIKELKEIADRLLD

SEQ ID NO: 16264 - protein, 178 aa, Artificial Sequence; identical to SEQ ID NO: 16263
  Synthetic sequence.

SEQ ID NO: 16265 - protein, 184 aa, Artificial Sequence
  Synthetic sequence.
SIEELVREIEKTNEDMRREIERLSDENRRRLDKALEDIERRAREIKEKLERVMKRLREKGVSEEVEERLRRLEKELKEVLDRLREIIKELKDDNERLTKRIRDRSRETRERLKRFLDEARRDKDEKRVLDELRKLLEDSKDELRRLLEELRRHIKETDDTVRELLDRIRKIREELDDEVRRLEK

SEQ ID NO: 16266 - protein, 184 aa, Artificial Sequence; identical to SEQ ID NO: 16265
  Synthetic sequence.

SEQ ID NO: 16267 - protein, 174 aa, Artificial Sequence
  Synthetic sequence.
KEEEDARRALKRVEEEVRRNKEEMRKLLEDNEKRIRENKKRAEDSSRKVKKRIDELRRDGKRGEEVKRDLDRLRDEHRRETKKSEDELKRNNERLEEETKRSKEDIKRIKEDLDRRGLPEEVLREIEKILRDLERDHRRVLEEIRKRNDELRETHERVLRENEKILEKVERELR

SEQ ID NO: 16268 - protein, 174 aa, Artificial Sequence; identical to SEQ ID NO: 16267
  Synthetic sequence.

SEQ ID NO: 16269 - protein, 181 aa, Artificial Sequence
  Synthetic sequence.
SVDDKVRRRIREIKEELERVLTRSERESDDIKRELEEVLKRSEERTKKIKDDAERGGVSDELREKLERETKRAEDKHRKIREDLKRDEDRNRKRHKEIRDEARKDTERMKKKLKDLKDDKDDERVMRDLERELEKLERKVREIKRELEEHNARLREKVRRIDEDLKRDNKELEDTIREDTR

SEQ ID NO: 16270 - protein, 181 aa, Artificial Sequence; identical to SEQ ID NO: 16269
  Synthetic sequence.

SEQ ID NO: 16271 - protein, 182 aa, Artificial Sequence
  Synthetic sequence.
KEEEELEERIRRLEKLVEDYKRELDRSIKELEDEVDRARRELEKSIEEMKKKVKKAEDDGPVDEELKRRLEEDNERHKRDLDRRKEELEKKLRELRKRNEELRRRLEEELKRVEEELKEANLPDRVIRKIKKLLDEVRERLERINRTHRELLKEVEERLKKILKDITDANRRIEERLEEITR

SEQ ID NO: 16272 - protein, 182 aa, Artificial Sequence; identical to SEQ ID NO: 16271
  Synthetic sequence.

SEQ ID NO: 16273 - protein, 182 aa, Artificial Sequence
  Synthetic sequence.
SLKEELKRINDENKEELDRLREELKKLLKEVEEELRRAAEELERINRRIKEELDKVADRVDDEKIKRIEKRLKEEHDRHREELKRIKRELDELKKELEKVLKDIEKKNREREKELRDREETTTEEVAERLLEELREDVKRTKEKMKEMLDRVKKKIDDIKRKLEKLLRDNERRIEELKRDAD

SEQ ID NO: 16274 - protein, 182 aa, Artificial Sequence; identical to SEQ ID NO: 16273
  Synthetic sequence.

SEQ ID NO: 16275 - protein, 176 aa, Artificial Sequence
  Synthetic sequence.
SVEEKLKKALEESKRKSKRIKDDDERANREVKKRIEDIVRRLEEVLRKVLKDVTKDIKDKRELLKEIEDRIREIEERIRRLTEEMKRTHEENEKRTREDEKRNDEEHKRIEKKLAETGASEDEVTRDVKRLEDHNTRLEKKVKESVERLKEKLEELRKRVEKIERDLEKLLEDVRT

SEQ ID NO: 16276 - protein, 176 aa, Artificial Sequence; identical to SEQ ID NO: 16275
  Synthetic sequence.

SEQ ID NO: 16277 - protein, 179 aa, Artificial Sequence
  Synthetic sequence.
KAEDVLRRVKEEHERIRREIKRVIDDVRRKHKEILDRLREEIKRVEELLRKILEDVERDGKRDDRLRRLAEELKKRLDDVKRDVEEKEKENRRRLEKEEKRLEENFKRNEERLRRIEEEGPVREEVVKELEDNVKRNEEDAKRTVEKLRKNLEDNRREVEKIVRDLRRLVEKAREDVKR

SEQ ID NO: 16278 - protein, 179 aa, Artificial Sequence; identical to SEQ ID NO: 16277
  Synthetic sequence.

SEQ ID NO: 16279 - protein, 173 aa, Artificial Sequence
  Synthetic sequence.
DLKEILDEARKLIEDLRKKAEEILEESKRLLDDLKRKADEILTRYDELTKRLSTKVPRTRELEELERRSKEELDKLKRELEEEVERWKEENEKIRKRMEDLVRDLRRKLEEARRDQRLEELKKRLEELIREVEKDLRRIKKESEDRVEEIERRLRRIAEELDKDVRRVEEEAK

SEQ ID NO: 16280 - protein, 173 aa, Artificial Sequence; identical to SEQ ID NO: 16279
  Synthetic sequence.

SEQ ID NO: 16281 - protein, 181 aa, Artificial Sequence
  Synthetic sequence.
SKEETVARRVDEIARELEEKNKKWEDDSRKAVDELRRKLEEWEKRSRDLREKVKDLLRKLKDQDDKERLKEEVRRVLEEWRRELKKLREEVKRTAEKWRRELKKLEDDSRRKLEEVKRELEELDVSEELKKKVEKLLEDHRKKSEELLRKDEKLIRDMEREVERLLREDEKVIEDVERATK

SEQ ID NO: 16282 - protein, 181 aa, Artificial Sequence; identical to SEQ ID NO: 16281
  Synthetic sequence.

SEQ ID NO: 16283 - protein, 181 aa, Artificial Sequence
  Synthetic sequence.
SKEETVERDVERIVRRLRELNKEWKKRSEEVKREVDESDKRTAEAVKKLVRDLEETLKDLKDRDDRETAKEEVDRRIKKIEDDLRRLLDEHRKLLEEWRERLKKLLDDSRRELEKVKEELERLDVSEEIKKKLEKLLKEHEDLSRKLLKEDEEEIDRHRRKVREWAEDLRKKLEEAERAST

SEQ ID NO: 16284 - protein, 181 aa, Artificial Sequence; identical to SEQ ID NO: 16283
  Synthetic sequence.

SEQ ID NO: 16285 - protein, 177 aa, Artificial Sequence
  Synthetic sequence.
SEKERAEEELKRIEDELREAIKRSEDRLRRIEKELRDREKRSEEELRRLEEELRRLAEERISEETVEKVARDIDEENKKHEDEVRKTEEKVKTENERHKKEVEDIARKVKRSIEELKRRNGDRKIIEDLKRLLREFERAVEESNERLRRLLEEFKEKVKESNKRSRELLRRMEEEVR

SEQ ID NO: 16286 - protein, 177 aa, Artificial Sequence; identical to SEQ ID NO: 16285
  Synthetic sequence.

SEQ ID NO: 16287 - protein, 175 aa, Artificial Sequence
  Synthetic sequence.
DDLERLEKEAREILERHKRALDELEKRLRRVLEKHEEDLRRLEETLRELLKKVRKDGLPEEVLRDVKRKLDKLKEDLKRSLDRLREELDRLRKELERSLRELKRDVERVKEELERNEKRREELEKEVRKLEKKSRDDIRRLEKELRELEKRSRDNIRELEKRVRRVARELDKTAK

SEQ ID NO: 16288 - protein, 175 aa, Artificial Sequence; identical to SEQ ID NO: 16287
  Synthetic sequence.

SEQ ID NO: 16289 - protein, 177 aa, Artificial Sequence
  Synthetic sequence.
DEKEEAEKALREIKKRIEDNVREVRRLNRELREKLRKLIEDYDRLLKELEKRVEDIVRKGRVDEKVKEDADRELEKNREELDRRRKEVDDRLRKHNRELEESMKEARRRLEEVDRRLDELGERDLRREEKKLRDELRDLHREHRKSIEDLDREIKKMEDELRRSIEENRKRVEELEK

SEQ ID NO: 16290 - protein, 177 aa, Artificial Sequence; identical to SEQ ID NO: 16289
  Synthetic sequence.

SEQ ID NO: 16291 - protein, 175 aa, Artificial Sequence
  Synthetic sequence.
REKERVKRVVRRVEEELKRNLEEVEEESRRDLRRLEENLERVEEAVRRILKRLDDSRIDSEELKRLKEEVREKLRRAKKDHDEYLKRNEEDLRRVRRKHEEIRERIKKKLRDVERENKPREELEKLIEKIERELKKTHDDSRREIERLRRETKKLHEKSEELIRELEKRLRDAER

SEQ ID NO: 16292 - protein, 175 aa, Artificial Sequence; identical to SEQ ID NO: 16291
  Synthetic sequence.

SEQ ID NO: 16293 - protein, 180 aa, Artificial Sequence
  Synthetic sequence.
SEVEEILDRIRRELERLAREARKTVERNKKELDRIREEVDRSLRRNKEELDRLRREKKDVDEEFLRRIEKELEDNKRELEREDRRLEEELKRNHEELEKEDRKIRKEIKDLEDEVEKKVRGEDARRAARELLKRLEDLLREHHDRLRKSDEEIRKLIEDHHRALEESNREIKELIDRMAK

SEQ ID NO: 16294 - protein, 180 aa, Artificial Sequence; identical to SEQ ID NO: 16293
  Synthetic sequence.

SEQ ID NO: 16295 - protein, 185 aa, Artificial Sequence
  Synthetic sequence.
DEAEKLIKDIEDKDEELKEKARELKEKLEERDERTKKLIEELKREADRTLEELKKKVEKAKTSDEKVLEELVREVEELLKRVKDLLDELVETVKRLNEESEEELRRLEERSRKVIEDLERRLSKLRSEVVKRVRDLLKRHEDLTREIKKEVKKMNEKNRELVRRVEETLKKLLEDLKRLLDESRK

SEQ ID NO: 16296 - protein, 185 aa, Artificial Sequence; identical to SEQ ID NO: 16295
  Synthetic sequence.

SEQ ID NO: 16297 - protein, 175 aa, Artificial Sequence
  Synthetic sequence.
SEEEEKVKDIERKLRKHNKEVKDTERENEKRLRELRRTVEEDRKDAERELERIKRVVERGEVDEETLKKILKDLRRKLEELRKRIEELKRRLERHHEEVERRLEESLRRLEDTLRKLEKSEELDRLEKELRESIRRAEELLKDSKRRADELIERIKDVLRKVKEKIEKLIEDTRR

SEQ ID NO: 16298 - protein, 175 aa, Artificial Sequence; identical to SEQ ID NO: 16297
  Synthetic sequence.

SEQ ID NO: 16299 - protein, 173 aa, Artificial Sequence
  Synthetic sequence.
SEKEVVEELKKTVDDLKRKSEEAIKKAKEAVDKIRRDSERAIRKNEDTLRKIEEEIKRNRSEEALKKIEDTLRELSKEHKEIIERIKKALDDLKRESEEIVKRLEDALRELAKSETDEDILREIAKRIKDLIEDHKRASKEIERDIRKILEDHKRAAEKIRRDLRRLLEDVER

SEQ ID NO: 16300 - protein, 173 aa, Artificial Sequence; identical to SEQ ID NO: 16299
  Synthetic sequence.

SEQ ID NO: 16301 - protein, 179 aa, Artificial Sequence
  Synthetic sequence.
SLEKMVTDIIRKLEEIARRHKTRSDEIVRRLEEIIKTHEKRSKELMDDLKRLVDEVRKKKDKAEEVKEKLRESLKRLAEESRKVVEDLKRTIERIKKESTETLKRIKDVVRRIREEARDKEPKEEDIRRLDEEVKDLERRSREEEERLEREVRELEKRSEETIRRVEKKVRDLADELRK

SEQ ID NO: 16302 - protein, 179 aa, Artificial Sequence; identical to SEQ ID NO: 16301
  Synthetic sequence.

SEQ ID NO: 16303 - protein, 174 aa, Artificial Sequence
  Synthetic sequence.
SEEDVVKKVRKKLEDVHRDTRREIRRLEEETKKLHDETRKTIETIERRLRDLRDRLTKEPKDKRVEEKVKKIAEDIERILRKLRRDHEDYLRRNEEVLKRLEDKHRKITEELDRGELDSEEVRDVKEKLKRNLEEARKASREDLERLKRNLEKADEDVRRLLEELKRLLDEVRR

SEQ ID NO: 16304 - protein, 174 aa, Artificial Sequence; identical to SEQ ID NO: 16303
  Synthetic sequence.

SEQ ID NO: 16305 - protein, 183 aa, Artificial Sequence
  Synthetic sequence.
SLEEAIEDLRRKLEKLLKDYADLSKEIEDKLRKIHEDSRRLVEKLEEEARRILKEVRERGKDEERVKKEERDIREELKKLEKTIEDSEREVEKEKRDSDEKLKRVEDDARKLLEDLRRSGEGREEEVRKEIEDADKRVKDLKRELERDIDELRKRVEELRRRHEEKIKKVAEDVKRREDEARK

SEQ ID NO: 16306 - protein, 183 aa, Artificial Sequence; identical to SEQ ID NO: 16305
  Synthetic sequence.

SEQ ID NO: 16307 - protein, 175 aa, Artificial Sequence
  Synthetic sequence.
SRLEKIKRELDKKLKDHEDDSRDKVRKLRESLKRHEDKSRKEEEEVKKTLKELEDKLRRDGPDKRVEEESRRHLEEVEKLLKELEDHSRRHREELKKRLDELRDHLRKLLEDLDRTDLEKRLVDDAKRKIKELEEENERLVKEVEDRNRELDERNKRIIDRIRRLNERVKEEAEK

SEQ ID NO: 16308 - protein, 175 aa, Artificial Sequence; identical to SEQ ID NO: 16307
  Synthetic sequence.

SEQ ID NO: 16309 - protein, 179 aa, Artificial Sequence
  Synthetic sequence.
DEVETVIERDKKLLEDWVDRARKVVKRDEDSLRRDEEENRRVVEENSRTVKELKERIRDERLVREVDTLARKLNRDIERTVEESRRLSEESKRLIEEVVKKVEKLSRDSVRILEAVKDGKEEVVKRVEEEVKRLNERADELLKRVEKRAEELNEESRRLSEEVERKVRELNREADERVK

SEQ ID NO: 16310 - protein, 179 aa, Artificial Sequence; identical to SEQ ID NO: 16309
  Synthetic sequence.

SEQ ID NO: 16311 - protein, 179 aa, Artificial Sequence
  Synthetic sequence.
SEVEEVVKRNSDTAKEDMDRNEKVVEDNSKRLREWEKAIEEVEKEVDKAMKDLKRRIRDEELVRRVEKLAKELKEIIKKVLDDIRKLIEELNRKIKDTVRRSKKEIDELNKILEEVRDGREKLVEDVRREVEKLNRESEERSKRVKEEVDDLNRKLEKLLRDVKEEVKKLLEEAERETK

SEQ ID NO: 16312 - protein, 179 aa, Artificial Sequence; identical to SEQ ID NO: 16311
  Synthetic sequence.

SEQ ID NO: 16313 - protein, 178 aa, Artificial Sequence
  Synthetic sequence.
DEVRKVVEDNERSVREIKEELKRVVEEDKELVDRWRERLEKVVKDNERSAKKIKDDVTKEEVKKLVEEVLRTSRKLAEELKKLIEEVHRTSRELIKRVDEEVDKVLEDSRRLAKELKDVDEMLRRIEETIRRLDEELRRLVEEVKRRIDELNREVEKRIREVEERIKEMDKRLREAVK

SEQ ID NO: 16314 - protein, 178 aa, Artificial Sequence; identical to SEQ ID NO: 16313
  Synthetic sequence.

SEQ ID NO: 16315 - protein, 178 aa, Artificial Sequence
  Synthetic sequence.
DEAEKVVEKDRRLIEKWKEDLKELVRRVREKVKEIKKRVADVVKENEDSVRRIEKEVTKEEVKRLVREVLERSRRLIEEVRRLVDEVLKTVEKLAKELVDKAEEVHRESRELIKDLKDVDEMLRRIDRRAERLNEDVARVIDEVAKRVTRLLERLEEKLKKIRDDIKKLDEELEEAAR

SEQ ID NO: 16316 - protein, 178 aa, Artificial Sequence; identical to SEQ ID NO: 16315
  Synthetic sequence.

SEQ ID NO: 16317 - protein, 178 aa, Artificial Sequence
  Synthetic sequence.
DEVRELVKENRRSVKENEEELKRILDEDERLIRDWKKKLEEVVRKVAELVREIEERVTKEEVKKLVREVLKTVKKLIDELRKLADEVHKRSNKLIEDNKRLTDEVLRRSEDLARKVKDSDELLRRVAETVKRMDEDLNRTTEEIADTIRRLNEEVAKRIREVERTVERLIEELEEAVR

SEQ ID NO: 16318 - protein, 178 aa, Artificial Sequence; identical to SEQ ID NO: 16317
  Synthetic sequence.

SEQ ID NO: 16319 - protein, 170 aa, Artificial Sequence
  Synthetic sequence.
DEEEELEKDARRVLEELRRELERVVREAKDINRRVEELIREVRERAKRVDDELRKRPRDDEVMKDVKREVERTIRDIERVLEDIERLSERSERLIKRVLDEVKRVVDDVLRKITNERVLREVERVLRELEREADEVLKEDRELLERWKKTVKDVVKENRDSLDELAKEMK

SEQ ID NO: 16320 - protein, 170 aa, Artificial Sequence; identical to SEQ ID NO: 16319
  Synthetic sequence.

SEQ ID NO: 16321 - protein, 170 aa, Artificial Sequence
  Synthetic sequence.
SEEERLREEAKEVLKRLREDLKRVEEDVERVDKRLRELNEDVARKLEEVLKRLREQPRDKDVADRVRREVEKILRESREVLKKSARDVDETIKKIETVLREIEKKVEEVVRKITNEKVLREVKRALDDLRRRVEEVLRKNEKSLRELEEENRRVLKKVEDLLEDIIRRLK

SEQ ID NO: 16322 - protein, 170 aa, Artificial Sequence; identical to SEQ ID NO: 16321
  Synthetic sequence.

SEQ ID NO: 16323 - protein, 175 aa, Artificial Sequence
  Synthetic sequence.
REEDEVRKELERVERRIEDLLREVERTNREVIETSERLTKTVEDDVRRVNTEIDRLLKEKKDDKERVVREVRELIRELNEKIKKTVEDSKRLADELAERNERVAREVRRLIEELKRRVGVEELLRELEEVLRRIEEKLKKIDDESKKLAKEDTDRNKRIVDENTRLVEEWDKRAK

SEQ ID NO: 16324 - protein, 175 aa, Artificial Sequence; identical to SEQ ID NO: 16323
  Synthetic sequence.

SEQ ID NO: 16325 - protein, 187 aa, Artificial Sequence
  Synthetic sequence.
SVLEEVRKKVERVIRESRELSERVREHIKRTIDEVKKLTEEVRKIVETLIRRLKELLDRVRRKELVEEVVRRARKVLKELEELAEKSIRDTRRLLDENRDILRKTIERSKRLLEEIEDVARKILKDVPDEEVRKILTDLRKAVDEDRRRNEKLLKDSEDAVRRDEKENRDILRELRKAIEEIERRLR

SEQ ID NO: 16326 - protein, 187 aa, Artificial Sequence; identical to SEQ ID NO: 16325
  Synthetic sequence.

SEQ ID NO: 16327 - protein, 187 aa, Artificial Sequence
  Synthetic sequence.
SMVDKVREEARKLIEEARRLSEEVKKIIDELTKRVKDLTRTSHELSKRLEDTIRELLKRVRRRELVEEVVRRLREMLKELEKTDRDSIRTTRDLLRRLEKIVRDTIRESRRVVKEAEDEIRRITKDVDDEKLREILKRLREELKRDEDRNRELLKRVRDRVKKDEEENRENTKRVREAVEKIERELE

SEQ ID NO: 16328 - protein, 187 aa, Artificial Sequence; identical to SEQ ID NO: 16327
  Synthetic sequence.

SEQ ID NO: 16329 - protein, 187 aa, Artificial Sequence
  Synthetic sequence.
DVLEEVRRRAEEVIREARELSKRSHDRSRELIERVKKLTEESHRLSRKLIRELEERLEKVRREEELEKVVRDAEKVLRDLKETDERSIRDTERVLRELEKTDRETIKRSRDLLEELERLARKILKDVPDEEVRRILKELRDEVKRDEERNRKNTKDVKDEVDKDRRTNEKNTEDAEREIRRIKEDAR

SEQ ID NO: 16330 - protein, 187 aa, Artificial Sequence; identical to SEQ ID NO: 16329
  Synthetic sequence.

SEQ ID NO: 16331 - protein, 187 aa, Artificial Sequence
  Synthetic sequence.
SVLEDVRRDVERLRREIEELSKRSHERSRRIIERLEELLKRSHDLSKRLRERLEELLKRVRREELVRRVVEEARRLLKELEKTDRDVVEEARRLVTELEDTDRRTIEESRRALKELEEEARKIRKDVPDEEVRRILKKLRDDVKKDEDDNRRNTEEVRKLAKDIERKLKKNTDDVRKDIKAIEDRLR

SEQ ID NO: 16332 - protein, 187 aa, Artificial Sequence; identical to SEQ ID NO: 16331
  Synthetic sequence.

SEQ ID NO: 16333 - protein, 187 aa, Artificial Sequence
  Synthetic sequence.
SVLEKVKELLDRLIRELEELVKTVEEIARRLITEVRELTERSHELSRRLIKELKRLLDDVRREEVLKDVVRRAEEVLERLRKTDEDSIRSTEDAVRRVAELAKRVLDKAEEVIRKVREDARKISKDVPDEEVRRILEEITRVLEEIATRLKRILDELRKAVDKDRKDNERNTEEVRKLIEEIKRRLK

SEQ ID NO: 16334 - protein, 187 aa, Artificial Sequence; identical to SEQ ID NO: 16333
  Synthetic sequence.

SEQ ID NO: 16335 - protein, 187 aa, Artificial Sequence
  Synthetic sequence.
SLLDEVRRKVKEVEDRLRKLVKDSHELSRRLIEEVERLTKTSHELSRRLIEELRELLKRTRTEELVKKVEEIVKELLRRLEETDKRSIERTEELLEELRETDRRVVEEAKRLVKEVEDEARRIKERVPDKDLRDILRKLREVLEEIERRLRKNTEDVKKVVDDDRKRNKDNTDEVRKAIREIEERLR

SEQ ID NO: 16336 - protein, 187 aa, Artificial Sequence; identical to SEQ ID NO: 16335
  Synthetic sequence.

SEQ ID NO: 16337 - protein, 181 aa, Artificial Sequence
  Synthetic sequence.
SEIERLLEEDTKRLRDWEEAIRKNLEDSEREAKKLKDRVKKLLDDARRDIDRLKKERKDDKDVIKLLDEVLDTVRRLAEDIKRVIEEVLKESRRLVEEVKKVIEEVNRRSKKLVEEIRREEREEILDEVRRRLKTLNDDVERLLREVHERSKKLRETVRKIVEEVEKRITELRDRVRRAAK

SEQ ID NO: 16338 - protein, 181 aa, Artificial Sequence; identical to SEQ ID NO: 16337
  Synthetic sequence.

SEQ ID NO: 16339 - protein, 181 aa, Artificial Sequence
  Synthetic sequence.
SDIDRLLEEDKKKLDDWRRAIEKNLEDSERRAREIKERLKKLLDEVRREAERLKEERKDDKDVLELIDRVVDTVRKLIEEVERVIDEVLRTSEKLVRDVKRAIDEVNERSKKLVEDARRDEKEDILREIAKRIEDLNKEVEDLLRTVHKESRRLDREVEEIVRRVKEEIDRLIREVREAAK

SEQ ID NO: 16340 - protein, 181 aa, Artificial Sequence; identical to SEQ ID NO: 16339
  Synthetic sequence.

SEQ ID NO: 16341 - protein, 181 aa, Artificial Sequence
  Synthetic sequence.
SEVDKLLEDDRKALEEWERRITKNLEDSKREIDDIRRRLRKNLEDSRRAIKEMKDRRREDEEVLRLLEEVLERSKRLVEEVEKLLEKVLRDSEKLVREVRRAIREVNKTSAELAKELKREEREEILKRIADEIKRLNDEVKKLLEEVHERSRRLIEELRRLLEEVHRRSRKLIREVEEAAR

SEQ ID NO: 16342 - protein, 181 aa, Artificial Sequence; identical to SEQ ID NO: 16341
  Synthetic sequence.

SEQ ID NO: 16343 - protein, 180 aa, Artificial Sequence
  Synthetic sequence.
SAEEEIEERLKRAIDRDEESVKRSAEEIKRLIEELKKSVDDSARELKELIERLKKLKKDGVDKSVIDKVVRELTRRVEELHERNRELLERVKETVERLHEENRRTSDEIEERVRELVREVDTKEIKDLLDRVKKEVERSKRKSAKLLKELEDAIKEIEDRSRELLERAREELKRVKDDKR

SEQ ID NO: 16344 - protein, 180 aa, Artificial Sequence; identical to SEQ ID NO: 16343
  Synthetic sequence.

SEQ ID NO: 16345 - protein, 180 aa, Artificial Sequence
  Synthetic sequence.
DETKRVRDLIRELIKRDEESVRRSARTLEELIRRLEESVKRSKKLVEDVIRKLKKLVKDGVDSDDIRKLVRDVERVVRKVVEENRRLVETVAREVERVHKENEDTSEEVRRTVKELVDEVRTEEAKKLLEDVEEAVERSKRKSRKLLEDARRALEKVKRDSDKLLEDVREEVERVLRTVK

SEQ ID NO: 16346 - protein, 180 aa, Artificial Sequence; identical to SEQ ID NO: 16345
  Synthetic sequence.

SEQ ID NO: 16347 - protein, 180 aa, Artificial Sequence
  Synthetic sequence.
DELEKIAEELDKLIRDDKKSVDESKRLLEDLIRRDRESVEESERELTELRRRLDELRRRGVDRDEIRKALEEVKRVVEKLVEENERSTEEVKRTVDRLHRENERTSEEVRRRVEELVREVDTREIKELLKRVRELVRESKERSRAVKERLKEEVKESERRSRELLERVRRDLEKIERDTR

SEQ ID NO: 16348 - protein, 180 aa, Artificial Sequence; identical to SEQ ID NO: 16347
  Synthetic sequence.

SEQ ID NO: 16349 - protein, 180 aa, Artificial Sequence
  Synthetic sequence.
SELERIKKELEELIERDKKSVKDTARRLEEMERRLRESVRKSEEDLRRMIEKLEKLVTDGVEEESIRRLIKEIIRTAKKLHDDNERLLKEVEEVVRKLVKDNEDTSKEIEDRVRELIREVKTDEARKLLEDVKRLVEESKRESKRLLDEVKKVIDRLRERSEKLLRDVERALREAEERTR

SEQ ID NO: 16350 - protein, 180 aa, Artificial Sequence; identical to SEQ ID NO: 16349
  Synthetic sequence.

SEQ ID NO: 16351 - protein, 180 aa, Artificial Sequence
  Synthetic sequence.
EEDERIRRDLEEAIRRDRKSVEDTREELRKMIEDDERSVRDSEEKLKELIKRLEELVREGRDSKDIEKALRDVEDTVRRLVRENEKSTEDIEKRVKELVEENKRTSEEIERRVEKLVDDVRTDEIRELLRRVRELVKKSKDDSRKLLEDVKRELERSKEESKRLLDEVKRAIDEIRERDK

SEQ ID NO: 16352 - protein, 180 aa, Artificial Sequence; identical to SEQ ID NO: 16351
  Synthetic sequence.

SEQ ID NO: 16353 - protein, 180 aa, Artificial Sequence
  Synthetic sequence.
SELERIEEELKKLIEDDKKSVDDTRKELDRAIEEDKRSVERSERDLRRMIKKLEDLVRRGRRDEDIRKLLEDVKREVKRLVDENEASTRTIKRRVEELDKRNRETSERIRKRVEELVREVKTDEIRKLLEEVKKLVEESKRTSEELLKEVDRRLRRSEDESRKLLEEAKKAVKRIEEETR

SEQ ID NO: 16354 - protein, 180 aa, Artificial Sequence; identical to SEQ ID NO: 16353
  Synthetic sequence.

SEQ ID NO: 16355 - protein, 180 aa, Artificial Sequence
  Synthetic sequence.
DELEEIKRRLKELIDRDRESVKRTEDELRELIKRLRKSVDDSRKEAERLIRELERLVKEGVDRRDIERLIREIKKRVKELNDENRRLAEEILRRVEKLDKENKETSEEIRKRVKRLVDEVRTDEIRELLERVERALRESKERSRKLLEDVRRAIEKVERDSEKLLKDVEEALERVKRERD

SEQ ID NO: 16356 - protein, 180 aa, Artificial Sequence; identical to SEQ ID NO: 16355
  Synthetic sequence.

SEQ ID NO: 16357 - protein, 180 aa, Artificial Sequence
  Synthetic sequence.
REEDEIRRELKELIERDERSVEETRKELEELIRELEELVKRVEDDLRRLIEKLEDLRRKGRDRREIERLLEEIEKRVTELVKEIEKLIEDIRRRVDELDKENRRTSEEIRKRVKELIDEVRSDEARKLLKEVEELLRRSKRKSEELLKRVEELLRKAREDIRRLLEEVKRVIDKVKKDTD

SEQ ID NO: 16358 - protein, 180 aa, Artificial Sequence; identical to SEQ ID NO: 16357
  Synthetic sequence.

SEQ ID NO: 16359 - protein, 179 aa, Artificial Sequence
  Synthetic sequence.
SDVERIIRENERKAKEIKDKVRKVIEDNERSVEEIKEKAERIVREVRKTLEEIRKRIRSELMRRLAELIREIEKRIEDVLRRIEKLHKDVSEAIRRVLKEIEDLHREVTEEVKRVRDANSKEMVERVERLIEEVARRSEELLRRIAKLVEDVNRESERLIREIKELAREVEKELKERAD

SEQ ID NO: 16360 - protein, 179 aa, Artificial Sequence; identical to SEQ ID NO: 16359
  Synthetic sequence.

SEQ ID NO: 16361 - protein, 179 aa, Artificial Sequence
  Synthetic sequence.
SEVDDIIRKNEELLKKIEDDARKILKENEERVEEIKERIKKLIEDDRRKLEEIKRRIRGELAERLRELSRTTVELLKEVLRRIETLHKKVTDDLKKVLEDIRRLHEEVTKELRRVKDANSEEALDRIRKLIEKVKRESEKLLEDIKRLIDKVDKDSERLLRTVKKLSEDVEKELKDTTK

SEQ ID NO: 16362 - protein, 179 aa, Artificial Sequence; identical to SEQ ID NO: 16361
  Synthetic sequence.

SEQ ID NO: 16363 - protein, 179 aa, Artificial Sequence
  Synthetic sequence.
SEVDEIIKDNERELDEVRREVEEIDKENKERLKEWVEEAREILDRLRKDLEEIRKRVRSRLVDELERLIREVEEVIRRVLERVRRLIEEVSKIITDVLREVERLHEEVTKELRKVEDANVREALDRLRRLIEKVVEDSRRLIKKVDELLKKVNKEIEDLVREVKDLVRRVKEELDRRVK

SEQ ID NO: 16364 - protein, 179 aa, Artificial Sequence; identical to SEQ ID NO: 16363
  Synthetic sequence.

SEQ ID NO: 16365 - protein, 179 aa, Artificial Sequence
  Synthetic sequence.
EEAERILKKDDDSVRKIKKEADRIVRENERLAEEIKKEVRKIIEDDKRTLEEIEKRIRSKLVEDLKRLSRETLEELRRVLEEAEKLHEEVTRLIRDVLRKIEELHRRTKKKLRDVRDANSEEMLRRVEEDLRRVNEESERLIRRIAKEVKRVTDESKKLLEEVKRISETVIEKMKEDAR

SEQ ID NO: 16366 - protein, 179 aa, Artificial Sequence; identical to SEQ ID NO: 16365
  Synthetic sequence.

SEQ ID NO: 16367 - protein, 179 aa, Artificial Sequence
  Synthetic sequence.
DEVEEILKRDEEALRDIEKKVREVDERNRREVEKIKEKVKEIIKRDKDELDEIRKRIRSEKARELEELSDRTLKTLKKVLDDIEREHREVSRDIKKVLEDIKRLHDETLKELTRVRDANSEEVLKRLEEEARRVNKTSKDLLKEVEDKIRKVNRKSEELLKKVEELSRRVIEEMRRRVK

SEQ ID NO: 16368 - protein, 179 aa, Artificial Sequence; identical to SEQ ID NO: 16367
  Synthetic sequence.

SEQ ID NO: 16369 - protein, 181 aa, Artificial Sequence
  Synthetic sequence.
RELEELIEDLRRALERSREEVTRLLKDLEDANRRSHRHNEELIKRLRKILKEARDRVKRDNVDERVVRRVERLVKESEKDNRRVLKESSDLVKKIVDELREVLKRSTELVERVVDLIRKLREEEALKDLRRVVEEVKKRSTDLNREVAKVIEEVKKRSEDLNRELEKLNRDIEERIDRETR

SEQ ID NO: 16370 - protein, 181 aa, Artificial Sequence; identical to SEQ ID NO: 16369
  Synthetic sequence.

SEQ ID NO: 16371 - protein, 175 aa, Artificial Sequence
  Synthetic sequence.
REEEEARKILERLEEELKRSLDEVRDLIEKATKESKDVNEKIRKLLEELKEELRKVVEDTGGNVEEIDKILKKVKKDLDDLLKESEDVARKVKKLLDELHEKNREMLERVRRELERVVKVEELVKDVERKLKRVAEESRKLVEDLRRRIKESREEIKRLVEDLERVLKEIKEEAK

SEQ ID NO: 16372 - protein, 175 aa, Artificial Sequence; identical to SEQ ID NO: 16371
  Synthetic sequence.

SEQ ID NO: 16373 - protein, 175 aa, Artificial Sequence
  Synthetic sequence.
REEEEALKRIRETSERIKRVVDDLHRRNKKSTDDIKRRVDELHKRNEKIVREVLDVIRRRGGEAEEVKELVERLRRSVEDSLREVTRLVEEDKRSVDESLDELRRLLKENRDLVERLVDSEVLRELDRRTKELKRRADELVTENRKLSKELEDEIRRLAERNRDAIRKIDKAVKE

SEQ ID NO: 16374 - protein, 175 aa, Artificial Sequence; identical to SEQ ID NO: 16373
  Synthetic sequence.

SEQ ID NO: 16375 - protein, 175 aa, Artificial Sequence
  Synthetic sequence.
DEEERALETIRDTSRRIEERIDDLRRRVEKIVRDIEETIRRLHEENRKIAERVKEVIERRGGKAEEVKKLVDELRRSVKKSLDDARKLVEDLKRVIDKVLEELRRLLEEDKRLVDELVDSEVLKELEDETRRVKERVDKIIKELEERVEDVERKVRELVKRNEELLKKIKDDADK

SEQ ID NO: 16376 - protein, 175 aa, Artificial Sequence; identical to SEQ ID NO: 16375
  Synthetic sequence.

SEQ ID NO: 16377 - protein, 175 aa, Artificial Sequence
  Synthetic sequence.
SREEDAVRKIRKLVEDVTRETKKMLEDVRRLVETVEKLTDDLLEEVRRLVEEVEDEIRRAGDVEERARELVEEIKRIIDEVRETSERLDREIEDLLRKVEKRARDLDRRIKEIIDREVDSELLREVEDLLRRHHETVRRILDEIRRLIERHHRRVREILKELDKLVKDAADEVRR

SEQ ID NO: 16378 - protein, 175 aa, Artificial Sequence; identical to SEQ ID NO: 16377
  Synthetic sequence.

SEQ ID NO: 16379 - protein, 188 aa, Artificial Sequence
  Synthetic sequence.
SEVERVEEEVKRLATEVEKSNRDSLREIEDLNRRDRDISRRVKEEIERLIREVKKLIDDRREEEAVREVEKVIREVLRRVTELIRRLRETVKEIRKRVEELIRRDEELVDRVLKEVRRLIEELRKRNDEKKVKELLERAKKIADELRKHIKRTLKKVEEEVEKNKRDNDKLLEEARELIKRLDDEVRR

SEQ ID NO: 16380 - protein, 188 aa, Artificial Sequence; identical to SEQ ID NO: 16379
  Synthetic sequence.

SEQ ID NO: 16381 - protein, 188 aa, Artificial Sequence
  Synthetic sequence.
DDLERVRKEIEDLNREDKRRSEEVRREVKKLIEDLEDSNRRSLEEVDRLVETVRELIDRERREEAVDKVRKVIEEVLRRVRELVERDERLVDEVLRRVKELIRELRETVKEILKRVEELIRRLEDRNDKEKVKRLLRTVRELMKKNKRDNDRLLKEAEDEARRVKRHIKESLKRIEEEIRRLKERLER

SEQ ID NO: 16382 - protein, 188 aa, Artificial Sequence; identical to SEQ ID NO: 16381
  Synthetic sequence.

SEQ ID NO: 16383 - protein, 188 aa, Artificial Sequence
  Synthetic sequence.
DELEKVAEDIKKLNKEDRDRSDEVRRAVKELVKEVEKKDKDIKRRAEELIREIKEDIERRREEEVVDRVREKIKKVLKEAEDLIRDSKRVIDEVLERVERLIRELEKTLEEILRRVRKLIRDLEEKNDREKVRKLLEDVEREARKNEEDNRKLLKDIREEIRRLADRSRKTLEDAKRLIEKIERDLEK

SEQ ID NO: 16384 - protein, 188 aa, Artificial Sequence; identical to SEQ ID NO: 16383
  Synthetic sequence.

SEQ ID NO: 16385 - protein, 172 aa, Artificial Sequence
  Synthetic sequence.
SEVEEVLKEIEEMLRDLERRVKESDEENRDSLRKIREDVERVDEENRDTLRRIKEKVKGELLKEVEELIRELSRELEKVLKEAEDAVRELSKDNRRVLEEIRKAVKRLLDLVREDGSEKVMKEVRDVIARLRDELEKVTEDSRRVNKELKKRLEDVVREIRRANEELDERVR

SEQ ID NO: 16386 - protein, 172 aa, Artificial Sequence; identical to SEQ ID NO: 16385
  Synthetic sequence.

SEQ ID NO: 16387 - protein, 172 aa, Artificial Sequence
  Synthetic sequence.
DEVEKVLEEIKRALDDLRKKVEESKREIKEALKRVEKHTRDSDTDNKRTLREIEERVKSKDLERVRKLVEELSEENERSLREVRRVAEELLEINERVLEEVERVVKRLLDLVRRRGEERVVEEVRRVLEELRRRLEKVTEDSRRAIERLEREDRRVSKKSKDVNKKLDDDVR

SEQ ID NO: 16388 - protein, 172 aa, Artificial Sequence; identical to SEQ ID NO: 16387
  Synthetic sequence.

SEQ ID NO: 16389 - protein, 178 aa, Artificial Sequence
  Synthetic sequence.
DSARKVEREVEEAARRVERTLEDVTRKVRELHDEVRRRLEEVKRRIEDLHRRVDEEPRGKELKEKLDEVHKRSEDMLREVEKIVRKVNTESKKLLDDVRRELEDVLRRVKELLRDVLSDKDTVKRVLDDVARIVKRIEEDIKRVLEESKKLVRDIEKEIRDVKKESRDLVREIREKIR

SEQ ID NO: 16390 - protein, 178 aa, Artificial Sequence; identical to SEQ ID NO: 16389
  Synthetic sequence.

SEQ ID NO: 16391 - protein, 178 aa, Artificial Sequence
  Synthetic sequence.
SSAEEVKRELEERHRDLRRTDEELRKDLDRVHDRARKILEEIEKKIRDMHRKVKERERGEDLERELDEVNKRSEELVTRAKEEVTRVNERSKRLVERSKEKVAEVNKRSETVLRDVLSDERKVKKVRDESNKVVEEIMRHSDKVLERSRRLVEEIRRRLEEVLRTSREVVRRIRDEVR

SEQ ID NO: 16392 - protein, 178 aa, Artificial Sequence; identical to SEQ ID NO: 16391
  Synthetic sequence.

SEQ ID NO: 16393 - protein, 172 aa, Artificial Sequence
  Synthetic sequence.
REVEEVLKEIEEMLKRIEDDVRRVLEEIKDVARRNEDEVRKLLRENEESVEEIKRRVSEELLRKVVTLSEDVVRKLAEVVKDTLRKIETVVKKVEKVVEKIRRDIKRVAKKVRKDSDRKVVEEVRKLLTDLKRLLEEVVKEVRKRLKELHDRTRTVAEEIRDINKKLKEEVN

SEQ ID NO: 16394 - protein, 172 aa, Artificial Sequence; identical to SEQ ID NO: 16393
  Synthetic sequence.

SEQ ID NO: 16395 - protein, 185 aa, Artificial Sequence
  Synthetic sequence.
SSVDEVRRTIEELIRRVEELVKRSKDHVDETERRVKELVRRSHELTKEVIERVEELLRRLKQRDVLEDILRRVKKLVDDVHESNRRVLEEVKRLVDENRESNKKVLEDVTRAVEELERLLRDKVSDEDKVRKLVEDLRRALEKIRREIEKSTEESDRVLRRIEEEIRRDSEELKRALREAEEEVR

SEQ ID NO: 16396 - protein, 185 aa, Artificial Sequence; identical to SEQ ID NO: 16395
  Synthetic sequence.

SEQ ID NO: 16397 - protein, 184 aa, Artificial Sequence
  Synthetic sequence.
SEVEELLKEVERLVREVEERVRRLHETDRKLLEDVKRKVEELHREDKKLADEVREAVKRRRDEEAVERIERLLREVEKHSDETVKEVKKLLDEVTKHVEDSNREAERLLREVRELVKEVLRRAGDNEDVERLRRELEKVAEKIRRLVEANRKTVEDARREIEKLLEENRRELDKVRRDVEREAK

SEQ ID NO: 16398 - protein, 184 aa, Artificial Sequence; identical to SEQ ID NO: 16397
  Synthetic sequence.

SEQ ID NO: 16399 - protein, 188 aa, Artificial Sequence
  Synthetic sequence.
KEVDDLLKEVRRLVREVEKELKRLHDENRKSSEEIARRLEELHKESKELVERVKETLRDLRKDSGDERVRREIRRLVKEVEDVVRRSIREAEELVERDERSVKRSIEEIRRLVKEVEDFVRDVIRKIRDEKVVRDLEREVREALRRLEEILRRDEDDVRRSREELKRIIDENREEVKRVLRELEETLR

SEQ ID NO: 16400 - protein, 188 aa, Artificial Sequence; identical to SEQ ID NO: 16399
  Synthetic sequence.

SEQ ID NO: 16401 - protein, 182 aa, Artificial Sequence
  Synthetic sequence.
SEVDELVERNERLVDEVRRRVEDVARKLEKVSRDSDDLVRRSNEELEDRLRKVEKRVREERDAKELVEKLIREVRKVLEESEKLVRDLIKKNEDVLREIEKEIRRLSKENEDVLREIERRIEDKKKLDEIRERSKRANDTLRKLLEDIRKRVEDSIRRLDELLKRSETRVRDIIKKLEDELR

SEQ ID NO: 16402 - protein, 182 aa, Artificial Sequence; identical to SEQ ID NO: 16401
  Synthetic sequence.

SEQ ID NO: 16403 - protein, 182 aa, Artificial Sequence
  Synthetic sequence.
DEVDELERRNERLAEDVRRKVREVEERLKELSKRSMDIVKDVLRRLKELVDRVEKKVREKRDDEELVRRLIKEVRRVLEEAKKVVKRLIEENRRVLEEIKEVVERLSRKNEEVLKRIRERISDEKKVEEIREKSERVNRDLEDKLRKIEEKVKESEKRLRDLLREIEERIKRAIEKLERDLK

SEQ ID NO: 16404 - protein, 182 aa, Artificial Sequence; identical to SEQ ID NO: 16403
  Synthetic sequence.

SEQ ID NO: 16405 - protein, 182 aa, Artificial Sequence
  Synthetic sequence.
SKVEELTERLRRLSKRSEEEVEKSNKDNDELVRRVLKRVKEVMRELEKLVEKVKEDVRRERDSRELVKKLIDEVRRVLEDARRVVKELSKENERVLRESEKLVRELIKENERVLKELEKRIDDKETLDRIRKEVEDSIERLKKLLDDSRRRSKEANDALRKLLKEIEDTIRRAIEELERARR

SEQ ID NO: 16406 - protein, 182 aa, Artificial Sequence; identical to SEQ ID NO: 16405
  Synthetic sequence.

SEQ ID NO: 16407 - protein, 182 aa, Artificial Sequence
  Synthetic sequence.
SRVEELTEENRRLAKRLKEVVKKVLDELRRRVEEVKERVERSNKKLRDLVREVDERVATKRDVKELVEKLLREIEKVLRESEKLVRDLIRDVRRVLEEVKKLVKEVSDRNREVLEDIKRRIDDEEIVRRIEEESKKVNRELEELLRKIEDDIRKAEEELRELVERSKREVDKALDDIDRRTR

SEQ ID NO: 16408 - protein, 182 aa, Artificial Sequence; identical to SEQ ID NO: 16407
  Synthetic sequence.

SEQ ID NO: 16409 - protein, 182 aa, Artificial Sequence
  Synthetic sequence.
KEVDDVKKELDDVDREVKELIKRAHDKNRKVVKEVEDELRRLTEDDKRVADKVRELLKKVRDKEEVVRRLLEEIERSLRKIEEDVKKLLEKIKRSLEESRELAKELLEKVARVLDKIKKTITDKDKMKEVEDEVRKVLDTIRKLLKRDEEAVKEALDKVKKMLDDARRHSEKVLREVEDTLR

SEQ ID NO: 16410 - protein, 182 aa, Artificial Sequence; identical to SEQ ID NO: 16409
  Synthetic sequence.

SEQ ID NO: 16411 - protein, 178 aa, Artificial Sequence
  Synthetic sequence.
SEVEELLKEVRELARRIEEEIKKLHRRNEELARRIKETIKRLIDENRKLAEDVRRDSGPDDRLRDLVRRVAEHVKESSDRIKELVDRVRRHVKKTSKEVDELLKKVERVVEEVLRRVGDGEDAKRIRDELERVRKSIEKLIRDNERFLEKVERDIRKLIEENEDLLRKIKEDVERKEK

SEQ ID NO: 16412 - protein, 178 aa, Artificial Sequence; identical to SEQ ID NO: 16411
  Synthetic sequence.

SEQ ID NO: 16413 - protein, 178 aa, Artificial Sequence
  Synthetic sequence.
DEVRELLETVRKLAEDVERRIRELIKENERLAREVERRIKELHDRNRELAREVEEKTGPDEELRRLLKEVEDHVRRTIREVEDLLRRVKKHVEDTTREIAKLLREVEEVVKDVLRKTGEGKEAREIERELEKVKDTIRRLLERNEELLEEIARRITKLLEEDKELLERIERRIAEKLK

SEQ ID NO: 16414 - protein, 178 aa, Artificial Sequence; identical to SEQ ID NO: 16413
  Synthetic sequence.

SEQ ID NO: 16415 - protein, 185 aa, Artificial Sequence
  Synthetic sequence.
SEVETLLRELKRLAEEVKKRIEELDRELKKLSDDVRREIERLIRENERLAREVLKEIRDLKGDKKRIEELLREVEKSVRETSKTIRDLLRRVEKVYEDVLRTIRELLERVRRVAEDVRRKIKERGKEEALREIEKLLRKVEEDVRRLIEKLKKSLEDSARDVDRLVKENERILEEVAREVEKLLR

SEQ ID NO: 16416 - protein, 185 aa, Artificial Sequence; identical to SEQ ID NO: 16415
  Synthetic sequence.

SEQ ID NO: 16417 - protein, 185 aa, Artificial Sequence
  Synthetic sequence.
KEVEDLLRDLKRIVDEVEKRIRKLIEDNKRLADEVRERIERLHKRNKDLAEEVLKRVRELKGDDKRIRELLKEVEDSSKESVERIEELLREVEESVKRSSREIERLLEEVARLAEDVIRKAEERGKKEVVKRIKEELDRVREEVKKLIKRNEELLKKVAEDVRRLLEKDKKALEEIKRRVEDELR

SEQ ID NO: 16418 - protein, 185 aa, Artificial Sequence; identical to SEQ ID NO: 16417
  Synthetic sequence.

SEQ ID NO: 16419 - protein, 181 aa, Artificial Sequence
  Synthetic sequence.
DELEELRKRVKENEDEVEKVLRELHKLNEENKEEVDRALEELRKRVRDIEEEIKKEPVDEELLRELERLVDELRRIVEKVIEDAKKLTEESNELNRRIIEESRRLSKELRKIVEDVSRVENRKDVVDKVRKVIEEVHKRSRDLAKEAREVNRRVHETTKKLVEDVRRVIEKVEEDVRRKVK

SEQ ID NO: 16420 - protein, 181 aa, Artificial Sequence; identical to SEQ ID NO: 16419
  Synthetic sequence.

SEQ ID NO: 16421 - protein, 181 aa, Artificial Sequence
  Synthetic sequence.
SSLEEADKKVDKNRRDVDRALEELHRRNKRNEEEIRKALKENRETNKRLLEEIRKNPVERELLEELEKLVRDSLRVSEEVIRDLERLTRESNRLNKEVIDESRKLSERLKDIVRTMSRVENREDAVRRVDKVIKEVHDESKRLVDELRDRNRRVHDETRRLDEESKKINRTVEELIRRKET

SEQ ID NO: 16422 - protein, 181 aa, Artificial Sequence; identical to SEQ ID NO: 16421
  Synthetic sequence.

SEQ ID NO: 16423 - protein, 181 aa, Artificial Sequence
  Synthetic sequence.
DKVEELLKRLEESTRRILKRVEELLRENERLAREVRKTVERLLEENRRLIEEVERRVRRDKKREAIEKLVRDVSRSADESSKRIKKLLDEVEESVRRSSKEIKRLLDEDRKLVEDVERRITDEKLRRELRRLLRESEKKIKEMLDRNKELLDEIERTIRELLKRNEDLLREVRERAKEADK

SEQ ID NO: 16424 - protein, 181 aa, Artificial Sequence; identical to SEQ ID NO: 16423
  Synthetic sequence.

SEQ ID NO: 16425 - protein, 181 aa, Artificial Sequence
  Synthetic sequence.
DEAEDLLRKLKRSTDEIKKTVEKLLRENEKTSRDIEREVRELLRRNKELAERVEEVARRENDKKKIEELLKEVERSARESSERIKKLLRDDEKSVKDSSDEIKRLLKEDKELVERVIRRITDEKVRRELERLLRESEKEIRKLLKRNKELLDESRDTIREMLERNKRLLEEVRKKIEKMKE

SEQ ID NO: 16426 - protein, 181 aa, Artificial Sequence; identical to SEQ ID NO: 16425
  Synthetic sequence.

SEQ ID NO: 16427 - protein, 181 aa, Artificial Sequence
  Synthetic sequence.
SEAERLLEELKRSTDEIKKRVEKLLEDNKRTSEEIEEEVRRLLETNRKLIEDVKRKVERDRDKDEIKRLLDEVKKSAEDSSRRIEELLKEDKKSADDSSEEIKRLLDEDRKLVEDVIRRITDERVRRELEKLLRDSERKIKEMLERNEKLARDSEERIRRMDDKNKDLLRRVKETIERKLK

SEQ ID NO: 16428 - protein, 181 aa, Artificial Sequence; identical to SEQ ID NO: 16427
  Synthetic sequence.

SEQ ID NO: 16429 - protein, 181 aa, Artificial Sequence
  Synthetic sequence.
DEVEDLLRKLEESTRRILERVKKLLEDNKRLIDRVRKEVERLLRDLKRLAKEIDEEVRRDNDKDRIRDLLREVERLVREVIKRIRKLLEEVKKSIEDSSREIKRLAEDDERLVREVIARVTDERVIRELEELLKESKKRIDDALRENEKLLREVKRRIEEAERTIKELLEEIKRKIAEEEK

SEQ ID NO: 16430 - protein, 181 aa, Artificial Sequence; identical to SEQ ID NO: 16429
  Synthetic sequence.

SEQ ID NO: 16431 - protein, 182 aa, Artificial Sequence
  Synthetic sequence.
KEAEELKRRLEDLVRRVEEDNRRLLEEHKKLVKDVRKRAKELLETHKKLVEDVTREVRKSTDSDVIRRLLEEIHRLVEEILREIEELLKRLHDLARRILERVRDTLRELEKLVRKILKDIKDLREVLEDLKRDLERARKINEESEKRIKDSDKRVHEEIRRVLEEVKKSDEEVRRRADRERE

SEQ ID NO: 16432 - protein, 182 aa, Artificial Sequence; identical to SEQ ID NO: 16431
  Synthetic sequence.

SEQ ID NO: 16433 - protein, 181 aa, Artificial Sequence
  Synthetic sequence.
REVDELRKELERIVKEVEDVIRDLNKKLKDILKDVKDKSDELNERLKKIVEDVRRLIRDVKGNRKDIRTVLERVKELVEETIRRDEELLDRVRKLVEETIRRIKRMLERVEELVKRVISRVRDKMVEELERLLDEARRRVEEAIRSNEELLKRIEEESERTVRSNEKLLKEAEEEVRRAEE

SEQ ID NO: 16434 - protein, 181 aa, Artificial Sequence; identical to SEQ ID NO: 16433
  Synthetic sequence.

SEQ ID NO: 16435 - protein, 181 aa, Artificial Sequence
  Synthetic sequence.
DEVEDVERDLKRILKEVKDRSDELIERNRKSTEDMKRRSKELNEELRRIIEDIRRLIRDTKGDKKKIEEALERVERLARRTIEEDKRVLEEDKRLVDRLLDTDRKLLKEVKDLVKEIIKRVRSKMVERLERLLEEAERTSRETLKRLEDTLRESEKRSRETVRSNEELVKEVTKEVEDAKK

SEQ ID NO: 16436 - protein, 181 aa, Artificial Sequence; identical to SEQ ID NO: 16435
  Synthetic sequence.

SEQ ID NO: 16437 - protein, 181 aa, Artificial Sequence
  Synthetic sequence.
DEVETVLRDNERTTKEAEDDVRRLNEELKEIIKRVREVSKRLIDELRRILEDVERRAREVKGDKDDIDRLLKEVEELVRRVIRTDEELLKRVEKLVRETIKKSKDVVKEDEKVVRRLISRIRSDFVERLRRTLEESKDKARRNVESNRELLERARKDSKRTLEELERLLETVRKSVDEMKK

SEQ ID NO: 16438 - protein, 181 aa, Artificial Sequence; identical to SEQ ID NO: 16437
  Synthetic sequence.

SEQ ID NO: 16439 - protein, 178 aa, Artificial Sequence
  Synthetic sequence.
EREERLEEKLKKSVDDSRELIERVLRKHEKVSDKVRRELERILEDHKRVLEEIKRVLKDRRKDKEVIRDLLRKIHEVATRLRERIKRLLEEVRRSVEEIKELVDRLNKHNERVIREVRRDSDVERLKDLLDKAHEEDRRAKEEVKRLLEDTTKKIKEFLDRVERSNEEVERELEKAER

SEQ ID NO: 16440 - protein, 178 aa, Artificial Sequence; identical to SEQ ID NO: 16439
  Synthetic sequence.

SEQ ID NO: 16441 - protein, 180 aa, Artificial Sequence
  Synthetic sequence.
DKDRKIKRIIEEVKKTIRKLLDDVRRINEEVLKELRKLLREVEEINKEILRRLKELVKTSKSDDVIRKARELIKRSREINKEVIDRLRKLVEDTRRINKTVIDEIKKLIDDVAEIIKDVTDEKVKKELDDEIRDAERELREAKKDMDRSNEELREEIKRAEERLRRLDEKLREEVEKDRK

SEQ ID NO: 16442 - protein, 180 aa, Artificial Sequence; identical to SEQ ID NO: 16441
  Synthetic sequence.

SEQ ID NO: 16443 - protein, 187 aa, Artificial Sequence
  Synthetic sequence.
SVKEEIKEMLKKIKRHSDEALKKNKETLDRDRKRVEDVIRELKKLLDEIRKRVEDVRRRVKDEDKLREIEDVLRRIEKRVTDLIREVRDSLRESEELSKRLLDKIKRSLDEAKRLVEELLEEVDRDDREEIARKVRELLERVLRDDRRVVREVEELNRRMHKKNEEVAKKVRDLLREVRKELEDVDR

SEQ ID NO: 16444 - protein, 187 aa, Artificial Sequence; identical to SEQ ID NO: 16443
  Synthetic sequence.

SEQ ID NO: 16445 - protein, 188 aa, Artificial Sequence
  Synthetic sequence.
REAEELLKELDEIIRRVEEEVKRLLDKVRETTKRIEEEIRKLDEDLKEIIREVEERIRKLKSDSGDERVRDKVRKLLRRLERVATESIRRIRELMKRDEDVIRRVLERVDELLKEIEKLIKEVRDRTDDEEVERRIKRLREKVKKKIDELKERVRRLLEESRRKAERVEESNRDLLRELKERLEERRR

SEQ ID NO: 16446 - protein, 188 aa, Artificial Sequence; identical to SEQ ID NO: 16445
  Synthetic sequence.

SEQ ID NO: 16447 - protein, 175 aa, Artificial Sequence
  Synthetic sequence.
SFEEEIKKIADEVEKRIRDAEKRSKDILEKSREVVERAKRRSEKLLRDAEREIKRVMEEKDDERIRRLLKELRDVVKRSKDLIDDLLRENKRVVDDSLRLIRELLRRLREVVRRLEEDGKDEMLRRLKKVTDDVRKRLEDSHRRLEKVTEESRKRADESHEELRKLIEEVREKLK

SEQ ID NO: 16448 - protein, 175 aa, Artificial Sequence; identical to SEQ ID NO: 16447
  Synthetic sequence.

SEQ ID NO: 16449 - protein, 175 aa, Artificial Sequence
  Synthetic sequence.
SSKERIEKILREVKREIEEAEKRSRDILKDSERIMRDVKRTTDDLLRKAEEIIREVAKRKDDDRVRDLLRRLRDVVRRSRELIKKLLKDNRKAVEDSKRLIKKLLDELRDMAEKLKKDGDEEVLKRLRELIDTVRRVLEESHKRLRELTKRSEEEARRVNEELRELIDRVRREAE

SEQ ID NO: 16450 - protein, 175 aa, Artificial Sequence; identical to SEQ ID NO: 16449
  Synthetic sequence.

SEQ ID NO: 16451 - protein, 175 aa, Artificial Sequence
  Synthetic sequence.
DVEKRIEELRERSDRIIDEARKRSEKLLRESEKMMRDVDKTTEDILREAEEEIKRVLDEKDDDRIRKLLEEIRKVIKESKDVIRKLLKENKEAVDTSRRLIEELLKRNREAIEKIRDKGEERVLKDLERLSKESEDELRRSHEELKRLTEESRETIEDVNRKIKEKIEDVKRKLK

SEQ ID NO: 16452 - protein, 175 aa, Artificial Sequence; identical to SEQ ID NO: 16451
  Synthetic sequence.

SEQ ID NO: 16453 - protein, 186 aa, Artificial Sequence
  Synthetic sequence.
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 16454 - protein, 186 aa, Artificial Sequence; identical to SEQ ID NO: 16453
  Synthetic sequence.

SEQ ID NO: 16455 - protein, 181 aa, Artificial Sequence
  Synthetic sequence.
SEVEEIVKEIEKLIKENEEVVREVEKEIRELIKRNREVVERIRKELEKMLRELERLAREGADRSLIRTLVREIEKEIERLAEEIRKTTEDINRRIEELLKRIKETTKEINDRIRELLKRIDRGEARERIKELVRRNERLLREVEKRLKTLSEENKKLLEDAKRELDRILKEVRDLLRETER

SEQ ID NO: 16456 - protein, 181 aa, Artificial Sequence; identical to SEQ ID NO: 16455
  Synthetic sequence.

SEQ ID NO: 16457 - protein, 181 aa, Artificial Sequence
  Synthetic sequence.
SRVERLSAEIKKLIDENRRVAEELLRELEKLLKDNEDVVREVERRIRDSSRKLEELARAGAPEEDIRRLVEESKELIKRLLRDIERTTREINEVIKRVVETIRRTTDEINRRIEELVRKIDRGEAREDMDRLVRENERLLKKVEDDLRKLSEENKRLVDRARERLARLLEENERLVDERRK

SEQ ID NO: 16458 - protein, 181 aa, Artificial Sequence; identical to SEQ ID NO: 16457
  Synthetic sequence.

SEQ ID NO: 16459 - protein, 172 aa, Artificial Sequence
  Synthetic sequence.
REAEEALKRVKEILKRIAEEVERVLTEVKKLSEDVKRRVEEVLTRLKRSTEEIERKKGPKEDLERLVKDDERTIKELLKEVEELIRRVDRLSEELLRKVEKLIRDLSKTLRDVGVDKKLVEDVDREIKKLLEEVTKKAKRLNDENKRLLDDVRDKARRVIEESREVLERARK

SEQ ID NO: 16460 - protein, 172 aa, Artificial Sequence; identical to SEQ ID NO: 16459
  Synthetic sequence.

SEQ ID NO: 16461 - protein, 176 aa, Artificial Sequence
  Synthetic sequence.
SSEEEVEKLERKVRAVIRKAEEDLEDSLRKSEKMAKEVTDEIEKSRRKAKAVIDDARRRNVDTDLVRELLRKLEETTRRVKKLVDELLEENRRTTERLKELVKRLLDELDEVVKEIARRGEEEVLKKVEELIRKVEKVIRTVLEEDRKVSEDSLRKMRKVLKEDEDVIKEVRDRAQ

SEQ ID NO: 16462 - protein, 176 aa, Artificial Sequence; identical to SEQ ID NO: 16461
  Synthetic sequence.

SEQ ID NO: 16463 - protein, 176 aa, Artificial Sequence
  Synthetic sequence.
SMKEEVDRLLKEVKDVIREVRERIKKSEEDVRRVIDDARRKLEELSKRAREVVEEVRRRNVDDEAVERLLRKVDRTSKELKKTVDELLKELERTTRRVKELVDRLLEKLRDVAEKLKKRGEEEVLKRVKELIDEVRERIEKVLTDDRRLIERVKREIERVIRENEKVIRDARERLR

SEQ ID NO: 16464 - protein, 176 aa, Artificial Sequence; identical to SEQ ID NO: 16463
  Synthetic sequence.

SEQ ID NO: 16465 - protein, 178 aa, Artificial Sequence
  Synthetic sequence.
DEVEKLLRDLEELDRDIERKVRELLKRNKEVLDDIEREVRRLEKELRRIIKEVADVIRKTTDKRTVDKLLKELEKILKEVLDRVRRLLEEAKESLDRSREEIERLLEESKTLVDEVRRAGIDKKEVDKIEKHSRDLIERAKRETDRLLEEAERLMREVVDRVRKILEEAKRLIDEARR

SEQ ID NO: 16466 - protein, 178 aa, Artificial Sequence; identical to SEQ ID NO: 16465
  Synthetic sequence.

SEQ ID NO: 16467 - protein, 187 aa, Artificial Sequence
  Synthetic sequence.
DVEDEARRLEKELRDILREIADDIRKLLEENKELLKESEKDIRRAEKAIEDILDDVRKRITDEKKLREIEKLAEDVKRRVRELLEEDRKSVEDTTRRIKELLREVKELVERVIKRVRELVDEVRKDKKEKLLTEVSEEVKRLADELRELARRVKEEVKKLLDDNRETTDRIRRTVTELLEELKRKTK

SEQ ID NO: 16468 - protein, 187 aa, Artificial Sequence; identical to SEQ ID NO: 16467
  Synthetic sequence.

SEQ ID NO: 16469 - protein, 187 aa, Artificial Sequence
  Synthetic sequence.
SVDETITEVIKRIEDTLRKVKEDADRLDERNKALLEDSKKKIKEVEEELRRILEEVRRKVKDEKKLREIEELVRRVIEEVRRLLDEDRKSVERSSRRIEELARRVEDLVRKVIETIRRLMAEVRREERRELVEEVKERAERLLKELEDLIKKVKEEVERLLEENRKTTEDILKRAKDLARELRKRTK

SEQ ID NO: 16470 - protein, 187 aa, Artificial Sequence; identical to SEQ ID NO: 16469
  Synthetic sequence.

SEQ ID NO: 16471 - protein, 187 aa, Artificial Sequence
  Synthetic sequence.
DAKESIEEVKKRLEKSLEDSERESRKTLEENKDLLRRSREEIKKALDRLKDLLRRAEERIDDKDKLEKVKRLVERVEEEVRRLMREDEKSLEDSLETDKKLLREDEEVVKRIIDTVEELLRRVEEEEREKLVEEVEREVERLLRENEKTSDEIKKTSEELLKRNEETTRRILEEVERLLKRVKEATD

SEQ ID NO: 16472 - protein, 187 aa, Artificial Sequence; identical to SEQ ID NO: 16471
  Synthetic sequence.

SEQ ID NO: 16473 - protein, 186 aa, Artificial Sequence
  Synthetic sequence.
KVEETATRLREEVKRSDTEVHRENRESEDRNKKSDEEVHKTIRDALKRVKDKLDDVRRRRKSRKLEEIERIVRDILRRIEELLRRLHKLAKESRDLVRKTLEELHKLAEDILRRIKELLDEVKDERRDEIVRRVKEEVERLLEEHRRLAKRVRDENRRSTEEHRDLVRKVKREIERLEEELDRAEK

SEQ ID NO: 16474 - protein, 186 aa, Artificial Sequence; identical to SEQ ID NO: 16473
  Synthetic sequence.

SEQ ID NO: 16475 - protein, 186 aa, Artificial Sequence
  Synthetic sequence.
KVEESADRARREVKRSDEEVRKRNTDSREEIKKSDKEVHERIRELLERIRRILDEVRKKRKSRDLDRIRRIVEEIERRIERLLEELHKLAEEILKRVEETLKRLHELARRILEEIKRLLKEVERENRDEIVRRVEDEIEKLLREHRELVKDVERENRRLLEEHKKLVEEVEREVRRMMKKLRDATK

SEQ ID NO: 16476 - protein, 186 aa, Artificial Sequence; identical to SEQ ID NO: 16475
  Synthetic sequence.

SEQ ID NO: 16477 - protein, 186 aa, Artificial Sequence
  Synthetic sequence.
KVEEEIEKLLRHNDELLKEVEKRAREVEERIKRSDEAVHDSIRKLLEDVKRILDEARRRRKGEELEKLEKIARDVLEEIKRLLRELHELAKRILEEVRRLLEEIEKSSRESKERIKRLLEELKRENRDEIVERVEREVRKLDDDDRRLAERVLRRAEELLKRHKELVERVEREVERLLKELEDAVK

SEQ ID NO: 16478 - protein, 186 aa, Artificial Sequence; identical to SEQ ID NO: 16477
  Synthetic sequence.

SEQ ID NO: 16479 - protein, 186 aa, Artificial Sequence
  Synthetic sequence.
KAEDEARRLERHNKELLKEVRKDNTRSEREIEESDKRAHDEIKRLEEEVEEILKDIERRRKSDKLRKIREIVERIRREIRRLLKELHELAKTIKDRVRDTLRKLDESSRRSLELIKRLLREVERENRDEIVERVRRTVKKLDEDDDKLVKDVRKENKDLLRRHEELVREVTERVKKLLRDLREASR

SEQ ID NO: 16480 - protein, 186 aa, Artificial Sequence; identical to SEQ ID NO: 16479
  Synthetic sequence.

SEQ ID NO: 16481 - protein, 183 aa, Artificial Sequence
  Synthetic sequence.
DVEDEVRRAEESNRDSDRKVHEEVRRVLKSNRDSDTKAHRDVEEAKRRLKTELKDIERKRKGRKLDDIRRVVEEIERRVDTLLERIHRVVEETLERIKRALEEVHDVVRKSLEDIRRLLEEVREKRLVDKVRTEIKRLNDEHRKVLKKVRDLVRKLNEDHERVVRDVRREIKRLRDELRETAR

SEQ ID NO: 16482 - protein, 183 aa, Artificial Sequence; identical to SEQ ID NO: 16481
  Synthetic sequence.

SEQ ID NO: 16483 - protein, 183 aa, Artificial Sequence
  Synthetic sequence.
DVEDEVRKMKKELDELLKRAEEEVKRVLESNEKSDDEVHKRAREAEEELRRLLDDVRRRRKSEKLRRIEEVAKRVLDLVRELLERVHKVVEDTKETIRRLLEEIREVVREIEERVRRLLEEIRDKKVVKDVEKKIRDLLTKLREVLRRVRREVKKLNERHEDILREVERLIEELRKRLEDTTK

SEQ ID NO: 16484 - protein, 183 aa, Artificial Sequence; identical to SEQ ID NO: 16483
  Synthetic sequence.

SEQ ID NO: 16485 - protein, 187 aa, Artificial Sequence
  Synthetic sequence.
DIEDEVREAIERLKKLLEDSEREVRESIKRLRDLLREIARESEEANERIKRLLEEIERKVKDEEKLERIREEVERLSETNRRVLEEAADLVRKLIRENEEALEDSKRLVDELIREIEDVLRKIRKDDKEDVRRRLRELVEKVMREIEDSNRKLRKLSKDSEKAVRDAERRNRKLVREIEDRIRKSLK

SEQ ID NO: 16486 - protein, 187 aa, Artificial Sequence; identical to SEQ ID NO: 16485
  Synthetic sequence.

SEQ ID NO: 16487 - protein, 187 aa, Artificial Sequence
  Synthetic sequence.
EVDKEVRKVLKDIERLLEEIERRVRKSIEDLKTELKKIEDESEKANRELERLLREIKDRVDDEKKLREIEELVRRLSDENRRVLDDARRLVKKLIEENAEALKKARDDVRKLLEEIKRVLERIREDDKEDVRRELRELVDKVRKDVERVMKALEDLSRESRREVRRVKEKNRRLVEEVKKRVEDKAK

SEQ ID NO: 16488 - protein, 187 aa, Artificial Sequence; identical to SEQ ID NO: 16487
  Synthetic sequence.

SEQ ID NO: 16489 - protein, 174 aa, Artificial Sequence
  Synthetic sequence.
SEDEDMVRDVKRLIDEVRKLIERVKREVEDLIRRLNELDERVVRTSEELARDVKRLVDAGLSREEVEKVVRESIERTRRLAKELDERNRDVLREVKRLVAEVEKVIRDVLKAVEEKLDSEDVERLKEEIKELLDRARRTIEELERRIRENVKRSRKKIEDLVRRHKKILDEARK

SEQ ID NO: 16490 - protein, 174 aa, Artificial Sequence; identical to SEQ ID NO: 16489
  Synthetic sequence.

SEQ ID NO: 16491 - protein, 174 aa, Artificial Sequence
  Synthetic sequence.
REKEEAVKTVKELIKEVREMVERLHRKNEEMIRTVREVVKELNERNKELIKTVRDLRRRGTDKEDLRRIIEEVLDHIRRSLEELERLAEEVLEHIKRTLEEIERLVREVLDVIKKLVDSEDARRLEREVRELLRDVREKVERNKEKVERLKREVRKRVRDDLERVKRLKEEVDT

SEQ ID NO: 16492 - protein, 174 aa, Artificial Sequence; identical to SEQ ID NO: 16491
  Synthetic sequence.

SEQ ID NO: 16493 - protein, 174 aa, Artificial Sequence
  Synthetic sequence.
SEDERAVREVEKLIKRVEEVVRRLNERNRRLIEEVRRIVEELHRRNEDLIRKVRELAERGVDKRDVERIVREVLKHIRDSLERLERLAREVLKHIRKTLEELTKLAREVLEAIRRLVDSREMERLEREVERLLREVERRVKEDEERVRKLLEEVERLVRRNARKVEELLKEVEK

SEQ ID NO: 16494 - protein, 174 aa, Artificial Sequence; identical to SEQ ID NO: 16493
  Synthetic sequence.

SEQ ID NO: 16495 - protein, 184 aa, Artificial Sequence
  Synthetic sequence.
SEKEKLTEDIERIIDKVRREVERLNEENERLIREVRKRVEKLNRENKEAIKRVEEEVRRLRDRDKSDVRKKVEEAIRKLERSVRESLKEVRRLIEELKRSVEETLREIERLAKELKDILDKVRTDGIDEELVKRLEEKIRELLKRARDLVKEDEDRIRKLLEEIERVNRDDKRKIDKLLEEVRR

SEQ ID NO: 16496 - protein, 184 aa, Artificial Sequence; identical to SEQ ID NO: 16495
  Synthetic sequence.

SEQ ID NO: 16497 - protein, 182 aa, Artificial Sequence
  Synthetic sequence.
KSDEEVRERVERLLREVRRLTREVRRHAKETLDTVAELVDRVRREAERLLREVEELLRRLTDKDVLEEIKKRLDEVLKKLEDIVREVLKEIKRLLDENRRISEETLRRLDDVLRKLEELARRLGVDETEVRDVKRKADEIKEEDKRILEEAEKRHKELLEDLKRLLDRIKEEVKRVREDIKT

SEQ ID NO: 16498 - protein, 182 aa, Artificial Sequence; identical to SEQ ID NO: 16497
  Synthetic sequence.

SEQ ID NO: 16499 - protein, 174 aa, Artificial Sequence
  Synthetic sequence.
REEDEARKRLKELLDRITKLSKEVRDLIREMLRELEESIERTKREIDDLLRRLEEIRRAGVDKKELKKVADDVLKRIEELLKEDKDVADRVLAVIEKLLRDLERLNRDILREVEEIIDSDEVERVKREIEEHLRRSEEDIRRVAEEIKKLVEESRRVIEEAKDRVRRLVERVKK

SEQ ID NO: 16500 - protein, 174 aa, Artificial Sequence; identical to SEQ ID NO: 16499
  Synthetic sequence.

SEQ ID NO: 16501 - protein, 174 aa, Artificial Sequence
  Synthetic sequence.
SEEDDARRKVEELLRRDKKVVDEVRDELRKLLEELRRLSEEVEKLIRKLEKELREVRKRGEDKDVLRKVVEDIKREVTRLLKELEEANREVEKRVKELLDRLRRTTEEILKEIRKIIKGETVKKVEDEVRDSLRRAKKIIEDAARAIRKHLEESKRRIEEARKRLEELLKEAED

SEQ ID NO: 16502 - protein, 174 aa, Artificial Sequence; identical to SEQ ID NO: 16501
  Synthetic sequence.

SEQ ID NO: 16503 - protein, 175 aa, Artificial Sequence
  Synthetic sequence.
SREEEAKKEVKRLLDELKKLSDDSRKRIRESHERLKRVIEEVRREAERSHEELERVIRRGEPREVIREVVRRSRELIKKLLKRLEDVARESKRLIEELLKRNKEMVDEIKKVIKDVVESEKDVRKVDRDVDEILKRSEDIIRKVKEDSERLLKEVRERIEEMKKRTDDLLKEAEK

SEQ ID NO: 16504 - protein, 175 aa, Artificial Sequence; identical to SEQ ID NO: 16503
  Synthetic sequence.

SEQ ID NO: 16505 - protein, 177 aa, Artificial Sequence
  Synthetic sequence.
RKEETLKRAEEKSKETLERNKRLLERIEEESRKTLEKNKDMLRRVKKRVEDLLREIKRDKPEAEEVRKRVEDLLREVKRSSERSLREDERLLREVKESSERSLKRDKDLLDRVKELIKEVPEEELRRVIEDVLRESEKLHREDEELARRVLEESERLHREDEELARRVEKEIRELKK

SEQ ID NO: 16506 - protein, 177 aa, Artificial Sequence; identical to SEQ ID NO: 16505
  Synthetic sequence.

SEQ ID NO: 16507 - protein, 172 aa, Artificial Sequence
  Synthetic sequence.
SLDELAKKAKEDSERSVRTDEKRLEEIARRIKELIKENEDLLREVKKEIDRLIEEIKDDRVLKEIERLLREVEKHVTRSSEEIKRLLKEVEDHSRESLREDEKLLEDVADMVKRVDEEEARKLLEDIKRRSEELHKRNDELAREVEKRIRKLIKENRELAEEVRRRIEELRR

SEQ ID NO: 16508 - protein, 172 aa, Artificial Sequence; identical to SEQ ID NO: 16507
  Synthetic sequence.

SEQ ID NO: 16509 - protein, 172 aa, Artificial Sequence
  Synthetic sequence.
RTDETVKKIEEDSRRSLEEDRKELEEVERRSRESIKENERLLREVAERIKRLIEEIDKREVLDEIRKLLREVEKHVRDSSREDEELLKRVKEHSERSLDEDRRLLEEVADLAKRVDEKTLKELADRIKERSEELHRRNEKLAREVLERSKELIKRNEELARRVIEEIKKLKK

SEQ ID NO: 16510 - protein, 172 aa, Artificial Sequence; identical to SEQ ID NO: 16509
  Synthetic sequence.

SEQ ID NO: 16511 - protein, 181 aa, Artificial Sequence
  Synthetic sequence.
DVEETLKTVEDESRKTIETLRRSLRKSEEESKRSIDRLRESLERSREEVERLLREIERDKPEAKDVVEKVRKLLEDVRREYERVLEDDRRLADDVRRVYEEVLERDKRLLDEVRKEAKRDTREEAVEKLKKLAEDVRRESEELRRELEELSKDVRRVSEELERRLRKLSEEVKKRIKDLKR

SEQ ID NO: 16512 - protein, 181 aa, Artificial Sequence; identical to SEQ ID NO: 16511
  Synthetic sequence.

SEQ ID NO: 16513 - protein, 181 aa, Artificial Sequence
  Synthetic sequence.
SVEKILRDVEDTSRRTIEELKRSLEESKKTVTKLLEENKDLLRRIKEDVRRRLEEIKRDKPEMKEVVERVERLLKEVEDSADRTTKEIKRLLEELEKVYREVLETDKKLLDEVRKVAEESTSEEAVERLKELAEEVKRVSKELLEELRKISEEIERRIRRLIEENKELADRVREEIERLKK

SEQ ID NO: 16514 - protein, 181 aa, Artificial Sequence; identical to SEQ ID NO: 16513
  Synthetic sequence.

SEQ ID NO: 16515 - protein, 179 aa, Artificial Sequence
  Synthetic sequence.
DKVDRVIEEARRILERLRKRVTDVVRELEEINRRLKREVDESVKEVDEILKKLEERVRKRKESERLLEDIKETLERVLRKNDDVVRKVEELVKRSDEKLNKVVEEIKRELDEVLKEIDRLEVRKELVEKLDREVKRLLKEARELSEENRRRSKKLLDELRKSSERIREKVEDLVRRIRK

SEQ ID NO: 16516 - protein, 179 aa, Artificial Sequence; identical to SEQ ID NO: 16515
  Synthetic sequence.

SEQ ID NO: 16517 - protein, 177 aa, Artificial Sequence
  Synthetic sequence.
SEEEAAKRRIDELLKRLKEVSDKVKEDIDELLKDLERRSREVVEEIKKLLEEVKDRVRKRREEEMLKRLEEELARVLREAERLIDEVDKLSEEVLRRVEELVREVSKLIKEVLERVRRDIDSERLKRVTEEAKRLHEENKKLLDDVRREARRLNEDNRRLLDEVRKRVEEVLRRIRK

SEQ ID NO: 16518 - protein, 177 aa, Artificial Sequence; identical to SEQ ID NO: 16517
  Synthetic sequence.

SEQ ID NO: 16519 - protein, 176 aa, Artificial Sequence
  Synthetic sequence.
DEDRRALEEVRRVLEEDKRVSKRSRDLIEKVLREVEELIKEVTKRAEDVLRRVREIIKTSGGRVEEVDKVIRELERTVDKLLRDMEEVIKEVEKLVRKVLRENRETTDRVREVVERIVKVRELVKKVEDEIKESEDESEDLIRRADEAVKRLRKRVRDVIEKARRDLEKIVTDAKK

SEQ ID NO: 16520 - protein, 176 aa, Artificial Sequence; identical to SEQ ID NO: 16519
  Synthetic sequence.

SEQ ID NO: 16521 - protein, 184 aa, Artificial Sequence
  Synthetic sequence.
SIEKLIEDVRREVERIEEESKKLVKKAREDVKRSHDHSKRLMEEATRRVRDILRRAEEMPKSEDELEELRRLVEEVEDRIRRLLKESADVDRDVKRLIDEALERNRKLVEDVRRRLDELKDRLRRKELVDDARRRVEELLRRLEDSLRKSERLVRELLKRSKEVDDRIREEVKRLLEELDDRRR

SEQ ID NO: 16522 - protein, 184 aa, Artificial Sequence; identical to SEQ ID NO: 16521
  Synthetic sequence.

SEQ ID NO: 16523 - protein, 178 aa, Artificial Sequence
  Synthetic sequence.
DTEEILKRIEEEIRRLLEENEKLLRDAEDTVRKSLEEHERILDEVTKRIRKMLEEIARTDRPGVEDVLREVRDLLRRVREVAKRVIDDNRRLLKEVRDSVKETSEEIKRLLDEVRDLMRKVDDETLKRLAEEVLREVERLLRENERLIREVERRADKTVKDLEKLIEEVERRIDELKK

SEQ ID NO: 16524 - protein, 178 aa, Artificial Sequence; identical to SEQ ID NO: 16523
  Synthetic sequence.

SEQ ID NO: 16525 - protein, 178 aa, Artificial Sequence
  Synthetic sequence.
DSKEIIDKVREDIKRADEENKRLLEEVRDRIRKLLEENETLLKDSERKARELLEELRRKDSPGVEEVLKRIRKLVEDDKESVDRSTKTIKKLLKEVEDSVRESSKEIERLLREVEDIVRKVPEEDLKRLAKEVKDRIRELLERNRELIKEVEKRVRRLLDENRKSSEEIRKEVEDRKR

SEQ ID NO: 16526 - protein, 178 aa, Artificial Sequence; identical to SEQ ID NO: 16525
  Synthetic sequence.

SEQ ID NO: 16527 - protein, 174 aa, Artificial Sequence
  Synthetic sequence.
SDEERALKLVEDVIRDVKRLNKRDRELIEKVERDIEKLLEDHRRLVDEVRRRVKELEDKVEDKEEVLKRIKDLLDEIHKLVEEILRRIKKLLEDIEESSRRSLEEIRRLLEELRRRIDSELLKEVEERIKKLLKSNKDLLREVEERVRRALERVKRSDEEVHKMARDALRRVRK

SEQ ID NO: 16528 - protein, 174 aa, Artificial Sequence; identical to SEQ ID NO: 16527
  Synthetic sequence.

SEQ ID NO: 16529 - protein, 174 aa, Artificial Sequence
  Synthetic sequence.
SEDEDAERLVEEVIRRVKELLDTHKRLVEEVERKIRELDKKDAELVKEVEKRAEDLRRKVDDKDDVLRKVEKLLRELEESSKRSLEEIKRLLEDIHRLVKEIEKRIKELLDELRRRIDSELLERAEREIRRLLREVKESDKEVHRRVRRMLEHNKDLLRRARDSIKKVLDEIRR

SEQ ID NO: 16530 - protein, 174 aa, Artificial Sequence; identical to SEQ ID NO: 16529
  Synthetic sequence.

SEQ ID NO: 16531 - protein, 174 aa, Artificial Sequence
  Synthetic sequence.
SEREDAERVIERVEREIRELNRRDEELIRRVEKEIRRMLEEHKTLVKEVTRELDRLRREVSDKEEVLRRIEELLRRIHELAKEILKRIKKLLKDLEESSKRSLEEIKRLLDEVRKRIDSEDLKRVDKKVRDVLRSNKELLDEARKRITKVLEEVRRSDEEVKRRAEKVLDEVRK

SEQ ID NO: 16532 - protein, 174 aa, Artificial Sequence; identical to SEQ ID NO: 16531
  Synthetic sequence.

SEQ ID NO: 16533 - protein, 174 aa, Artificial Sequence
  Synthetic sequence.
SEEEDAERAVREAAELAKKANKEDEELARRAAELAKKALREHEELVERAARLADEAEKKAEDKDTALKLIKEAADRAHKAARDALRVIEDAARKADKSSKESLDLIREAADDARKRADSERAKKAEDDARKAAEDNRRLAKRAKEEARRAAEEVKKSDKEAEERARRAAERVRR

SEQ ID NO: 16534 - protein, 174 aa, Artificial Sequence; identical to SEQ ID NO: 16533
  Synthetic sequence.

SEQ ID NO: 16535 - protein, 173 aa, Artificial Sequence
  Synthetic sequence.
SLERLLEEVTRRSEETVRTNEEILRRAADEVRKAIESNKDLLRKIKKEVDDVKRRLKDEKALRDIERALDEVRRLVEETIERIRRMLERVRKLAEETIEVDRRLLKKVEDLVRRGLPEESVRTIIEEVERTSREMNERLKKIIDEVRRTIEELNKDLKRILEEIRELVKRLET

SEQ ID NO: 16536 - protein, 173 aa, Artificial Sequence; identical to SEQ ID NO: 16535
  Synthetic sequence.

SEQ ID NO: 16537 - protein, 173 aa, Artificial Sequence
  Synthetic sequence.
SLEETLEEVDRKSKETVKRLKELLDRIRERVEEAIKSNEDILRRIKAEAEEAERRLKDEEMLKEIRRLAEEVEKLVRKTIEEIKKLLEDVKELVERVIRRDKEVLEEVRRLVEKGLDESEVERIIRELERVSRELMELLKKILEEVRKRIKELNDRLEEILRRVRKRIRELEQ

SEQ ID NO: 16538 - protein, 173 aa, Artificial Sequence; identical to SEQ ID NO: 16537
  Synthetic sequence.

SEQ ID NO: 16539 - protein, 173 aa, Artificial Sequence
  Synthetic sequence.
SLEELLERIKRDSDRTVRELEELLERAEEISRRTEKSNEDSLRRSTKEVKEAEDRLKDEDALKKIRDLLERDRKLVEDTIRDDRRVLDEVRRLAEEVIKRDKDVLETVSRLVERGLPEEVVKKMLDELRDRSEKLLRTLRDIIRRAKERSDDLNRKNKESTEKVREDIRRLEQ

SEQ ID NO: 16540 - protein, 173 aa, Artificial Sequence; identical to SEQ ID NO: 16539
  Synthetic sequence.

SEQ ID NO: 16541 - protein, 173 aa, Artificial Sequence
  Synthetic sequence.
KLEELLKRIAEESKKTVEELEKLLEEVERISKKTVEELEDSLRRSEEDAKEAEERLRDEDMLRKIREMVKRDAELVKKVIEEDKKVLDDVRRLAEEVIRADEDALRKVEKLVRDGLPEDDVRRILEEVRRLSEELKTRLRKILEDLRRLSEKLKRENEESTKTVRKVIEDLER

SEQ ID NO: 16542 - protein, 173 aa, Artificial Sequence; identical to SEQ ID NO: 16541
  Synthetic sequence.

SEQ ID NO: 16543 - protein, 173 aa, Artificial Sequence
  Synthetic sequence.
SLEELLKRIKERSEETVKRLEDLLKRVREDIDRAIKELKKSLDDSRKTVEDIEREIKDEDVLRRIRKLLEDDERLVREIIKEVKKLLKDVEELVKEVIERDKKLLEEVERLVRKGLPEEKVKEIAEEVRRRSEKMLEELKKLVDEVRKRLEDLRKRNEDSTEEMKKRVEEEKR

SEQ ID NO: 16544 - protein, 173 aa, Artificial Sequence; identical to SEQ ID NO: 16543
  Synthetic sequence.

SEQ ID NO: 16545 - protein, 181 aa, Artificial Sequence
  Synthetic sequence.
SEVEKVIKDNKRSVDEIRKTLKRVLERNEKTLRENEKKIRDIIAEVDKRLKDLEREIDDRDEAREIKKEVKKLVDDLRRDAEEIVKESARLSKELKEKLERIVREVEELSRRLSEEAKKGRDDKAIKEIEEEVRRVDDRVRKLVEKLDRDIKEVDDRSRKLTDDLRRKVEEVLRRIKETVT

SEQ ID NO: 16546 - protein, 181 aa, Artificial Sequence; identical to SEQ ID NO: 16545
  Synthetic sequence.

SEQ ID NO: 16547 - protein, 174 aa, Artificial Sequence
  Synthetic sequence.
REVEEIEKELRKIIRDLKELLRELRERLEKLDRDLKDLLRRLREENREILDRLRKEPKDKDVEKKIEDLLRELKKKNKEVLERIKEIMERSRREVEKVITTIDELIKRVKEKVRRNNLDEKVIRDADRMAKELKKDLRKVLEDNRRTVEKLKRDLEEVDKESDEEARKLREEIR

SEQ ID NO: 16548 - protein, 174 aa, Artificial Sequence; identical to SEQ ID NO: 16547
  Synthetic sequence.

SEQ ID NO: 16549 - protein, 180 aa, Artificial Sequence
  Synthetic sequence.
SESEKIEREIRKLIDDSRKNSERIRREIEKLIRDSEETSKEIKKEIEDLLRELKEMLDEIKKRDDDRLKEELKKRADDVERRIRELIKKNKDRLDEILERVERLVRENKERLDKIEEDIRRKGVPEEVLRRAKKALEEDKKRNDEVLDEVRKALEEDKKRNDKVLEDARRVIKKIKDELK

SEQ ID NO: 16550 - protein, 180 aa, Artificial Sequence; identical to SEQ ID NO: 16549
  Synthetic sequence.

SEQ ID NO: 16551 - protein, 180 aa, Artificial Sequence
  Synthetic sequence.
KDEETIRRRIEELLKRSEDNSERIRRTIRELLERSKKLSEEVRKRIEELLKRLDEKVKEIRKREDERLVRDAKRELERILDEVRRLVEKTKRDLEDMLRRIKELVRRNKEEIDRMLEEIRRSGVPEEVLKEAEKRLREDKKRNDEVLKRVTEAVEEDKKRNDDVLEKVERAIREIARKLD

SEQ ID NO: 16552 - protein, 180 aa, Artificial Sequence; identical to SEQ ID NO: 16551
  Synthetic sequence.

SEQ ID NO: 16553 - protein, 174 aa, Artificial Sequence
  Synthetic sequence.
SEEEKVIRDLERLLEENEEHSRDVERKLRESDKRLREMVKKVSDEIRKLDEEVEELLRRGTDSDRLRKVLEDILKRSKELADKLKKDIDKSLDEVKKLIDRDDEHVKDIEKKVRELRVSEDALRRVKEALERSKKRLDKVLKDHEDSVRELKKEIDDVLKRNEETVREIEKRAR

SEQ ID NO: 16554 - protein, 174 aa, Artificial Sequence; identical to SEQ ID NO: 16553
  Synthetic sequence.

SEQ ID NO: 16555 - protein, 174 aa, Artificial Sequence
  Synthetic sequence.
EEVERVKRELERLLEENDEHSKEVEKRIRDLDRKAEELLREIEERLRRSDERLKRLLERGTDEDELRKRIKKSEDEVRELIKKLTRVLEEILKRTKELADRDKKHVRDVEKRVRELDVEERVLKKVEDDLRESEKRVEEVLRKNEETVRRLKEELRKVLEDHKRTVEELRRRLT

SEQ ID NO: 16556 - protein, 174 aa, Artificial Sequence; identical to SEQ ID NO: 16555
  Synthetic sequence.

SEQ ID NO: 16557 - protein, 174 aa, Artificial Sequence
  Synthetic sequence.
SREEEVEKRIREVLKRLEELLADVERRARELNRRLEKVVRDVKKEIEDLDRKLRKLLKDGVDSEELKKVLKEVKKRSTELAKELEELIREVNRRVEKLVRDLREAIKRVEEEVRRLDVREKVLKDVTDMARELERRLEEVLRKHRKSSEDLKRRIDEVLKRNEETLREIDRRLN

SEQ ID NO: 16558 - protein, 174 aa, Artificial Sequence; identical to SEQ ID NO: 16557
  Synthetic sequence.

SEQ ID NO: 16559 - protein, 177 aa, Artificial Sequence
  Synthetic sequence.
SEREKAKRELERLLEEDRKHLKDVERELKELDEEDERHLREVEKELKELDDRAKEALDRRPDQKDKLRELLKRIKDRSEELVRRHEETNKRIEERTKELLDRHEESNRRIKKRLEELKDVVEEEVLKEVKRLSEKSKTDLEKIVRDNKRSSDDSRRELERVIRENEETLRRLAERIK

SEQ ID NO: 16560 - protein, 177 aa, Artificial Sequence; identical to SEQ ID NO: 16559
  Synthetic sequence.

SEQ ID NO: 16561 - protein, 177 aa, Artificial Sequence
  Synthetic sequence.
KEEEEAKKELDDLLRRLKDLYRRIREELERLDRRLEEAYRRIKEDLKRLDEELRRLLEKDRDDRERIETLLEEILRRSEDLVRKLKKLNDEINTRTEELLKRLKKLNDDINKRLEDLRDVIDEKVIRDVRKASRDTEREIRKVAEDNRKSSEDSRRKLEDVLRKNKETLDRLRDELR

SEQ ID NO: 16562 - protein, 177 aa, Artificial Sequence; identical to SEQ ID NO: 16561
  Synthetic sequence.

SEQ ID NO: 16563 - protein, 177 aa, Artificial Sequence
  Synthetic sequence.
DEKETVEEELRRLLEELKKHIEDTERKLRKLDTDLEDVYRRIEEELRRLLEELKKMLDDRKEDREELRRLLEEIERRIRRLAEELKKLNKDINDTTKDLVRKNERLLREILKRLRELRDLVDEKVLRDVEEALRRAKKRSDDVVRENEKSSRRSEERLERVLRDAKRVLKELKERID

SEQ ID NO: 16564 - protein, 177 aa, Artificial Sequence; identical to SEQ ID NO: 16563
  Synthetic sequence.

SEQ ID NO: 16565 - protein, 185 aa, Artificial Sequence
  Synthetic sequence.
SELEEVLKRVAEVVERVSREDEKVNRKNDAAVKKVTKDDRKVLEDLERKLRELEKDAKDRGVDKELVDRIREKIETIKEEIRDLNKKLKELIEDTLRDNRRLNEEVRRKVERILEKLEEIRRRGSDEDVIRRLEKEVRDVLKDWEEKSKEAEEKNKTVNKRWEDESRRLKKKVDRLIEKIKEDLR

SEQ ID NO: 16566 - protein, 185 aa, Artificial Sequence; identical to SEQ ID NO: 16565
  Synthetic sequence.

SEQ ID NO: 16567 - protein, 177 aa, Artificial Sequence
  Synthetic sequence.
RSEELLREIEERIKRLKEKNEELVKEIRRRARELEREDDRAKKEIDDLARKVEEKIRRTIRDKDRARELEKRLRDILREIEDLSRKSEKAIRDVERKVEELSEENKRLIEEIADRVRRKRMDDDVVREVRKLIEELDRHLERLVEEVRRVVKELLEISKEILDRVREVITRLREEVK

SEQ ID NO: 16568 - protein, 177 aa, Artificial Sequence; identical to SEQ ID NO: 16567
  Synthetic sequence.

SEQ ID NO: 16569 - protein, 179 aa, Artificial Sequence
  Synthetic sequence.
SEVEDAVRKIRELAKEIARAIDELLKEHEELIRTVADALEKLVRTSDKLAEDIARVIDGGVSEEALKEALKRWREATEEVRKRLEDVLRRTKEHLREVAETIREALERLERAIRRVEEEGTIGRELLEELKRILEDLERRAKEIVDRARELNKRAEDEIRRLIEDSKRKLEEIRKRIEE

SEQ ID NO: 16570 - protein, 179 aa, Artificial Sequence; identical to SEQ ID NO: 16569
  Synthetic sequence.

SEQ ID NO: 16571 - protein, 179 aa, Artificial Sequence
  Synthetic sequence.
KEAEEAVKRLRDLVRRVEEETKRLLRESRESLKTLEEITDRLLKRSEESVKEIEKVITRGRPEKDVKDALDKHRDTNREVLKRLTDLNREHKELNEKVARDLERIDEELKKALDEVTRRGTIGRELLTEVTKLIKDHHDKVREILRESDKELDRHHKDVERILERSKRELERLEDEVRR

SEQ ID NO: 16572 - protein, 179 aa, Artificial Sequence; identical to SEQ ID NO: 16571
  Synthetic sequence.

SEQ ID NO: 16573 - protein, 171 aa, Artificial Sequence
  Synthetic sequence.
SREELLKEIKKKIDDIKRENEKLLRDIERLIRELEKRDKELLDEARKTSEELVRRAGTEDEKVKKLLEESERLIEEVERVSREMVERARRLLERVKRASERLTRKLEDILRRKGADRDVVRDVDRILTEWKKESEDLVEEVKELIKRWKDTSEELVRRVRELNERIDRETR

SEQ ID NO: 16574 - protein, 171 aa, Artificial Sequence; identical to SEQ ID NO: 16573
  Synthetic sequence.

SEQ ID NO: 16575 - protein, 178 aa, Artificial Sequence
  Synthetic sequence.
SEVETVEEKVKKVIEDLRRLLKEVRDRNRRIIEEIKRLLERVAEKNKRIVDEIRDLLRRRSTEEVLKDIERLLREAHETNKEVLERVKRLADEAHRRNEKVLEEIKRLADTIDKELKDINVDEDIIRRIDELFREILKEVKRLNEESKRRLEKLEEDIKRLDDRSREEAEKLRDAVRR

SEQ ID NO: 16576 - protein, 178 aa, Artificial Sequence; identical to SEQ ID NO: 16575
  Synthetic sequence.

SEQ ID NO: 16577 - protein, 178 aa, Artificial Sequence
  Synthetic sequence.
SEVEKVARDVEEVIRTSEDKTRKLEKRNKDIIREIKKLLDDLARENKRIADEIKRKLDERREERVLEEIERLMRKLHEDNKRVLKRVDELLRKLHDENRRLNEENKELAERVEDTLRRKNVDKRLIDEIRREMERSHRRDEEVNEKSKREADKLRRDVEKLDEDSARELKKLEDEVRT

SEQ ID NO: 16578 - protein, 178 aa, Artificial Sequence; identical to SEQ ID NO: 16577
  Synthetic sequence.

SEQ ID NO: 16579 - protein, 178 aa, Artificial Sequence
  Synthetic sequence.
SEVERVERELDKVITDLRRLLDDLKRKNEELVRRIRELLKKVKERNKKIVTEIDDLLRRRKTEEVLKEIKKLLEDAHRDNTEVLKEVRRIVKEAHDLNKKVLDEIKKLLRELLEDLKRLNVDERIIRRIKELADRIEERVKELNERVREEVRKLEEDIKKLDDESREEARKLEDKVRQ

SEQ ID NO: 16580 - protein, 178 aa, Artificial Sequence; identical to SEQ ID NO: 16579
  Synthetic sequence.

SEQ ID NO: 16581 - protein, 177 aa, Artificial Sequence
  Synthetic sequence.
SSEEIRREIERESEDTRRRLDRVLEDIERLSRETKEHIKESLERVRREHDRLRRELERKAKDKDTVTELAKHIKRSLEEVERIHEELLRDDERVLKEIKEIADELRRRDDEVVKRIRDREMTEEVRREVRKLIEESRRAIDEVKRRVEELIKESRDRNRRIEERVKELVKENAERIR

SEQ ID NO: 16582 - protein, 177 aa, Artificial Sequence; identical to SEQ ID NO: 16581
  Synthetic sequence.

SEQ ID NO: 16583 - protein, 177 aa, Artificial Sequence
  Synthetic sequence.
KSEEIRRKIEEDSRRTKKELDDILDEIRKLAEKVKKEIEELLRKVRRRHEDMKRRLREKVKDKDTVTELEKHIRRSLDEVRKLAEELKKKIEEVKRELKKLADELRRRDDEVVKRIRDKPVTEEVAKEVKKLIEESRKLLEELKDTVRRLIKRLKELLEELERRVEELIKENEERIR

SEQ ID NO: 16584 - protein, 177 aa, Artificial Sequence; identical to SEQ ID NO: 16583
  Synthetic sequence.

SEQ ID NO: 16585 - protein, 177 aa, Artificial Sequence
  Synthetic sequence.
RSEDILREIEDLSRETKEKIDEILERIRKLAEEVKRHIDESLKEVRRRHEEADRELDEKMRDKDTVKRLKEHIRRSLTEVEDLHRKLREEVERVLRKVERDIDKLRETDDRVAKRIRSKRADEEVAKEVRDLIRRSEDLLRRILETVDKLIKELRKLNEDILERVRKLIKKNKDDIK

SEQ ID NO: 16586 - protein, 177 aa, Artificial Sequence; identical to SEQ ID NO: 16585
  Synthetic sequence.

SEQ ID NO: 16587 - protein, 177 aa, Artificial Sequence
  Synthetic sequence.
KSEEIERRIRERSRETRRELEEVDKKVKKRHTELREHLKRSLKKVKEDHDDLKRKLEEKIKDKDTVRRLDEHIKRSLEEVKRLHEELERHLTTSLRKVEEEAKRLKKRDDDIERRIESKPMTEEVEEEVKRLIEESKELIKRLEEEVDKLIRDNKKLNDDILRRVKRLAEENDERIR

SEQ ID NO: 16588 - protein, 177 aa, Artificial Sequence; identical to SEQ ID NO: 16587
  Synthetic sequence.

SEQ ID NO: 16589 - protein, 177 aa, Artificial Sequence
  Synthetic sequence.
SSEDILRDIERIARKLREDLKRVLKRVKELSDDTRREIERLVEEVERIHERLRRELERKVSDKDTARRLKKHIDDSLREVRKLAEDLERTDKKVLDEIRKLAEDLKRKIDKIVEDVRRKRMDERVADEVRKLIAELEKLIRDLKRRVDELIRRSRELLERIRDRVRKLIEENKRAID

SEQ ID NO: 16590 - protein, 177 aa, Artificial Sequence; identical to SEQ ID NO: 16589
  Synthetic sequence.

SEQ ID NO: 16591 - protein, 179 aa, Artificial Sequence
  Synthetic sequence.
SKVEEAKREVDRVIKELREDIKRVEEEVDKLIKDHEKLNKELEDESRKLAERVEKLRRDGVPREDVRRALDDWRRRSEEALRRSEESLKRIKERVRELLERIRKLLKEIDDRVEKLREAGVIDEKIVRDIKELLRDLRREVEKVIERIDRLIKRLEEESRRLFEESEKAIRELKRRVDK

SEQ ID NO: 16592 - protein, 179 aa, Artificial Sequence; identical to SEQ ID NO: 16591
  Synthetic sequence.

SEQ ID NO: 16593 - protein, 179 aa, Artificial Sequence
  Synthetic sequence.
KKVEEAKKEVKEMIRRHRERNKEVEKEVKDLARKHEKENRDVAETSKRLAEKVKKLRDDGVDRKDVRRVLEDWRRRSKELLDRSRKSLEEIRKRVEDLVRESKESLKRIEDRVRELEERGVIDEEIVKDIKREIEELEDESRRILEEIREDIDRLRRRSEKLFEDSRELIERMKREVDR

SEQ ID NO: 16594 - protein, 179 aa, Artificial Sequence; identical to SEQ ID NO: 16593
  Synthetic sequence.

SEQ ID NO: 16595 - protein, 176 aa, Artificial Sequence
  Synthetic sequence.
DEIEKVRKRAEDLNREDKRLSERAFEESKEVVEEHRRLSDRARRESDRVVEEVEKTLKDKREKKEDLEKLLRDWKRISEKLKEESDKSLKDWEDRTRELMERSKKSLDELEEVLRRIPVDRKILEEIRKAIDRNRDENRRLVEESKKELDELRKEDEELVERSKRKLEELDRRAKK

SEQ ID NO: 16596 - protein, 176 aa, Artificial Sequence; identical to SEQ ID NO: 16595
  Synthetic sequence.

SEQ ID NO: 16597 - protein, 176 aa, Artificial Sequence
  Synthetic sequence.
SRIETVKDELRRIAEDVRRALEEIEERLKDLNRRDEELTKRIEDTSRDILRRVEEVLRRNREKKEEAETLLRDWDRVSKELKKESDRSLEELRREIERLREEIERLLRELDKLIKDIDIDEKILKEVADRLRELKRRAERLIEEVTRLLKENEKRNKEVVDTSREALREIRDRVRK

SEQ ID NO: 16598 - protein, 176 aa, Artificial Sequence; identical to SEQ ID NO: 16597
  Synthetic sequence.

SEQ ID NO: 16599 - protein, 177 aa, Artificial Sequence
  Synthetic sequence.
SKEDILREIEKRIRKIEKEAEELLRESRKILEELEERDRRLLERVKREIDRLLEETGEDDDLRRLLRELEKALEDMERVSRTVLREIERLIKESEDNIRELIERLEELLREVERRVRDEELLRRVERELKKLIDEVRKVLKDNFDRNRELAKEWEDLSRELFKRAKELIEKVEEASR

SEQ ID NO: 16600 - protein, 177 aa, Artificial Sequence; identical to SEQ ID NO: 16599
  Synthetic sequence.

SEQ ID NO: 16601 - protein, 177 aa, Artificial Sequence
  Synthetic sequence.
SKEDILREIKKRIEEIERDARRLLEESKRILDELRKTDEKLLRESEERVEELERKSGRDEKVEDLLRRLKRLIDESKKDSDRMLKEAKKLIEDSKRNIEELLKELRRLLERVRREVRDEELLKRVMEELRELIERVERELRRNARENRELARKWKKLSEENKKKNDDLIREVDEASR

SEQ ID NO: 16602 - protein, 177 aa, Artificial Sequence; identical to SEQ ID NO: 16601
  Synthetic sequence.

SEQ ID NO: 16603 - protein, 174 aa, Artificial Sequence
  Synthetic sequence.
DEKERIEEEIRRILEELERKVDEAREEIKRMDEELKRRIEEIARRSRELDDELRERVDKDKDKDKLEKIVEDILRTSRKLIEDLKKLIDDILRRSKELVDRLRELVDRVRERVERLPVDEEVRKEAERVLRKIEEDIDRVLRENEDSVRKLRTEIDRVEEENRRSAKRIRERLK

SEQ ID NO: 16604 - protein, 174 aa, Artificial Sequence; identical to SEQ ID NO: 16603
  Synthetic sequence.

SEQ ID NO: 16605 - protein, 176 aa, Artificial Sequence
  Synthetic sequence.
DEVRDVVTRIRDLLRRIKERLEELTERIRRLLEKIHKTTEDLARRNRKLIDEIRKEIDKGVEKEEVDKMIEELKKHTDETLRRIEELNDRSDKLVKRVLEEIERLIREAEKEVKKAERVIPEDVKREVKELLDKIREDLERVREEAKRSNEENRKRLEEVVEESERLLEELKRRST

SEQ ID NO: 16606 - protein, 176 aa, Artificial Sequence; identical to SEQ ID NO: 16605
  Synthetic sequence.

SEQ ID NO: 16607 - protein, 180 aa, Artificial Sequence
  Synthetic sequence.
DEVREVLKELKKVLREIEKAVRDVLEEDREMHERIARKVKKVLDENKKSLDDLRRKVDSEKLKEIEKVVEDTLRELKELLDRARELNERTKRRLEKLLDEIRKVIKRLLEELDELRRRGASEKKLKEIADKIRELLERLKDRLEKIAREIRDVNRKLDEDLEDIVRRIRDVDKKLDDKTK

SEQ ID NO: 16608 - protein, 180 aa, Artificial Sequence; identical to SEQ ID NO: 16607
  Synthetic sequence.

SEQ ID NO: 16609 - protein, 188 aa, Artificial Sequence
  Synthetic sequence.
SVLEEIEREVEEIRRRIEKVLKELNDDDRRVIEDSKRLNEKLEKEVRDIERKARDLLRKLKDTDDDREMKKILREVEKMVEELKRRSDEVVKRTRRVVDRLREKNKDVLRRIEKKIRELKDKIEKISAPREELEKLKRRLDEELDRVREKVEENIRRTDKAVEDSERENERLKRELDEKVKRIRDELR

SEQ ID NO: 16610 - protein, 188 aa, Artificial Sequence; identical to SEQ ID NO: 16609
  Synthetic sequence.

SEQ ID NO: 16611 - protein, 171 aa, Artificial Sequence
  Synthetic sequence.
SDEEDVERLVKELIDRVRKTDAELERKVDEVIRELKEVIKRIEDHSRDSIRKLRNEPMTEDVLRKAEEVHERNRDLLRKISERIKKLLEDLNKESRKNEDRVRRLVEELERRAKTLRELIKRLRDAVRESEKENKRINERLRRVIEKAKRDLEKILEEDRRVLEEMAERAK

SEQ ID NO: 16612 - protein, 171 aa, Artificial Sequence; identical to SEQ ID NO: 16611
  Synthetic sequence.

SEQ ID NO: 16613 - protein, 181 aa, Artificial Sequence
  Synthetic sequence.
SEVETIKREIDKLMKELTEKIKRIKEEDDKVHEELKRAVDRSRERLEEVLKELRDRGVPDKKLRELEKLIEELKRRNDDLLRKLKEVNEKTREDLERLLRDLRRLLKELRERLKELKDRNSDEKEIRDLMREIREVAERAKKRVDELLERIRRINTKLKEELKELHKRTEDLIKKAKEEVN

SEQ ID NO: 16614 - protein, 181 aa, Artificial Sequence; identical to SEQ ID NO: 16613
  Synthetic sequence.

SEQ ID NO: 16615 - protein, 181 aa, Artificial Sequence
  Synthetic sequence.
KEVEEIDERLKRVLEELRRMLEESRKEDERVHDELRKEAEKIKRELDKAVEELRARGVPKDVLRELKRLIDELRKEIKDLLDDLRRVNEETLRENERLLRELEKLVRELEEELKKVKDERRDKKVIDDLLRKIEKLIREMKKRLKDLHEETKRINEELERRLRDLERRVRDLLRRAREEAN

SEQ ID NO: 16616 - protein, 181 aa, Artificial Sequence; identical to SEQ ID NO: 16615
  Synthetic sequence.

SEQ ID NO: 16617 - protein, 181 aa, Artificial Sequence
  Synthetic sequence.
SEIERIKEEDEEVHKRLKEINDRINKEDKDVHDKLRDEARKIEERLRRVMEELRANGVPKSLLDEARRVIDELRRKLEKVLDELEKLNRKTEEDNRRLHEETRKVNEDTKRKLKEVKDNRSDEKVIRKLLEEIRRINEELERRNRKLMKDIREINERAEEKLRRLAEEIEELIKKLKEEVK

SEQ ID NO: 16618 - protein, 181 aa, Artificial Sequence; identical to SEQ ID NO: 16617
  Synthetic sequence.

SEQ ID NO: 16619 - protein, 181 aa, Artificial Sequence
  Synthetic sequence.
SEVEEIKREDDKVHEDLKKAADDIRKRDEDVNRKLTEAIEEIRREVDKALEDLERRGVPKDLLDRARRLAEELRRRLKELLERMHKVNEDTKRLLEELLRRLEEVNRRTRKELEDVKRRREPEEVIRRLMEKIRRINAELRKALKRLLEEIEDINRKLEEEVKKILEEIRRVLEELRRRAN

SEQ ID NO: 16620 - protein, 181 aa, Artificial Sequence; identical to SEQ ID NO: 16619
  Synthetic sequence.

SEQ ID NO: 16621 - protein, 182 aa, Artificial Sequence
  Synthetic sequence.
SEVEELVKELRRLIEEWDRRSKRLMEELKELAERIDKTTKELLKELEDLVEKIKRELDKKGGEDERLKEDVERLLRELREALKRVEDTVDRLNRESEEVLKEVKKTNEELVRRLEELLKRAKENGVEERVAEEVKRAIERAKRESDKIERDVRELNRRNREILKKIKKRVEDVLRKLRKDLE

SEQ ID NO: 16622 - protein, 182 aa, Artificial Sequence; identical to SEQ ID NO: 16621
  Synthetic sequence.

SEQ ID NO: 16623 - protein, 174 aa, Artificial Sequence
  Synthetic sequence.
DEVEELKERLRRLAETIARRIRELVERLRDSARKIEKRVRELAKKLRDSVREITKVIKDGVDERTIDEMIERHKRTSEEIAREIRDLLRRHKEVSERILEEVRRLIEELDRVVKEVTRTEEIREEVEKAVRDLEELLKELKRESEETIRRIEKLVRDLERESEEAVRRLKEEKD

SEQ ID NO: 16624 - protein, 174 aa, Artificial Sequence; identical to SEQ ID NO: 16623
  Synthetic sequence.

SEQ ID NO: 16625 - protein, 174 aa, Artificial Sequence
  Synthetic sequence.
SEEEKLKKELEDLARRIEKRLRELVEELERSVREIERRIEKLHKELEESVDRIKKVVDKGVDEDAVRKLLTDHDRISRETVRRIEELIKKHEEDSRRVVKEIEDLIRRLEEVVRRVTRTDEIRRRVEEVVRRLEKIVKELEERSREVLKRLREEIEKHKKRSEETKERIRTRAT

SEQ ID NO: 16626 - protein, 174 aa, Artificial Sequence; identical to SEQ ID NO: 16625
  Synthetic sequence.

SEQ ID NO: 16627 - protein, 174 aa, Artificial Sequence
  Synthetic sequence.
SEVEELLKRLEDLIRKIEERLKELVKRLKESAKEIEERLEELHRRLKESVDRIREEIEKGRDKEDVKRLVKRHKELSEETVRRIKKLLEDHKRLVDKILREIEKLLKELKDVAERVSRTEEIKKEVKKALERLKKIVEDAKKVSEETMERIRKLVEEHKDTSRKTVEDLERATK

SEQ ID NO: 16628 - protein, 174 aa, Artificial Sequence; identical to SEQ ID NO: 16627
  Synthetic sequence.

SEQ ID NO: 16629 - protein, 174 aa, Artificial Sequence
  Synthetic sequence.
DEVERLMEELRRLLEEVRKRIEDLIRENRKLVKEIKDRLEKLLRDNERLAREIEEVIRSGTEEEKVRELLERLERSSRKTLKEIRELLEKLRKKNEDSTREIERVLRELEDVVRKVVREERIREEVKRAIEKLKELVEDSNREVTEALKEIEDLLRKLKERSEELLRRIKARTD

SEQ ID NO: 16630 - protein, 174 aa, Artificial Sequence; identical to SEQ ID NO: 16629
  Synthetic sequence.

SEQ ID NO: 16631 - protein, 182 aa, Artificial Sequence
  Synthetic sequence.
KEVDELDEELKKHAERIDRELERLDRENEKHVEDVRRELERLREENERHARRIEDEVKKRTDEEEVIKRLIDDHRRLSKRTEDEIKKLLDDHRRLSEETKERIKELLKDHRRLLKDVADKIEDRKTLEDIRRKVEKSLRELEKKLEEIDKKNRDTLEEARRELERIRRENEEVIRRLDKRRR

SEQ ID NO: 16632 - protein, 182 aa, Artificial Sequence; identical to SEQ ID NO: 16631
  Synthetic sequence.

SEQ ID NO: 16633 - protein, 182 aa, Artificial Sequence
  Synthetic sequence.
KEVEELVRKLREHVRDIKRKLEELLKENEDHARRAEDRLRELTKENRDHVKEMEDVLRRDTDSRETIRKLLEDHKRLSKETAERIEELIRDHERLSRETSKRIKELIDDHRRLLEEAAKDIRDKDTLERLEREVRKSIKELEDKLREIRKRNKEVIDKLRDILEKIKKENREALKRLRDTEE

SEQ ID NO: 16634 - protein, 182 aa, Artificial Sequence; identical to SEQ ID NO: 16633
  Synthetic sequence.

SEQ ID NO: 16635 - protein, 182 aa, Artificial Sequence
  Synthetic sequence.
SEVEKLTEELRRHVEEIERDLDRLRKENERHAKKIKDELKRLLEELEEVARRIEAELERDTDDEDKIRKLLEDLEELLERIADTIRRLIEDHRRLSEETMERIRRLIEDHKKLLDDIARRIRDKDMLRRIEEEVERSIRRLEELLERIRERNEKVIEDLKELLKRIRDRAEEVKDRLRRTRK

SEQ ID NO: 16636 - protein, 182 aa, Artificial Sequence; identical to SEQ ID NO: 16635
  Synthetic sequence.

SEQ ID NO: 16637 - protein, 182 aa, Artificial Sequence
  Synthetic sequence.
SEVEKLKKELEDHVRDIEKKLRDLMRENEEHAKRARERLKKLLEDNEENVKDIEDKVRKKRDKEEVIKKLIDHHRKLSEDSVRDIEELIKDHKRLSEETSERIKRLIEDHRRLLKEISDKIRDEDTLRKIREDAKRSEKKLEEILRTIRKRNEKVIRDLRRLLEELRKRNREAIERLRKELE

SEQ ID NO: 16638 - protein, 182 aa, Artificial Sequence; identical to SEQ ID NO: 16637
  Synthetic sequence.

SEQ ID NO: 16639 - protein, 182 aa, Artificial Sequence
  Synthetic sequence.
SEVERLAEELRKHVEEIKKELRKLKEKLEKLARDIERELKRLRDENKKHADDIRDKVEKRKTDEKTIEDLIRDHERLSEETKKRIEDLIRRLEELLREVAKRIKELIEDHRRLLKDVADKIEDKDTLRRIEEEVKKSERELREELKRLEERVRRVIEKLEDLLRRIEKENEEVKRDLERRRK

SEQ ID NO: 16640 - protein, 182 aa, Artificial Sequence; identical to SEQ ID NO: 16639
  Synthetic sequence.

SEQ ID NO: 16641 - protein, 182 aa, Artificial Sequence
  Synthetic sequence.
SEVDELKRRLDEHAKDIRDKLRKLVKELREHAKRAEDELRRLLKENEDNAREIRELVKTLRDDKDKIEELIKHHKKLSEDSEREIKRLIEDHKRLLEEVEERIRRLIEDHKRLLEDVARKIRDEKTLRDIKRAVEKSIRDLERILEELRKEVEDTIKRLEDILREIRKRNKDVIDDLRRRMK

SEQ ID NO: 16642 - protein, 182 aa, Artificial Sequence; identical to SEQ ID NO: 16641
  Synthetic sequence.

SEQ ID NO: 16643 - protein, 182 aa, Artificial Sequence
  Synthetic sequence.
SEVDRLVRELDKHVEDIERTLKKLREENEKNVEEIKRTLKKLVDELRKLAREIIDTVDKNRDIREEIEKLIEDLRRMVEEIAKRAKDLLDHHAELSRRTREEIKRLLEDHDRLLKEIARKIKDEKTLRDIKRRVDKSLEDLKRTLEEIKRENERTLEEIKKILEDMEREVRDIERKLREKEK

SEQ ID NO: 16644 - protein, 182 aa, Artificial Sequence; identical to SEQ ID NO: 16643
  Synthetic sequence.

SEQ ID NO: 16645 - protein, 182 aa, Artificial Sequence
  Synthetic sequence.
KEVEDLVRELEKLIEEIKRRLEELDKELKKHVEDAERRIKKLLDENRENAERILEKLRRDKDDDDKARRLVKHHRELSEESSRRIEELIRDHRRLLEEISRTIEELLDRLRRMLKKIADEIKDEELLRRAKERVREALEDLRRILEEIRRKVEETIRRLEKLLKELRDRNRRVLEELERTLK

SEQ ID NO: 16646 - protein, 182 aa, Artificial Sequence; identical to SEQ ID NO: 16645
  Synthetic sequence.

SEQ ID NO: 16647 - protein, 180 aa, Artificial Sequence
  Synthetic sequence.
REKEEIKREVEEAKKRLEDLLREIAEEVKRALERLRELNERNNDRARRVLKRLTDELRRVDNEDLKRDARRLLEELKRINRESNETHKKLLEELRRLLREVEKTVERLLRRLDEMLERVERTEPDDRLSERLRRLVREIEETLKELLKALRRLLERIREVSEELHRRSEELVERILRKLK

SEQ ID NO: 16648 - protein, 180 aa, Artificial Sequence; identical to SEQ ID NO: 16647
  Synthetic sequence.

SEQ ID NO: 16649 - protein, 180 aa, Artificial Sequence
  Synthetic sequence.
REKEDIEEKVKRVLERLERLNRENNKESERLLRRLEELNKRNNEAVKELLDRLREILKRVRDEKKKREVEELLERLRRINEESNRVHRRLLEELRKLNEESNRVHKRLLELLKTLLDEIRKREPDDRLMEELKRLAREAERVSEELHDRTRRLAEEIEKVSKELHKKSEKLAREIKKRLD

SEQ ID NO: 16650 - protein, 180 aa, Artificial Sequence; identical to SEQ ID NO: 16649
  Synthetic sequence.

SEQ ID NO: 16651 - protein, 175 aa, Artificial Sequence
  Synthetic sequence.
KEAEELIKELKDLAERIRRENRRLLEELKKLVEEIRRRIRELIERSEDSVRKIEETVKRKKEKREELEKLLREHEKLNEEILEEIKKLLDDLRKTVKEAIDRSRKLNKELKDMVEKVSRDEKAERELKKISEDDERSIKELEDLLRKVEEDIRRLLDELRDIMKKTKEKVDELRR

SEQ ID NO: 16652 - protein, 175 aa, Artificial Sequence; identical to SEQ ID NO: 16651
  Synthetic sequence.

SEQ ID NO: 16653 - protein, 182 aa, Artificial Sequence
  Synthetic sequence.
DEAERVKRELERLVKEIKEENRRLLRELRELSKRSREVLERLLRKLEDLVRKIREVLERLKRVKEVVKRLKEELKKLLDEAEKVIEDLKRENDKLLEEVHRVNEKLDRDLEALLEEVRRINLPKKVLDEIEKEAEEIKRENKDFNRRIEREVRESKREIEEVVKRIREIAERVDRDIDRTRR

SEQ ID NO: 16654 - protein, 182 aa, Artificial Sequence; identical to SEQ ID NO: 16653
  Synthetic sequence.

SEQ ID NO: 16655 - protein, 182 aa, Artificial Sequence
  Synthetic sequence.
DEEREVKERLRDLTRRIRETIKRLLDKNKDLARRIREVNKETSEELERLARDIERVLEELKDVDEVVKRLKERLRELLRRSEEVNRRLDEENKKSNKETEDVARRLLKELRDLLEEVRRINLPKKVLDEIREAAERVKREIEELLKEVHRINTELNKDNTELNKRNREIVERVKRRIDERAR

SEQ ID NO: 16656 - protein, 182 aa, Artificial Sequence; identical to SEQ ID NO: 16655
  Synthetic sequence.

SEQ ID NO: 16657 - protein, 182 aa, Artificial Sequence
  Synthetic sequence.
DEVEEVKKALEDLAEKIRDLNRKILEKNKKLADDIRRLNEKLLRELRKLVEEIERVLRKLKDVKKVVKELKDRLKRLLEELERVNRELDERNKKLHKETEDLNRELDERLKKLEDDVRRVNIPKELLDEIRRRVEEVKKDNERVNKEIEELNRKLDEDNERANREIRDTVEKVRRRIDEEEK

SEQ ID NO: 16658 - protein, 182 aa, Artificial Sequence; identical to SEQ ID NO: 16657
  Synthetic sequence.

SEQ ID NO: 16659 - protein, 181 aa, Artificial Sequence
  Synthetic sequence.
SEIEEIEKEIRRVLEEIERLLRTLKKINDDVKRESEKLVRDDKKKIDDALRELRKLAAERGKDEKVIRDIEKLIRDVKRHSEEVLERLKRLNEETRKTNEEVIRRARRLIDELEKDIRRIRGDEVVRRAEKLLKEIRDTVETALKELEDKNERSERENKRVAEESERKLRKIKEEVDKAAE

SEQ ID NO: 16660 - protein, 181 aa, Artificial Sequence; identical to SEQ ID NO: 16659
  Synthetic sequence.

SEQ ID NO: 16661 - protein, 182 aa, Artificial Sequence
  Synthetic sequence.
RKVEEIKKRLKELKERLEESVKRIKDRLRKLEEDNRRLAEEVKKRLEELLKRLEDLVKRREGDKTDLRRSVEKVVREIRELIEELKRHTEESADEIRKLLEEHKRLSDEVVREIRELIRDLDDEKAVKELEDELRRIEKTSRDVLKELEDILRRLREESKRVADELRELLRRVKEKVERETK

SEQ ID NO: 16662 - protein, 182 aa, Artificial Sequence; identical to SEQ ID NO: 16661
  Synthetic sequence.

SEQ ID NO: 16663 - protein, 182 aa, Artificial Sequence
  Synthetic sequence.
SEDDRIRERLKELVDRNDELVKRIKRALDELLRELRKSVEDIKRTLDDLARKLEELARRREGDKTDLRRVVEKIRRDIEKLLKDHEDKSREVVRTIRELLDKLRRHTERTAREIRELIRRQDSREVVEDLKRILRELEKRSEDVLRELKKKLDDVEKESRDVLRELTEKLKKIEEDVRRAEK

SEQ ID NO: 16664 - protein, 182 aa, Artificial Sequence; identical to SEQ ID NO: 16663
  Synthetic sequence.

SEQ ID NO: 16665 - protein, 182 aa, Artificial Sequence
  Synthetic sequence.
REVEEIERRIRELLETNREIAERTTEEIKRLKKELEDSLEEIKKRLKELVDELRKLATDRRGDKTDLRRSVRRVEEEIRRLLDEHRKLSEEVMRTIEKLNEDSRRHTRETVEEIKELIKRLTIEEAVRRLEELVREIEDRSERLNKENEDELKKIEETSRKALKELEDRLREVKKEVREAER

SEQ ID NO: 16666 - protein, 182 aa, Artificial Sequence; identical to SEQ ID NO: 16665
  Synthetic sequence.

SEQ ID NO: 16667 - protein, 181 aa, Artificial Sequence
  Synthetic sequence.
DSDRELEKKIRDSLKRLEEALRELEERLKRSLEDDERVHEELRRRAERIRETIKKRLSDKDTLDKLKKEVDKLLTDLERVNRDTKRLNKELLDKAREVVKKLKEDNRRLLEDLKEIIKKPTRSELVKRMKERVDELHKRTEELLERLKEELKKLHDETRDINRELKKRLEDLERKIEEAAK

SEQ ID NO: 16668 - protein, 181 aa, Artificial Sequence; identical to SEQ ID NO: 16667
  Synthetic sequence.

SEQ ID NO: 16669 - protein, 181 aa, Artificial Sequence
  Synthetic sequence.
KEAEELRRLIEESKRTDKKVHEDLKEEVRKIEEEDDKAHEELRKEVERIKKKIDDDMSDEDTARRLRKEVEDLLRRLKKLNEETKRELERLDEKLRKVNEKTKEDNERLARELEEIIKKPTGSELIKRLKDEVKKLHDETERINRELKKELDDLLRRVRKINKELKEELKKLERKIEEAAR

SEQ ID NO: 16670 - protein, 181 aa, Artificial Sequence; identical to SEQ ID NO: 16669
  Synthetic sequence.

SEQ ID NO: 16671 - protein, 181 aa, Artificial Sequence
  Synthetic sequence.
SSREELEKRIRESEKRDREMHERLRRTAEKIEKEDKEMHDRLREKAERIEERIDKEVSDEDTARRLKEELKRLLEDLERVNRRTKEELERLLKEAEELNKRTEERNRKLEKEIKDIISRDTKSELIERIAERIERLNRDTERINRELEEKLRRLLKRIREINTELDKRLKELLDRIEEASR

SEQ ID NO: 16672 - protein, 181 aa, Artificial Sequence; identical to SEQ ID NO: 16671
  Synthetic sequence.

SEQ ID NO: 16673 - protein, 178 aa, Artificial Sequence
  Synthetic sequence.
SSEEKIEKASEDNERKVKEVLREIEELSKKDKTDVERVLRELEKRLEEIKREVDRRDRRREEMERLREEIKRLLDRLRERIEEVDKRITELNKDANDTVRRVVKEIKELNDRLRRRVREVDSEEDLKRELDEIDKRTEELARELRELMREIHERTKRLADDLRRAIDEIRKKIEEDAR

SEQ ID NO: 16674 - protein, 178 aa, Artificial Sequence; identical to SEQ ID NO: 16673
  Synthetic sequence.

SEQ ID NO: 16675 - protein, 181 aa, Artificial Sequence
  Synthetic sequence.
DELEDLLRRHRELVKRSLERLKDLLERNRELIEDSERRAEELLRELRRLIEEIKKVLDEGIDEKDIKKMLDELRRTAEEILKELEEVNERLNRASRKTLEEIKDSNRKLNDSVKKIEDRIKDKKVLEELKRSNDEANERHKTVLRRLEEENKRANDSHRKIKEELKDLLRRVDETVKEKRR

SEQ ID NO: 16676 - protein, 181 aa, Artificial Sequence; identical to SEQ ID NO: 16675
  Synthetic sequence.

SEQ ID NO: 16677 - protein, 181 aa, Artificial Sequence
  Synthetic sequence.
SRLEELLKTHKKLVEDSVDEVRRLLERNRKLIEDSKERLKELLRTNEELIRTLKEVLDRGTSEEDIKRLLDELEKHVRETNERSKRSNERLNRHVEETNKRTKELNDELNRSVKEIEDEIKDEEVLRRLKESNKKANEDHRRLNEENKDLNRRANEEHKKVNDRNKELLDRARRTADEKRR

SEQ ID NO: 16678 - protein, 181 aa, Artificial Sequence; identical to SEQ ID NO: 16677
  Synthetic sequence.

SEQ ID NO: 16679 - protein, 181 aa, Artificial Sequence
  Synthetic sequence.
DEVDELVKTHERLVEESERRIEELLERNRRLIERITERAKELLKENKRLIEEITEVLKRGSDEKDIERLLRELEKHVRETNEESKRMLDELRKHVEDTNRETKKLNDDLNDSVKKIEDRIKDKDVLERLKDSNRKANERHKRMNEENKRLLEDVERRIKELNKRNEDLLREAEKRVRDERR

SEQ ID NO: 16680 - protein, 181 aa, Artificial Sequence; identical to SEQ ID NO: 16679
  Synthetic sequence.

SEQ ID NO: 16681 - protein, 181 aa, Artificial Sequence
  Synthetic sequence.
SELEELLKTHKKLVEDSVERVRDLLRENKRLIEESEKEIRKLLDELRELIERIIELVERGESEETIKEVVDRLRRTVERIEKRLRDSNRELNDHVRRTNEETKRLNEELNRAVKEIEDRIKDKEVLERLKKSNKEANDEHRRLNDENRELNERANRKHKEVEDRLKDLLRRAEEKLTEDAK

SEQ ID NO: 16682 - protein, 181 aa, Artificial Sequence; identical to SEQ ID NO: 16681
  Synthetic sequence.

SEQ ID NO: 16683 - protein, 181 aa, Artificial Sequence
  Synthetic sequence.
DEVERLITKHRKLVEDSRRRVEELLRRNAELIKTSKRRVEELLERNRRLAEELRRLLKEGQSEETIKELLERLRKHVKETDDELRESNKRLNDHVKRTNEETEKLNRELNKVAKEIKDRIKGDEVLRRVEDSNRRANETHKDLNRKNKELNEEANRTHEELLRRNEKLLREIEDTVDRETK

SEQ ID NO: 16684 - protein, 181 aa, Artificial Sequence; identical to SEQ ID NO: 16683
  Synthetic sequence.

SEQ ID NO: 16685 - protein, 181 aa, Artificial Sequence
  Synthetic sequence.
SEVEKLLKELEDESRKSEDDNRRLLEELRRLSEESLRDLRRLLEDLKRLAEEIEREVRKRPEKELLEDLLRKLEKILRDIRRAIRRNIEENRRVLEEWKKRTDKNRRDNEDIVRRIRERIRGDELKKRVDEVLETSRELLRESKRKIEEIARRSEEELKRVKDEVDDTARRIKRKIEEAEK

SEQ ID NO: 16686 - protein, 181 aa, Artificial Sequence; identical to SEQ ID NO: 16685
  Synthetic sequence.

SEQ ID NO: 16687 - protein, 174 aa, Artificial Sequence
  Synthetic sequence.
DSERRLDEILERAREVNEESSRRLDKLLRETEEKNRKSTEELRKIVEDLKRTVKDESRTDEIEDLVRKIEEEIKKLIKESNDLVEEILRRSKDALRESNERVREILERIRDMKERGEDAETVIRRIEKLLEDLKRVDDKILEEHKDLSKKLDDVDREIKERIKKLIKDLKDTAR

SEQ ID NO: 16688 - protein, 174 aa, Artificial Sequence; identical to SEQ ID NO: 16687
  Synthetic sequence.

SEQ ID NO: 16689 - protein, 174 aa, Artificial Sequence
  Synthetic sequence.
DSEEELKDILRKAKEDNDRSSDKLRRLLEETEKRNRDSTKRLEELLEETEREVRRRSRREDIERLVREILTRSRKLIEDSNRLVKRILDESEKLLRDSNRLLEEVERRIKDLKDRGEDAETVKERIKKLLKDLREVDREILERHKKMSDDLKRVDEEISKTHKELSRRLKETAR

SEQ ID NO: 16690 - protein, 174 aa, Artificial Sequence; identical to SEQ ID NO: 16689
  Synthetic sequence.

SEQ ID NO: 16691 - protein, 174 aa, Artificial Sequence
  Synthetic sequence.
SKEEDLKRILEEAEKTNKESSDRLRELMDRTRRENEESSRTLKEIVKDADRRVAEIIRTDELRKLVRDIKETIKELDERSNRLAEEILKTSKKLDEDSNRLVEDVVRRIKDMVDRGEDVERVKEDIERLLDELRKVDREILETHKKLSEELRRVDEEIIKRVKDLIRTLEKAAE

SEQ ID NO: 16692 - protein, 174 aa, Artificial Sequence; identical to SEQ ID NO: 16691
  Synthetic sequence.

SEQ ID NO: 16693 - protein, 174 aa, Artificial Sequence
  Synthetic sequence.
SSEERLRTILREIEKTNRDSSKRLRDLLRETKRENKESSDELRKLLEETRDEVEKRRRDKEIERLVREILKTSEDLDRRSNREVERILRTSERLDRESNKLATKISEDIKRMTDKGEDSDTVAERIRRLLEELKRVDEEILKTHKDLSDRLRELDEEIKKTHEKLSEELRRAAN

SEQ ID NO: 16694 - protein, 174 aa, Artificial Sequence; identical to SEQ ID NO: 16693
  Synthetic sequence.

SEQ ID NO: 16695 - protein, 181 aa, Artificial Sequence
  Synthetic sequence.
KEVEEILETHKEIARELREVAEEIIRDHERILRDLEKKIRELRRTHERMVEELDRVAKEGVSEEELKRLLDELHERVKEILETLKRLLDKLHKTVEELKRTLEELLRDLHRLVKELEDRIKDKDALDKLRDSDRRVHEDVRRMLKRLDDSDKRVHDRVRKVLEDLKRSNDELRRTVEERER

SEQ ID NO: 16696 - protein, 181 aa, Artificial Sequence; identical to SEQ ID NO: 16695
  Synthetic sequence.

SEQ ID NO: 16697 - protein, 181 aa, Artificial Sequence
  Synthetic sequence.
SEVEKILEDHKRIVDELEKEAKKIEETHTELVKRLREEVEKLKEELRRLLEELKDMARRGVREEELRELLDRLREMVERILRRLRKLNEELNKVIEELKRRLEKLLEDLHRRVEELLREIKDEEALRRLKKSDEEVHRRVREILKRLEKSNRDLNDDSRKVEEELKRILRRIEEEAKRTED

SEQ ID NO: 16698 - protein, 181 aa, Artificial Sequence; identical to SEQ ID NO: 16697
  Synthetic sequence.

SEQ ID NO: 16699 - protein, 187 aa, Artificial Sequence
  Synthetic sequence.
SEAERLLDELRRLLEEIKRRIEELLEESKRSLEEVEKRSKELLDRLEDLLRKIKEEIRKDGTSDEVAKKIKELLERLEDSIRKVKEEDEKMLREHEETNRRIEKEIKDMLRKLEDDIKKVKDRLKDSPEEVKERLERLRERIKREIDRVIRELRELDKRAKEVSKRTKEELEKILEKVRRVIEEVKR

SEQ ID NO: 16700 - protein, 187 aa, Artificial Sequence; identical to SEQ ID NO: 16699
  Synthetic sequence.

SEQ ID NO: 16701 - protein, 187 aa, Artificial Sequence
  Synthetic sequence.
DDVDRLLDELRELIDRIRKDLERLLKESRDSLEELRRRSEELLKKLEEEIREVVERIRREGTGDEVREKIDRVAKEVERSVRKVKEEDKDLLRRHNELNKDIKRKIDELLKRLEEVVRRIKKRIEKDPDELKRRAEKLLEDLRRVIEEIKRRLDKVNDEVREVSKETTDRLDDLVRKARELIRRVEK

SEQ ID NO: 16702 - protein, 187 aa, Artificial Sequence; identical to SEQ ID NO: 16701
  Synthetic sequence.

SEQ ID NO: 16703 - protein, 179 aa, Artificial Sequence
  Synthetic sequence.
SEREKLLTDLRDLLKKVVDTLRRLNEELKKSIEESKETLERLNRTLKKLLDEVKKKLEDDGGEDKRVLDKIRDLLRKLRRAVEETKKTNKRLAEENEKLAKKSKEDLKKLLDDLEKVVKEVEETDELRKIVEEIRTELDRVRETNERILKEVRDEHRRVDKTNTDIERDIERVIKEVET

SEQ ID NO: 16704 - protein, 179 aa, Artificial Sequence; identical to SEQ ID NO: 16703
  Synthetic sequence.

SEQ ID NO: 16705 - protein, 182 aa, Artificial Sequence
  Synthetic sequence.
KKDEDLKKLLKDNEDVMKKAADEVKRLNDENRDLMRRVAEKIEDLLRRLEKLLRDILRRRGEEDERAKRLEELVREILERIERLLRESEKVHRESNERSKRLLEESKKLHKRIAEEIDELRRRGSDSKTVKDRIKRLTDELERVNRELSEEHKRVLDELRKRNKEILDRLKELLKRLKEEAD

SEQ ID NO: 16706 - protein, 182 aa, Artificial Sequence; identical to SEQ ID NO: 16705
  Synthetic sequence.

SEQ ID NO: 16707 - protein, 181 aa, Artificial Sequence
  Synthetic sequence.
SSEEELERLLEELRRITEEAKERMERSSKELEDVSREAEKRLEKSSRDLDKTVRDIKRRIKDKDTLREIDRLAKELKERNERLLEELRRSSEELKRRNERLIEESRKSSEEIKKRIKDLRRDSDDAEDVKRRVRELIEEHKRLNKELLDESRELLKTHAELVKRILDESRRLLEELEKAAR

SEQ ID NO: 16708 - protein, 181 aa, Artificial Sequence; identical to SEQ ID NO: 16707
  Synthetic sequence.

SEQ ID NO: 16709 - protein, 175 aa, Artificial Sequence
  Synthetic sequence.
SEREDATRRLRDIIRRLRDLIRRLTEESEESIKEIRERIERIIRTSEESLKELEERIRRNRDKRELLEELLRRHHELNKRLKEELKRILKEHAELNKRIKEELKRILKEAKERIDRLERTEDLERLREEIEDVVRKAEKRLDELHDEIRRTIEDAERRLDESNERAEKVVRDAEK

SEQ ID NO: 16710 - protein, 175 aa, Artificial Sequence; identical to SEQ ID NO: 16709
  Synthetic sequence.

SEQ ID NO: 16711 - protein, 175 aa, Artificial Sequence
  Synthetic sequence.
SDEERALEKIRRLIEDLRRMVREMLERSKKSLEEHKELAREILRRSRESLERLKDVARRNKEKEEDLKRLLKEHADLNRELKKRLRDSNREHNELNKDLKRKLRELLKELKKRVDELPRSRELDKLREELEEVVRRVEEKLDDSDRRANEVTREIEKTLDDLHREAEEVVKEIRR

SEQ ID NO: 16712 - protein, 175 aa, Artificial Sequence; identical to SEQ ID NO: 16711
  Synthetic sequence.

SEQ ID NO: 16713 - protein, 181 aa, Artificial Sequence
  Synthetic sequence.
SVEETLRRLLEESERVNRRVKEDLDRIRRESEEVNKRAEEMAKELLDEIRKDIDRVRKRNVDEDTLRKLLEEIKRLVDEWRRLVEENHKRNEDLIRKWEKLVRENHERNKTILKEVEERIRTEELAKEVIKTLRKLIEESKRNHEDLRRELRELIEESKRDHERLLRRLRELIKRIRDTTK

SEQ ID NO: 16714 - protein, 181 aa, Artificial Sequence; identical to SEQ ID NO: 16713
  Synthetic sequence.

SEQ ID NO: 16715 - protein, 181 aa, Artificial Sequence
  Synthetic sequence.
DEIEDLLRRAEKLIRDLKRKNDKLLKESEELLERLRERAKEVLDESKKLLEELRELVRRRGKTEEIEELVKEINKRNRELLKELSDLVKEINERDKEVLDRLRRDHERTLKTIDDLLKEIRDERAARDVERLKRRNKKVVEDSEDLARKTNKKSEELLREIRKRVEDSNRETKEILDRVRK

SEQ ID NO: 16716 - protein, 181 aa, Artificial Sequence; identical to SEQ ID NO: 16715
  Synthetic sequence.

SEQ ID NO: 16717 - protein, 174 aa, Artificial Sequence
  Synthetic sequence.
DEDEELLKRLRDLIREVRDRVRRLLEEDKDSLRRIRERVEELLRRSEESLKDLEKKIREGSPEEEIERLLREHEELNKRVLDEIRKLAEDNRDLTRRIKEKVEELIERVRDALRKLTPSEELKKIADKVEEVLREVEKELDKSRRTSDEILKKVEKAVRDLDRRVKEVIDRARR

SEQ ID NO: 16718 - protein, 174 aa, Artificial Sequence; identical to SEQ ID NO: 16717
  Synthetic sequence.

SEQ ID NO: 16719 - protein, 182 aa, Artificial Sequence
  Synthetic sequence.
SEAEELLKRLERLLRESKKDLERLRKELKDLLEESRKDVTRLLDEIRRLLEEIKRRLDKRNEDEKLDKLRKELKELVDRARRVLERNVRENEELIRDIERNLKKNREDNERAIKEILDELKDLEEVKRMIEKLKKESEEVIRKAKEDLDRVTKESRRVIEEVERRLDELRERLREVVERVKT

SEQ ID NO: 16720 - protein, 182 aa, Artificial Sequence; identical to SEQ ID NO: 16719
  Synthetic sequence.

SEQ ID NO: 16721 - protein, 182 aa, Artificial Sequence
  Synthetic sequence.
DEAEKLLKELRDLLEESRKDLERLLKELEDLLEESKRDLERLLEEITELLKRIKETVERRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 16722 - protein, 182 aa, Artificial Sequence; identical to SEQ ID NO: 16721
  Synthetic sequence.

SEQ ID NO: 16723 - protein, 180 aa, Artificial Sequence
  Synthetic sequence.
SVEETARRLLDENRKLLEEAERIHTEINERNKELLKRADDLHRRVLEDLRKLLDKVAKEIDSRRLERIEELVKRILEKLEKSNRDSNKEHKDTNERSKRSNDESRKVHEKTLKEIEDVTKEGQDADTVVKRIKKVIDELEELNRKSKKELKEVIEDLERRNRDSIRRAEDLLRRLEEEVR

SEQ ID NO: 16724 - protein, 180 aa, Artificial Sequence; identical to SEQ ID NO: 16723
  Synthetic sequence.

SEQ ID NO: 16725 - protein, 180 aa, Artificial Sequence
  Synthetic sequence.
KDEETVEKLLRELEELLKEAEERAKDLNRRNKELLDEADRRHEELLRRLEDLLRDVRRRIDSERLERLERLAKEIRERIKKSNEESNRLHEETNKRIEKLLRDLRKTVKEVLERIKDMKDRGEDSDTVSERIRKVIREIERLIKEIVKEIEKLIRDLEKRNRESLKEIKDLLKKLKDEVD

SEQ ID NO: 16726 - protein, 180 aa, Artificial Sequence; identical to SEQ ID NO: 16725
  Synthetic sequence.

SEQ ID NO: 16727 - protein, 173 aa, Artificial Sequence
  Synthetic sequence.
SRKEKLLTELKEILKRLKEEVEKIVKESEKSIEEHHRRSERLKRESKKSLDDLAKILERSDKKVIDEIAKEHHDLNREILREDKKLLDDHHRLNKDLLKTIKELIDEARRRMEELDQDEELEKIRREVEELLRRAEEELRRLNREIEENHKRVKRELEKIDKEMKDLLREAKR

SEQ ID NO: 16728 - protein, 173 aa, Artificial Sequence; identical to SEQ ID NO: 16727
  Synthetic sequence.

SEQ ID NO: 16729 - protein, 173 aa, Artificial Sequence
  Synthetic sequence.
DRKERLKERLERLLKEHHDRSRELLRTSEESIRRHHEESRRLLRRSKESLDRLRDELRRLREEDIDKLMREHHKLNRDLLKEDEDLLDTHHKLNRKILREDEELLRKIREEIEKLDKDEELRKLERRARENHKRVREALERLNRRIEENHKRVRRRLEDLDRAAEELLREAKR

SEQ ID NO: 16730 - protein, 173 aa, Artificial Sequence; identical to SEQ ID NO: 16729
  Synthetic sequence.

SEQ ID NO: 16731 - protein, 173 aa, Artificial Sequence
  Synthetic sequence.
SRKEDLKRRLEEIIKRLEEVVRRILRTSEESLKDHHEASKRLLEESEKSLKRLEEELKRKDERVIEELVRRHHDLNRRILEDDKRLLEEHHDLNKKLLEAVDKLLKEAEDVLRKLDKDEELRKIEERIRELAKRAREELDKLDKEVRKNHERVKRRLEELDRRAKELVREERR

SEQ ID NO: 16732 - protein, 173 aa, Artificial Sequence; identical to SEQ ID NO: 16731
  Synthetic sequence.

SEQ ID NO: 16733 - protein, 173 aa, Artificial Sequence
  Synthetic sequence.
SEKEKLLKEIERLIEELRRVVKKAVEDSKESIDRHHERSRELLRRSRESLKDLERRLKDSDESVIEKLVKEHHDLNRRILKEDRDLLREHHELNKKLIDKIRRLVEDVRRKLEELRKDRELEELEKRVRELERRIRETLTRLNEEIEKNHRRVEERLRDLNREAEKLAEEAKR

SEQ ID NO: 16734 - protein, 173 aa, Artificial Sequence; identical to SEQ ID NO: 16733
  Synthetic sequence.

SEQ ID NO: 16735 - protein, 173 aa, Artificial Sequence
  Synthetic sequence.
SEKEDLSRRLAELLKEHHDRSKKLLDESRDSLRKHHKASRDMLRRSDESLKRLDRVRKERDDEVIKELVKRHHELNRELLERDKKLLKEHHDLNEEIARRDETLLREIRKKLEEADKDEELDRIRKEVKKNHDRARRALEKIDKEAKENHERVREALRKLNEDLEKLEREKRK

SEQ ID NO: 16736 - protein, 173 aa, Artificial Sequence; identical to SEQ ID NO: 16735
  Synthetic sequence.

SEQ ID NO: 16737 - protein, 173 aa, Artificial Sequence
  Synthetic sequence.
REKEELIKRLKRLIDELRRVVKTLLADLERLLKEHHDRSRRILEESKRSLEELEKTLRRSDERVIEELLKRHHDLNRRLLEEDRELLRRLTEMIDRILEELERLLKELDDEVKKLDKDDELRKLKEELEDLARKARKEIEDIKEKLRRNHERVKKALEDLNRTAEELLDRARQ

SEQ ID NO: 16738 - protein, 173 aa, Artificial Sequence; identical to SEQ ID NO: 16737
  Synthetic sequence.

SEQ ID NO: 16739 - protein, 173 aa, Artificial Sequence
  Synthetic sequence.
SREEKLLKELKDIIDTLRRRVEEILTESEKSLRDHHRESRKIVEELRKLLEDLRRLLERKDERVIEEILKRLAERIRDLTRKDEKLVEEHHRLNRRLIDEIRKLFEELKEVLDRLDKNRELDKIEEEARELVKRAEEKLREIDKRARDNHKRVRDELKRILDELKKLIDERRK

SEQ ID NO: 16740 - protein, 173 aa, Artificial Sequence; identical to SEQ ID NO: 16739
  Synthetic sequence.

SEQ ID NO: 16741 - protein, 188 aa, Artificial Sequence
  Synthetic sequence.
SVEDSIDKIDKELEKNSERTKRTIDRIREESRRLIEEIKDRVRRLLREAERTIEDVKRKLKDDERARERIKELEEKVRRLIEKVRRRIKENLDRNDKLLREVEKVDKELNERLKELIKEVEDVLRKTRERRVVEELRERLKRLLEKHHDLMRRLTEDLKRLLEESERDARRLVKELEDALREIREDTR

SEQ ID NO: 16742 - protein, 188 aa, Artificial Sequence; identical to SEQ ID NO: 16741
  Synthetic sequence.

SEQ ID NO: 16743 - protein, 180 aa, Artificial Sequence
  Synthetic sequence.
SREDKVRELEERLKRLNERLNREVKKVNEDNRRLLKRAEDTARRLAERIRRLLERVDREIDSERLERVRRTVERIERELKRLLDELRKHVRETDEESRKVNEELNEMSERTLRELRKLKDNNVPDEELERRVEELLKRNEKLIREVKKRLEELLRRNEELIRRILEEVEKLLKDLEDKVR

SEQ ID NO: 16744 - protein, 180 aa, Artificial Sequence; identical to SEQ ID NO: 16743
  Synthetic sequence.

SEQ ID NO: 16745 - protein, 180 aa, Artificial Sequence
  Synthetic sequence.
RREERVKEALERIRRLNKRINERVEEVNRENKRLLDEAKRTHEELEKEADRLLDDVRRKIDSERLERIERKVKEIKERIRESNKRLKEHVEDTDRRSKELNERLNRSSEKTLEDIKRMKDSNVPEEELEKEIRKVLETNRKLAEDVRRDLERLLRRNRRLIEESKKEVEKLLKELEEDVR

SEQ ID NO: 16746 - protein, 180 aa, Artificial Sequence; identical to SEQ ID NO: 16745
  Synthetic sequence.

SEQ ID NO: 16747 - protein, 180 aa, Artificial Sequence
  Synthetic sequence.
RRDDKVRKLEKELRDSNRKANDESKKLRDELRRLNEEANRRVRELERRIERLLEKVKDDIDSEELERIERKAREVKKTLEDLNRKLNDTSRRSEEELKELNRELNRVVRELEEELRAMLENNVPEEELKKRVEEALEEHRRLVEEVRRRVERILERNDELIKRIEETVEDLLRRLEEEVR

SEQ ID NO: 16748 - protein, 180 aa, Artificial Sequence; identical to SEQ ID NO: 16747
  Synthetic sequence.

SEQ ID NO: 16749 - protein, 175 aa, Artificial Sequence
  Synthetic sequence.
SEIDEIVKEVERLLEKLKEDSRRTVEEVKKLLDELRKHSEDSVREIEELIERLRREIERDGDTEEVEKKIRDIKRRIEELLRRNEKLVKEIKDRLKKLLDENRERLKKIEKELRDKARAEEKLRRLEEELREILKRSEDLARKLDEDLKRILERTRREIKRLEEDLDRLDEEVRR

SEQ ID NO: 16750 - protein, 175 aa, Artificial Sequence; identical to SEQ ID NO: 16749
  Synthetic sequence.

SEQ ID NO: 16751 - protein, 175 aa, Artificial Sequence
  Synthetic sequence.
SESDEIIKEVDELIKRLRKHSKETVKEIEEILTRLEERSRKSVKEIEDEIRKLEDIVRKRGNTEEVRELIKKILEDIERMLEENERLAKEVKDRIEKLLRDNERLVRDIKRKLREKLSVEEKARTLERKLDKILEETKREAEELKKRLDELVEKTRRLIEELKRRLKELLDRAET

SEQ ID NO: 16752 - protein, 175 aa, Artificial Sequence; identical to SEQ ID NO: 16751
  Synthetic sequence.

SEQ ID NO: 16753 - protein, 175 aa, Artificial Sequence
  Synthetic sequence.
DESRKIVRDVEELIKRLEEHSRETVKRADRVLREDHKKSRDSVREIEKLIRDVKDKIDKRGRTEEVEKLLRDIIRKVEKLLEENRRHNRRVKEELKRALEENRRLLEEIKKEIEKKASVEEEVRRLKKELDDLLEETKDLIRRLEEKLDKNVKETEDEIRRLIEELKKILEDATR

SEQ ID NO: 16754 - protein, 175 aa, Artificial Sequence; identical to SEQ ID NO: 16753
  Synthetic sequence.

SEQ ID NO: 16755 - protein, 175 aa, Artificial Sequence
  Synthetic sequence.
REIDEIVKEIEKILRELKKRSDETVREIERLIEEDHRKSRKSVRDIEKLIDDLRKDVERRGDTEEVKKLIEDIDRRIKELLDRNRKHNTRVLKRIEDLLRENERLAREVEKRLKDDMRAEEKLRKLEEELRRLLEESKREADRLKKELRDNLKTTDELIKELKERLDKLKEDIER

SEQ ID NO: 16756 - protein, 175 aa, Artificial Sequence; identical to SEQ ID NO: 16755
  Synthetic sequence.

SEQ ID NO: 16757 - protein, 175 aa, Artificial Sequence
  Synthetic sequence.
DESDRIVEEVRRLIKTDHDNSRRSVRKIEELIARDHKKVKEIVDEIRRLIRELEELIRRDGDTREIEKLIRDIEETIRRALEELERHNERVKREVEKMLRDNEEHNKEVKERIRRKLRVKEKLDRLEEEIDKNVKRTREEIERLKRELDKNLEDVRRLAKELEDELRKLDEDAKR

SEQ ID NO: 16758 - protein, 175 aa, Artificial Sequence; identical to SEQ ID NO: 16757
  Synthetic sequence.

SEQ ID NO: 16759 - protein, 175 aa, Artificial Sequence
  Synthetic sequence.
SEIDRIIEDAERLLRELERNSDRSVEEIEKLIRDDHDNSRRTLEKIEKVIRELRKDVKDRGDTEEVERKIREILREIEELLRRNEKHNREVKERIKEVLRRNKELLDEIKKRLEDRVSSREKVKRLEEELRKILKKTREKAEELKRRIDRNVEETRRRARELKEELDRLLKEART

SEQ ID NO: 16760 - protein, 175 aa, Artificial Sequence; identical to SEQ ID NO: 16759
  Synthetic sequence.

SEQ ID NO: 16761 - protein, 175 aa, Artificial Sequence
  Synthetic sequence.
DESRKVIKEIEDLLEEWKRRSERMIRESEKLIEELRERVDKILEDIDRLIRTLDELRKAGVPREEIRKLAEEVRKRIEDLKREIKKLAEDIKRTDEKLLKESRDIVRKIEEIIRRKLSVEEEAKRLKDELEEILKESEDLSRRTKKELEDLLREVEKEIKKLEDKLKKLLDETDK

SEQ ID NO: 16762 - protein, 175 aa, Artificial Sequence; identical to SEQ ID NO: 16761
  Synthetic sequence.

SEQ ID NO: 16763 - protein, 175 aa, Artificial Sequence
  Synthetic sequence.
SETEKVIREIEKLIDDIRKESERSIEESRKLLKELEEIVEKAIRDSRRLLEDLRRLVEDGVDRDEIRKLAEEVERSDRELVKRIEDIARELKKRDEELLRENEKIVRTLEETIKRELSSEEKADTLRRKLEKLLEDTKRMSEKTKKEIEDLLKRVRELSEETKRRLDRILEDVER

SEQ ID NO: 16764 - protein, 175 aa, Artificial Sequence; identical to SEQ ID NO: 16763
  Synthetic sequence.

SEQ ID NO: 16765 - protein, 175 aa, Artificial Sequence
  Synthetic sequence.
SESDKVVKEIEELLRELRKRVEEIIRESEALIETLKKRVDDAVRESRKLIKDLRELIERGVPEKDIRKIAKDLEEKNKKLTDEIRRLAEELRDRDRRLLEEIEKLLRDIERTVDRKLSVREKAKKLREELRKLMEEVRRLSKETKDKLDELLKTVEELSKELRERLKRLLDEAET

SEQ ID NO: 16766 - protein, 175 aa, Artificial Sequence; identical to SEQ ID NO: 16765
  Synthetic sequence.

SEQ ID NO: 16767 - protein, 175 aa, Artificial Sequence
  Synthetic sequence.
SESDEVAKRIKELIDRLEERSRRSIRESDRLIKELEKEIEKAVRESEKLIRDLEELIRRGVDTREIEKLARELKKRNDDLTRKIEDIARKLKKRDEELLKENEDLVKEIDDSIKAALSVEEKMRTLEEDLKRLLEETRDMSRKTKEKLEELLKRVRDLSKKLAEDLRRLLEEVRR

SEQ ID NO: 16768 - protein, 175 aa, Artificial Sequence; identical to SEQ ID NO: 16767
  Synthetic sequence.

SEQ ID NO: 16769 - protein, 175 aa, Artificial Sequence
  Synthetic sequence.
SETDEVIKTLEELLERIKRRVEELVKRNKDLIKALEEEVRRIIKESKKLIDDLAELAKEGVPKKDIEKIARDLEKRDEELLDRIRKLAEELRRRSKKSLDEVRKIVRELEEEIDRRLSDKDKADRIREEIRKLEEEVKRLHDELKKELDDLLRRVEEDSKRTKERLRKLLTDVKK

SEQ ID NO: 16770 - protein, 175 aa, Artificial Sequence; identical to SEQ ID NO: 16769
  Synthetic sequence.

SEQ ID NO: 16771 - protein, 179 aa, Artificial Sequence
  Synthetic sequence.
SEVDDLIRRLEKLLEDIKRRVEELVRRDEKITKDWERESERLIRELEELLKTIADLVRRRKESKEEVEKVIRDAERKIREILETSKELLRRSKKHTKEVLEEVERLIDEARKMIEEVRKRNVDKKKLDEIRKRLEEILKRVRELLERLDRENEDLARKSKELADRIRKELKRILDEVRR

SEQ ID NO: 16772 - protein, 179 aa, Artificial Sequence; identical to SEQ ID NO: 16771
  Synthetic sequence.

SEQ ID NO: 16773 - protein, 179 aa, Artificial Sequence
  Synthetic sequence.
DEVDELVKELEESLRRSREEIERLVREDEELTKTIREEVKKLVKTDEDLSKKIEDTVRRRREADEKIKEMIDRSKKHTDEVLERVEELIKRSKDHTKEVVDRVEESIKRNDERLDEIRKRNVDKDKIKELKERNDKLLEEARRLAKELKERNDTLLKEVREELRRLRERNDRILKEAKK

SEQ ID NO: 16774 - protein, 179 aa, Artificial Sequence; identical to SEQ ID NO: 16773
  Synthetic sequence.

SEQ ID NO: 16775 - protein, 179 aa, Artificial Sequence
  Synthetic sequence.
DEVDKLIRDLEELIRRIRKRLKELVDRDRELTREIRRRIRELIEESKEALERIDKRVKERKEVREEVEDLARELKRLNDEVLKEIEDLLRESKKHTDDVRREVERLIKEIREKLEEIRKRNVDKDKIKKLKDDLDRLLKEAEDRLRELEERNKRLLDEARKEIEKSDRRLEEILERVRR

SEQ ID NO: 16776 - protein, 179 aa, Artificial Sequence; identical to SEQ ID NO: 16775
  Synthetic sequence.

SEQ ID NO: 16777 - protein, 179 aa, Artificial Sequence
  Synthetic sequence.
DEVDELIKTLKKLLEDIRERVERLVTDSKRSLDEIRETVRDLVRRDKELLKRIEDTVRERKEVREEVEELIKRSEEHTEDVERRVRKAIEEHKRLNDEILREVEELIKRIEEAIREVAKRNVDKDKLEKIKRDLEKILTEVREALRELDERLKKLAEEAKRLLEELRKRNRDILEKVRK

SEQ ID NO: 16778 - protein, 179 aa, Artificial Sequence; identical to SEQ ID NO: 16777
  Synthetic sequence.

SEQ ID NO: 16779 - protein, 179 aa, Artificial Sequence
  Synthetic sequence.
DEVDKLIKEIEESLRRSEKEVRDLVRESERSLKEIEKRVRELVKRDEDLLKEIEEVVRKKKEAREEIEEMAKRSEEHTEEVRKEVEELARRHKERNKEILKRIRESMKRNDELIDEIAKRNVDEEKLKRLRKENKDLRDRVEEELRRLDKELDELLETVRRLLDELRKRNKKLLDEARK

SEQ ID NO: 16780 - protein, 179 aa, Artificial Sequence; identical to SEQ ID NO: 16779
  Synthetic sequence.

SEQ ID NO: 16781 - protein, 179 aa, Artificial Sequence
  Synthetic sequence.
RLEEEIERLRREVEELIERSKDLIRRSHTKSRKLIEDVKRELDRLRREVEELIKRAEDRTRREEVDKKLKDLLRELEKILEEIDRNIRRNMKENEDLNRRWKEVTEELLKELEEILKRIRDRVEDRVVREAEKLIRKIAEDNRKALEESDELIRRSEKDVRDMVRRAEELIEEIKRRVD

SEQ ID NO: 16782 - protein, 179 aa, Artificial Sequence; identical to SEQ ID NO: 16781
  Synthetic sequence.

SEQ ID NO: 16783 - protein, 181 aa, Artificial Sequence
  Synthetic sequence.
SKDEEVERLKEELDRLLEEVRRLSEESKKRNDELLKRAEEIIEELKKELDEIREEVERRGLPEEKLERIERLVKRIKERIEDLLKKSREEHEKSKRRDEELLRRLEEVAKEVKRRLDEMARKGEDKDTVVRRAKKVIDELRKDVERVKRESDEVLKELEKLNREIEREVRKLLKELRDTVR

SEQ ID NO: 16784 - protein, 181 aa, Artificial Sequence; identical to SEQ ID NO: 16783
  Synthetic sequence.

SEQ ID NO: 16785 - protein, 181 aa, Artificial Sequence
  Synthetic sequence.
RSEEEARKLERENKKLVDDARKLSEESRRRNDKLVEEARRIAEELKRELDRLLEEVDRRGLPEERLRDIRRLIEEIKRRVEELLRRSKKMHEDSKKRDDDLLRRSEELHEEIRKAIEKMRKDGEDTKTVVDRVKKLLDDLREVNREILRESDKVLRDLKRLNDEIKREVEELLERLEREVR

SEQ ID NO: 16786 - protein, 181 aa, Artificial Sequence; identical to SEQ ID NO: 16785
  Synthetic sequence.

SEQ ID NO: 16787 - protein, 181 aa, Artificial Sequence
  Synthetic sequence.
SAEEDAERMKDRNRRLLEKVRRLSEESKRRNDKLVEDAKKLSEDTRRKLEDIARKVRKRGLPEDKLRRIEELVKEIEKRNRELTKRSEDAHRESKKRDEKLLRDSEKRHREVLKRIEDLLRRGEDKDRVSEEIDRLLRDLERRNREILKESKEVLDRLKKLNEEILKESEDLLRRLEEEVR

SEQ ID NO: 16788 - protein, 181 aa, Artificial Sequence; identical to SEQ ID NO: 16787
  Synthetic sequence.

SEQ ID NO: 16789 - protein, 176 aa, Artificial Sequence
  Synthetic sequence.
SEIEKVVKDVDKLLKELEDHTRKSLEDSKRLLDELRKHTEDTSREVKELLERLEEVIRRNKEMKEELRRIAKKIDEDIKRLVERNKKIADDIRREDKKLLDRNRELVDRIREEIDRRIRSKEDADRLRERLDRILEESERLSRETKEELDRLLEDSKRKIRELEERLKKLLDDAER

SEQ ID NO: 16790 - protein, 176 aa, Artificial Sequence; identical to SEQ ID NO: 16789
  Synthetic sequence.

SEQ ID NO: 16791 - protein, 176 aa, Artificial Sequence
  Synthetic sequence.
DDSDKVLKELEKLLEDLERHTRESLRESDELLKELKEHTKTTLRRSERLLRELKRLVDENKEAVERIEEAARRIEEEDRKLLKRNEELVREIEKRDRELLERNRKLAEEIKEAIRRKVRVEKDVEEVRRKVEELLKDSERLSKETKERLRDILRDSRRLSRETKEELKRILKEVRD

SEQ ID NO: 16792 - protein, 176 aa, Artificial Sequence; identical to SEQ ID NO: 16791
  Synthetic sequence.

SEQ ID NO: 16793 - protein, 176 aa, Artificial Sequence
  Synthetic sequence.
RESEEVIKEVEKLLEELKENTKRTLKESRDLLKTLEDHTRETKKTVEKMLKELEDKVRKRKESEEEIRKVVEDIKREIERLARENERIAREIEERDRELLDRNRKLAEDIEEKIRRKIRVEEEADRLRRELKKILDRSRELSRKTKEDLKKLLKESEDIIRELDRRLEEILKEVER

SEQ ID NO: 16794 - protein, 176 aa, Artificial Sequence; identical to SEQ ID NO: 16793
  Synthetic sequence.

SEQ ID NO: 16795 - protein, 176 aa, Artificial Sequence
  Synthetic sequence.
EEIERVIKEVKDLIEELRRNTERTLRESEELLKTLKKISDDSKEEVERMLRELRELVKSNKEAKEEIRKVADRIRKVIKRLMDENKKVADEIRKRDEDLLDENRKLIDRIRREIDKKIRSKEDADRLRREVDKLLEESKRLSEETKRELDRILEETKRTLERLKEELDKILEEVER

SEQ ID NO: 16796 - protein, 176 aa, Artificial Sequence; identical to SEQ ID NO: 16795
  Synthetic sequence.

SEQ ID NO: 16797 - protein, 174 aa, Artificial Sequence
  Synthetic sequence.
SEKEKLVEEVRRIIERHKRVTEELLKELRRILKEWEDVSRDIERRVREILERLERAARDGEDKRLVRELVKDIERLLKKLLDDSKKIVKEIDEVLKELLKTDEELVRRIREKLERADKDKDLEELKKELEDSARRSKKLADDVREELKTLLRESERIIKELRKELEKLLREVEK

SEQ ID NO: 16798 - protein, 174 aa, Artificial Sequence; identical to SEQ ID NO: 16797
  Synthetic sequence.

SEQ ID NO: 16799 - protein, 178 aa, Artificial Sequence
  Synthetic sequence.
TLEEVLKEVKRRVERVNEEDKRVLDESRKRAKEINDEDRRLLEESKRKAEELLERLRRKDKDAKEVEEKIKRVLEELAREHEKINERIKEEVKRLEEEHKKINERTKRLLEDLKRLVESGLDEDRLRREAERILREIRELSRELKRKNEELLRTIRRVSEELRKKNEEILERVDREIK

SEQ ID NO: 16800 - protein, 178 aa, Artificial Sequence; identical to SEQ ID NO: 16799
  Synthetic sequence.

SEQ ID NO: 16801 - protein, 173 aa, Artificial Sequence
  Synthetic sequence.
SAKELLDDLRKKIEDNVRETEKLLRRLREKVEKIEREIKELVRKLREDLERLLEKVKRRGVEEEVERLIREIIKKIEELVKRLEELLKEILERIEKLAEDNRRHNEEVKKDIDDKRIEKEVVDTVRELIERDHKKSRDSVRRVDELIDRARKDVRRVVEEVRKDLEKLDEDVK

SEQ ID NO: 16802 - protein, 173 aa, Artificial Sequence; identical to SEQ ID NO: 16801
  Synthetic sequence.

SEQ ID NO: 16803 - protein, 175 aa, Artificial Sequence
  Synthetic sequence.
REVEEVLKDLKRLIDEAKKRVEDAIREIDRLIREWERLNREMLREIKKSNDEVRELVKAGVPKEDIERLLREDNKLIEELLRRSEEIARDIERKIRKILEDLKRIIEELKKRVKDALRVEEAVRDVERRLEKLLKEIKDLIDRLKEKVDRVKREVERSIEELKRHNEEVLKEVRK

SEQ ID NO: 16804 - protein, 175 aa, Artificial Sequence; identical to SEQ ID NO: 16803
  Synthetic sequence.

SEQ ID NO: 16805 - protein, 175 aa, Artificial Sequence
  Synthetic sequence.
KEVEDVLEELDRLIETWARLNRELVERIRRLLEEWREENRKVVEEVRRSNETLRELVERGVPKEDIRRLAKEDNERIEELLKRSRKIADDIRRAIEEIVRRSREILRELEKRVDDKLRVEEVVRRVKDKLREVKREVEETARELRERVDDLLRKVEESVTRLKRHNEDLLREVER

SEQ ID NO: 16806 - protein, 175 aa, Artificial Sequence; identical to SEQ ID NO: 16805
  Synthetic sequence.

SEQ ID NO: 16807 - protein, 175 aa, Artificial Sequence
  Synthetic sequence.
SEVEEVLRDLKRLLEEWKKRNEDLVRDVERLLREWKEANDRALKKSRDSNKELERLARDGVPEKDVEELAKRDNEENKRLSEESARIVERIREKIEEALKRSTDIVREIEKRVEKALRKKEMVERVRREIKRLEEEVKKTITDLKERLKKLKEDADRSSRESEEHNKKVVEDVRR

SEQ ID NO: 16808 - protein, 175 aa, Artificial Sequence; identical to SEQ ID NO: 16807
  Synthetic sequence.

SEQ ID NO: 16809 - protein, 175 aa, Artificial Sequence
  Synthetic sequence.
REVEEVLKELDRLIDELRKEVEKIVREVERSNDEWRRRNKELVDEVRRELDRLRKLVDDGVDKKDIRRLLDEIRKLIERVLKESRDILRKDNERIKELADRIRRLVEDLERKIEEKLRVKEVVDDVKRKLEDLKRRVDELVRRLEEHNKDLRRKVEESAKDLRRKLEELRERVER

SEQ ID NO: 16810 - protein, 175 aa, Artificial Sequence; identical to SEQ ID NO: 16809
  Synthetic sequence.

SEQ ID NO: 16811 - protein, 176 aa, Artificial Sequence
  Synthetic sequence.
SEKDEVRKTIERLLKEVEKMIRRVLKEVEDLLRELKKRTEKLKRELDESHRRVKEVIERRKEDRDLLRRLIEENERLIEEAKRELDEVDERVRRRIEELLKELEKIVRDVEDMLRRLNLPRELLEEVERALKKLKEDVDKVIEELREKLKRHHEDVKRAIDRVREESKRLKDEAEK

SEQ ID NO: 16812 - protein, 176 aa, Artificial Sequence; identical to SEQ ID NO: 16811
  Synthetic sequence.

SEQ ID NO: 16813 - protein, 176 aa, Artificial Sequence
  Synthetic sequence.
REDEEVVKTLRELLREAKERTDRLLRELREIIKTMRKRLRDIEEDLRRSHREIEKLIRDRKEKREELRDIVRRNDELIRRLTEDLERLIEEARKVLKDIERDLERVDEELEDTLDKANLKRELLEEVRKELERHHREARRAVEEVKKLIDDLMREVRKLIDEVRKDSERLRREVER

SEQ ID NO: 16814 - protein, 176 aa, Artificial Sequence; identical to SEQ ID NO: 16813
  Synthetic sequence.

SEQ ID NO: 16815 - protein, 176 aa, Artificial Sequence
  Synthetic sequence.
DEDEEVKRRLEKLLEDADRVTEKIRKDLKETHDRVKRAIDELKKELEKSHRTIKEVIERRKEKRKDLTKIVRDNERLIEEVKKRLEELIRKNEEIIKELEKELKKIDDDLDKKIKDANLKRELVEEVRDRLRKHHKKVRDIVDDVDKRSKDLERTARRVIEDVKEKSDRLKEEVDR

SEQ ID NO: 16816 - protein, 176 aa, Artificial Sequence; identical to SEQ ID NO: 16815
  Synthetic sequence.

SEQ ID NO: 16817 - protein, 174 aa, Artificial Sequence
  Synthetic sequence.
EDEERVKEKLKRLLEKAEEALRRSKRRNEENKKEHERVLKEIDERLKRLEEKVRRGNLERRTVEEIRRILEDIKRKLDKLTKESEDLHRRNDERVKEVFRRIEKLIRDIEEDIKAGRSREDIERLLKELDDRIRRIIEELKRSDEELHKENRRKIKELEDLVREADKRIEDKRK

SEQ ID NO: 16818 - protein, 174 aa, Artificial Sequence; identical to SEQ ID NO: 16817
  Synthetic sequence.

SEQ ID NO: 16819 - protein, 174 aa, Artificial Sequence
  Synthetic sequence.
DDEKEIKDRLDDNKRKDDEMTKRAEDELRKNLETTKEALRDIKRKLDRLREKVERNNLDEKTLKEIEDVLRTIEEEARRLLEDSKRVHREIEERMKRLNDDSKRVHEDIKRALDGGVRREELEKIVRDLHKRNKEVIDDIRRLIDELHKRDRETIKRLEEIVRRADEKIKEKAR

SEQ ID NO: 16820 - protein, 174 aa, Artificial Sequence; identical to SEQ ID NO: 16819
  Synthetic sequence.

SEQ ID NO: 16821 - protein, 174 aa, Artificial Sequence
  Synthetic sequence.
SDEERIEERLKRNEETDKRATDENEKRNDDLLRRAKEALDRNRERNDELRDKVRKENLDDETVKRIEKLLRDNDRRLKELLRELEKRLRDNREKLKELNKESKKRHEEVRERLRAGVRREELSKLVKELHDDNREKIKDSDRSDDDIRREIERMIRETNKSDEDIARAIDESAR

SEQ ID NO: 16822 - protein, 174 aa, Artificial Sequence; identical to SEQ ID NO: 16821
  Synthetic sequence.

SEQ ID NO: 16823 - protein, 174 aa, Artificial Sequence
  Synthetic sequence.
SERERVEERLKELAKRVEDAIRRLKKDLERTKEEHKEADRRVKEKLKRLKEEVDRANVDEDLRRKIEELLKRAKDENKKLNEEVERILRELEKRYEELKRRIDRLLDTLRKKLEEGTRDTEVEELLKDVKRKIEEMIKELKRLNDELNKRSEEMIRRNDDLIKRLEEEIRKDSK

SEQ ID NO: 16824 - protein, 174 aa, Artificial Sequence; identical to SEQ ID NO: 16823
  Synthetic sequence.

SEQ ID NO: 16825 - protein, 176 aa, Artificial Sequence
  Synthetic sequence.
SSEDEVRKTVDELRERSERTIRDLERVDRELKKEHEELIKELREIVKELREKVKRASKEPTSEREIERLKEELERTMRELHKKNKRVREKHEELLEELRRRNRKLNEEVKKTVREMRDKVDKRIEEELRKLHKENKEAVERSERTNRDILRRNDEADKEIEKELRELIEKLERDRK

SEQ ID NO: 16826 - protein, 176 aa, Artificial Sequence; identical to SEQ ID NO: 16825
  Synthetic sequence.

SEQ ID NO: 16827 - protein, 175 aa, Artificial Sequence
  Synthetic sequence.
SEKEDLKEKLKRNEEEHRRAVEEIRKRLDENRRRHEKVIKEIEDALKKDEDDVDKENLDEELRKELKRLHDEIRRRLEELNRRSKKRHKEVEDKLRRLDEESEKMHRRVEDLIRRGELDKDELTREIEKLHRTNREMVRDLRETLKRLHEENKRLVDELRRLLEELHRRTREASR

SEQ ID NO: 16828 - protein, 175 aa, Artificial Sequence; identical to SEQ ID NO: 16827
  Synthetic sequence.

SEQ ID NO: 16829 - protein, 174 aa, Artificial Sequence
  Synthetic sequence.
SEEEEVRKALERLRRELKRVLERSEELLKEWEDRLRRVLEESRRLLERWREELEKDGIDEDVLRELEKDIKKVKEDHDRDAEKLRRIIEEIRKRHEEVFRRLEDLLRKVRERLERGRRREELKEILKRLEDTLREIEKEAKRLNDELARVLEEIRRKSERENRRLKELIDRLRK

SEQ ID NO: 16830 - protein, 174 aa, Artificial Sequence; identical to SEQ ID NO: 16829
  Synthetic sequence.

SEQ ID NO: 16831 - protein, 171 aa, Artificial Sequence
  Synthetic sequence.
SDRERLEEMLKRLKEELEKVRRDNERSLEEIKRSVDRVLEEHKRTLEELKREVDRANVDEDLKRELKELLEDSKRRVEELKEKHERLLRKNKKELDELKKRLDDLLKKIRDDDVRGEEADEVVKRLADVLEKAREDLKRSDKRLRDSNRESRKELEKINRDLRRKLEEAKR

SEQ ID NO: 16832 - protein, 171 aa, Artificial Sequence; identical to SEQ ID NO: 16831
  Synthetic sequence.

SEQ ID NO: 16833 - protein, 171 aa, Artificial Sequence
  Synthetic sequence.
KDEERLETVLREIETRAEKVARDHRDSLRRIREELERVLKENKDTLKRIREELEKTNVDEKLKTEADRLEEENERRLRELEKELDELLKRSEDTLRKLLKELRELLKRVRDRQVRGEEVKRVLKELRDLLEEIRKRLEDINRDLKRKLDEIEEELRRSDEKLKRDLEEARK

SEQ ID NO: 16834 - protein, 171 aa, Artificial Sequence; identical to SEQ ID NO: 16833
  Synthetic sequence.

SEQ ID NO: 16835 - protein, 171 aa, Artificial Sequence
  Synthetic sequence.
SDEDKLREDLRRLEEELKKVLDDHRKSLKEIEDSLRRVLEENKRTLEKLKRDAEKANVDEELLERLKKLLDDNRKRVEELEERHRRLLKESEERLRRLVEEFKRLLEKIERDQVRGEEAKKVVKALEDVLREIRERLKRINDELRERNKKSSDELRKSDERLKRELDKMRK

SEQ ID NO: 16836 - protein, 171 aa, Artificial Sequence; identical to SEQ ID NO: 16835
  Synthetic sequence.

SEQ ID NO: 16837 - protein, 183 aa, Artificial Sequence
  Synthetic sequence.
DADKELEKLLREWEKRSEELRKRLEDINRRWEEESKRLKKELKDINADLRRKVEELRRDEDKDRVREVVKRLSERNDEVDRKVKKTSEDIADRNRREDKKIREDSKKIKEDLERALEELREKVSSDVIRRAKEELDRIEKKDRDVLDDNRRLIETWRREDKKVNDDNRRSNEELKRELDKTRE

SEQ ID NO: 16838 - protein, 183 aa, Artificial Sequence; identical to SEQ ID NO: 16837
  Synthetic sequence.

SEQ ID NO: 16839 - protein, 183 aa, Artificial Sequence
  Synthetic sequence.
SAEEELKELLERWDRDSKRAEEELRRLLEESRERSEKVLRDLKRLLDEMEDAVRKLKRDSDKDRVRRTVEELTKTVRKKLEEIERRTREIKKELERTLKRIEERSREIKKDLERSLERLRKDVSSEVIERFKDVLRRIEKRNKEVIDRAKEVIDEDEKRNREVIERVERKVERLRKEVEDREK

SEQ ID NO: 16840 - protein, 183 aa, Artificial Sequence; identical to SEQ ID NO: 16839
  Synthetic sequence.

SEQ ID NO: 16841 - protein, 184 aa, Artificial Sequence
  Synthetic sequence.
EEKERMREVLKRLEEEAKKVLDDNRRAVEEIEKKDREVHKRNRDLLERWREEMEEILRKARERVDKEDLDRLEETLRRLIEDNRRKDEEIRKVSEDVKRDNRKKNEDIKRRLEELKKTVADVERKNSREEELKKIIERAREELEKVRRELEEHLKRWDEISKKLSKDLERHNEEVARTLKRSRD

SEQ ID NO: 16842 - protein, 184 aa, Artificial Sequence; identical to SEQ ID NO: 16841
  Synthetic sequence.

SEQ ID NO: 16843 - protein, 181 aa, Artificial Sequence
  Synthetic sequence.
SVLEEFKKRIEELHRRDRKVLEDHRRRLKEWEEELKRVLDEHRESLKRIKERVDRVKKDLDDEELKRVDKKLKDLEKKSRDLVREVEKILRELRKRSKDAEDKVKKVNEDVRRRAEKLARDLREDSDALRELLREWDKLSKELEKELRDLNREVERSIREAKKKLEKANEEMRRTLEKDRK

SEQ ID NO: 16844 - protein, 181 aa, Artificial Sequence; identical to SEQ ID NO: 16843
  Synthetic sequence.

SEQ ID NO: 16845 - protein, 181 aa, Artificial Sequence
  Synthetic sequence.
STEEDAERALEELKEELRRVEKENRDSLKRIREKLKEVEDEHRKTLEELKKELDDVMRKIKDERKKRKVEKLRRELEKAKRDSEKLLRDLERKIDEVEKTSKKMLEELERDLRKILDDVRKAKLDKDSLKRLLDEARKKLEELKRRLEKLDRDLDESLKRLKEDLDRLDRELRRLLDELDK

SEQ ID NO: 16846 - protein, 181 aa, Artificial Sequence; identical to SEQ ID NO: 16845
  Synthetic sequence.

SEQ ID NO: 16847 - protein, 181 aa, Artificial Sequence
  Synthetic sequence.
SVEEEARKALDDLRRRLEEVTRRHRESLKELREELDEVRKENEKSLKKIKDDLEAVRRRITDERKKRKVDEARERIKEVEERSRRKLRRLEEEIDKAEEESERLLETLKEELKRLMDEVEKAKRDEEELRRLLKKLEDDLRRLKKRLDELDRRLRELVKRLLEDLKRLDDELKKLLEETER

SEQ ID NO: 16848 - protein, 181 aa, Artificial Sequence; identical to SEQ ID NO: 16847
  Synthetic sequence.

SEQ ID NO: 16849 - protein, 175 aa, Artificial Sequence
  Synthetic sequence.
SAEEELKRLLEEHKKESEDVKRRLRDLLRELEDIHRRMTERLRELLKRLDDILRRRNSDDETLKRLVDELRKEIKKVEDDDHRNLERLREELRRLEEDLKRRNEETKEEVDRVRKKGSLTEEILKKLEEISRRVREKVKKELDELKELIRRHARKLEKILEEIRRLIEDLERRAR

SEQ ID NO: 16850 - protein, 175 aa, Artificial Sequence; identical to SEQ ID NO: 16849
  Synthetic sequence.

SEQ ID NO: 16851 - protein, 184 aa, Artificial Sequence
  Synthetic sequence.
SEAEEVLKRIRDILETLRREHERILKEIRELNEEFKKEVEKALRKIKRELEELEKDAEREGTTEELRKKVEKLLRDIKETLRRLEEKSRELEERIRELLKRLHETVRTLEERIKDLREELRERVDERVEKKIEELLREIRKVNDEVHKRIRKLLEDHRRTVDEARRRIEELLRRLKKTLDDIDK

SEQ ID NO: 16852 - protein, 184 aa, Artificial Sequence; identical to SEQ ID NO: 16851
  Synthetic sequence.

SEQ ID NO: 16853 - protein, 181 aa, Artificial Sequence
  Synthetic sequence.
SDKDELKRLLDDHERTSTRARESLEKLSREHRKTSREVEERLKRLVDAIRDTARRVDSRRREVEETLKEIEKRLRELKRELEELDKEFEDSVRKLKRELERLNEEVRKRVEDLKRRMAEGTDEEVVRRILRELRELNERAKEMLERILRKLEELNREYKKKVREILERIKELLRDLRRKAN

SEQ ID NO: 16854 - protein, 181 aa, Artificial Sequence; identical to SEQ ID NO: 16853
  Synthetic sequence.

SEQ ID NO: 16855 - protein, 181 aa, Artificial Sequence
  Synthetic sequence.
SADDEIRKLKKEAEDILRKAREDRERLKEKNRKIDEDMRRTLKKLHEETRELEKKVRREKGEDERVKELLDDLRRKDDDMRKRVTELHEENKKIDDEVRREVERLEEEIRDTIRKLDEDVKRDGVTEELVKEIRELLRRLEEKIEELRRRYEKKLEELKRKVDELIRRYKRKLERVAEEVK

SEQ ID NO: 16856 - protein, 181 aa, Artificial Sequence; identical to SEQ ID NO: 16855
  Synthetic sequence.

SEQ ID NO: 16857 - protein, 175 aa, Artificial Sequence
  Synthetic sequence.
SEEEELVRRVEEKIKASEKHARELVEETRKKLDESRKKWKDLARRSRRLLEELKDKVDKGTDKKRLAEEIKRVLDEHEDENRKLADEDRELRKRHKEKNKEHEERNRRLREELERRLDETEELRRLEKELRDLNKRVKEESRKLEEDLKDIHERAKEDSKRLKRELEKIKEEVER

SEQ ID NO: 16858 - protein, 175 aa, Artificial Sequence; identical to SEQ ID NO: 16857
  Synthetic sequence.

SEQ ID NO: 16859 - protein, 181 aa, Artificial Sequence
  Synthetic sequence.
DAERILRELEERLKRLLDEHREISKELRKRNKDLLKEHKERSKRVKEELKELVKEVEDGGKPREDVDRLRKSAEKVEEELDRMDEEFERDNRELDRRLDELDKEIEELVETVRERLERAEERGEPIEELVKEVEKLIKELREKSREVEREVDKMIRDNARKSEKIVRDAKRLLEKLEREVR

SEQ ID NO: 16860 - protein, 181 aa, Artificial Sequence; identical to SEQ ID NO: 16859
  Synthetic sequence.

SEQ ID NO: 16861 - protein, 181 aa, Artificial Sequence
  Synthetic sequence.
RSEDILRELRERVKRSEERHEKISRDLERKNRELLKEHRERSEKLKRELEELVKRVEDRGLPEERLKELRKIAEEVDRELEEMDRRVEEMNERLDRRLEELDDENRKKVKEIKRKLDEDAKRGEEAEDLARRVDETIKDHERHSEEVKRDVTEKIKENEKLSRDIVRRVEKLLRDLEREVR

SEQ ID NO: 16862 - protein, 181 aa, Artificial Sequence; identical to SEQ ID NO: 16861
  Synthetic sequence.

SEQ ID NO: 16863 - protein, 181 aa, Artificial Sequence
  Synthetic sequence.
SREDILRDLRRRLEELLRRHKRISDELRKRNKKLLDDAEKRAKELREELEKLVREAERRGLPEEELKRLKEIADEVKKRLDELVKELRRDNERLDKTLDDLNREVEELVRRVEDELRRAAERGEEIEELVKRVDKLIKELKRKSEEVMKRVDELIRRNERLIREIVKEVEKLLEDLEREVR

SEQ ID NO: 16864 - protein, 181 aa, Artificial Sequence; identical to SEQ ID NO: 16863
  Synthetic sequence.

SEQ ID NO: 16865 - protein, 181 aa, Artificial Sequence
  Synthetic sequence.
SAEETIERLKEEIEKLLREAEEILRRLRERNRRLLEEHKDISRKLEEELRKLMEKVRRGGLPEDRLRELERRLKEVEDRLKDLNRKVEEKNKELDRRLDKLAEELKKEIRDVERELDDLRRKGTEVEELVRRVRELIKRLRDMAKEIEERVDETIRRNRRLSEKVARDVERLLRELEERVR

SEQ ID NO: 16866 - protein, 181 aa, Artificial Sequence; identical to SEQ ID NO: 16865
  Synthetic sequence.

SEQ ID NO: 16867 - protein, 181 aa, Artificial Sequence
  Synthetic sequence.
DAERILKELEERLDRLSEEAKKILDELRRENEELLREHDERVKKLKEDLKRLEKKVEDGGLPEERLDRLRKLVEKVRKRLEDLNKRTRELNKELDERLERLLEELKRTIEKVKDELRKEAEKGTEVEELVKRVTKLIEDLRRLAKKISDEVRKLIEENRRASKRVEDEARELLKRLEDAVR

SEQ ID NO: 16868 - protein, 181 aa, Artificial Sequence; identical to SEQ ID NO: 16867
  Synthetic sequence.

SEQ ID NO: 16869 - protein, 172 aa, Artificial Sequence
  Synthetic sequence.
SEIEKMVKDVRDLLKRLKDEVKKISERWEDSLRKLKKRSEDTVKRVKEILEELRRRNLPRDEVREEVKKIKEELDRLNEEFKKRNEEDRRDLERAAEEIKKLLKDIEDELRRRLRKRDALRELERELDKLRKEIKKELDRLRKENREVNERHKELSKRLEEELERVKRELDT

SEQ ID NO: 16870 - protein, 172 aa, Artificial Sequence; identical to SEQ ID NO: 16869
  Synthetic sequence.

SEQ ID NO: 16871 - protein, 176 aa, Artificial Sequence
  Synthetic sequence.
DEVRELVKTVKKVLDDIRREVEETLRRYEKLVEDLKRRSDKSVKDVDDEIKRAEEEGDKDKELIDRIREEMEDLKRKHEDEHRRIEEELKRLNDEVKKILDELRERLKRLDEDLRRKRLDEELIKRLREEAEKLIRRAKEEHERLEEESKRLLEENEELLDRLDKKVRTLLDKLEK

SEQ ID NO: 16872 - protein, 176 aa, Artificial Sequence; identical to SEQ ID NO: 16871
  Synthetic sequence.

SEQ ID NO: 16873 - protein, 179 aa, Artificial Sequence
  Synthetic sequence.
SEEDRVRETVKKLLEDHRRKTEKVTEDVRRLLKENREKVEDAVDKARKLLKRLEELRREGELSEDDLRRVIEEIKRRIDEVERRLRKHHDDIRRTLEELDRDNDETLRRIEKELKRLVDEKVDDEKLKRIEEELRKSRERTKRLLEEIRKELEDSKKEVEDLLRRLREELKRLKDEIER

SEQ ID NO: 16874 - protein, 179 aa, Artificial Sequence; identical to SEQ ID NO: 16873
  Synthetic sequence.

SEQ ID NO: 16875 - protein, 182 aa, Artificial Sequence
  Synthetic sequence.
SEVEELVKRAEELIRELKKLSEDSVRELEKLLDEYRKTTEKLKRELEELLKEVEDVVRKLRDQDDDEKIRKTAEELVKRLEDILRKLEEVNREKKERAKRLLEKHEELLRRLDRRLEDLRRKIKVDEKLLRKIEEDVRRLKETNERLLKRVDEELKRLDEESRRVLKEAKERLKELKDRERK

SEQ ID NO: 16876 - protein, 182 aa, Artificial Sequence; identical to SEQ ID NO: 16875
  Synthetic sequence.

SEQ ID NO: 16877 - protein, 178 aa, Artificial Sequence
  Synthetic sequence.
DEVEKVLDELEKVIREVEERIKTTNKRLREVVERVERRIDKSDRELEEMIERVERKLEDDERARRLIERLRDLLRRLRKRSKELIDELRKLLKDLEDRSRDLLRELRELLERIKRKVEAGTPSEEVRKEVRRLDKRVKEIVEESRKLVKELAERVEEIVEESKRLVEKLAREVDETRR

SEQ ID NO: 16878 - protein, 178 aa, Artificial Sequence; identical to SEQ ID NO: 16877
  Synthetic sequence.

SEQ ID NO: 16879 - protein, 178 aa, Artificial Sequence
  Synthetic sequence.
SEIEKALKEAREAIEDAKKKIDDTDRENEKASRDAERRIDKSDKEAEEAVRRAEEEAEDDERARKLIEDLRKLLKELKETSEKLKEEIRRSTEEHRRRSEELKKELEKLADEIEKAARAGRDKDEVTKAARKAADDAREAAERSRKLAEENARRAKKAADDSRKLARELAKEAKKAAD

SEQ ID NO: 16880 - protein, 178 aa, Artificial Sequence; identical to SEQ ID NO: 16879
  Synthetic sequence.

SEQ ID NO: 16881 - protein, 175 aa, Artificial Sequence
  Synthetic sequence.
KELEDVLDTVRRAIERVKRESKKINDELEKELKKVKDELDKSHEEVRRAVEDVARKLKDVEEVKRDLERLLKEDRELIKRIVDRLRKLLKESKDHSREVVKDLRRVLEELRKLVEEGLDVKDIEKLVRDVVRRAEKVVDDDRKLVRDIVRDAKRVVRDSERTVRDIVKKADENTK

SEQ ID NO: 16882 - protein, 175 aa, Artificial Sequence; identical to SEQ ID NO: 16881
  Synthetic sequence.

SEQ ID NO: 16883 - protein, 175 aa, Artificial Sequence
  Synthetic sequence.
SKLEKILKDLERAVREVARELERTHRELEEAVKKVKKRLEDTNRRLTEALKRVKDKLDKVEDVKRKLDKLNEDDRRLIREIVEELRRLLEENKRKLDKIEEDLRKLLEDLDKLVKDGLDVSEIKKLVDDIVRRLRKVVKDSEREVREIMKRADDVVRTSEKTVEDIVKEAEDDAR

SEQ ID NO: 16884 - protein, 175 aa, Artificial Sequence; identical to SEQ ID NO: 16883
  Synthetic sequence.

SEQ ID NO: 16885 - protein, 175 aa, Artificial Sequence
  Synthetic sequence.
SELEEAAKRAREAAKKAKEALKRSLKEAEDAAREAEEDLKRSNDKNRKATREAEERAKTARELLKRLRESTKKHEEDTKKLAEDIRRLLEELRKRSEELAREIDKLLEDLERLIRAGLDAEEAKKAADDLARKAKEAADESKRLSEELAKKAKEAAKTSDKLAKENAEEAKKAAK

SEQ ID NO: 16886 - protein, 175 aa, Artificial Sequence; identical to SEQ ID NO: 16885
  Synthetic sequence.

SEQ ID NO: 16887 - protein, 175 aa, Artificial Sequence
  Synthetic sequence.
DELERVLEDLKRVMEEVERKLRESNKELEKAVRRVEELLKRSNEKNRKVTREVREKAKTDRELLEELDDSTRKHEEETKKLVKEIRDLLEELRKTSERLVEDIRRLLKELKELIEAGLDAKDVEDLVRRLMEKLERIVEESERLSDELRRRAEEVVKTSEDLVRENAKRVDDAAK

SEQ ID NO: 16888 - protein, 175 aa, Artificial Sequence; identical to SEQ ID NO: 16887
  Synthetic sequence.

SEQ ID NO: 16889 - protein, 175 aa, Artificial Sequence
  Synthetic sequence.
DELEEIEKKLRDVVREVEEKLRETNRRLREVVKRVEERLKKSNEDLRRAVRKVEESVKTLEEDLRRLKELLRRLEEESRKLVEEIRKLLKDLERRSKELVDRIRKLLEELKRLIEAGLDAKDVEKLVKELMEEAEKIVEESRERVDRLMKRLDDIVRESERLSKELADRADEVEK

SEQ ID NO: 16890 - protein, 175 aa, Artificial Sequence; identical to SEQ ID NO: 16889
  Synthetic sequence.

SEQ ID NO: 16891 - protein, 179 aa, Artificial Sequence
  Synthetic sequence.
RELEEILRTLEEMIERVKEKHERSKRELEKVITEVKEELRRSNEELRRVIEEVERKLGKESEEAKDVVDEARRLLREHEELVREVEKTARDLLRENEKLVEDSERRVEKLRRELKRLVEEGVPVDEVRKVVEDIVREAEKSVRENEELVKAIMRELKRVVKEAEELSEEIVRRLEERTR

SEQ ID NO: 16892 - protein, 179 aa, Artificial Sequence; identical to SEQ ID NO: 16891
  Synthetic sequence.

SEQ ID NO: 16893 - protein, 182 aa, Artificial Sequence
  Synthetic sequence.
KELEDVKRRLEKVHRDVNEASKEIVTRLREVHKRANDESKKIIERLDTVLREVARRLADRRRDKKVEKLLRDIAREAEEIKKRVKRLNDENRKRVEEVEKRVTKLNDENRKKVEDLLRVIDRGDLDAEEVERRVRELEKDVRRLVEDIRRLVEELMRNAKEIVDTAEKLVRELERKLEEVVR

SEQ ID NO: 16894 - protein, 182 aa, Artificial Sequence; identical to SEQ ID NO: 16893
  Synthetic sequence.

SEQ ID NO: 16895 - protein, 182 aa, Artificial Sequence
  Synthetic sequence.
DEVEDIIRRLEKFHREVNEESKRIIEELERVHREVNRKSEEIVRKLEKVLDEVREKAKRRSRSEEVRKRLEEIADEVRRVKEEVERLNRENKREVDRLKKEVEDLNRDNRKKVEEVIKVVEDGKLRAEEVEEVVRRLVRHAEAVVERIERLVEELVRNAEKLVEEVKRKADRLVEEADRTVR

SEQ ID NO: 16896 - protein, 182 aa, Artificial Sequence; identical to SEQ ID NO: 16895
  Synthetic sequence.

SEQ ID NO: 16897 - protein, 175 aa, Artificial Sequence
  Synthetic sequence.
DELEEVKRRLDEVNKRVEDEHRRVEEELRKVLEDVAREHEEVIKELERVLEKVRRAKGGDEEVLRRLTKKVEDISRDSKRLLDELREDIKRIIEDSKRLLEDNRRHSKEIKDTIDRDKKSDEARKLVKENERRVEETVRRSEKLVRDAMKKAKDTVRRSAELVKELMDRVERVVR

SEQ ID NO: 16898 - protein, 175 aa, Artificial Sequence; identical to SEQ ID NO: 16897
  Synthetic sequence.

SEQ ID NO: 16899 - protein, 171 aa, Artificial Sequence
  Synthetic sequence.
SEVEKVKKEAREMLKRVTDLLKEVNDRLKEVNKRVREEIRRVIERVREVLKRVAREVDKREMLERLEERVRRAEERVEELLRENERHSKKVSDDSKRLLDELRKIIKEIEDANLPLEDLRRVVEELEKRARDVVEESRRLVDEDRKHVEDVVRRVRDVVRELEERAERITR

SEQ ID NO: 16900 - protein, 171 aa, Artificial Sequence; identical to SEQ ID NO: 16899
  Synthetic sequence.

SEQ ID NO: 16901 - protein, 181 aa, Artificial Sequence
  Synthetic sequence.
SEVEKVVEENKKSVKTVRERVTELVKRNRDSVEEVKRRAEEMVRRNRKSVEEVRELLARGVSEEVLRKAKEDNDELNKRVRETLKELVKRNDDLLKRVTDDLDKLRRDNERLVEDIDRKNLPEEAKRRVDRVSEELEEVLRRVEEELRRVSKDLRRVLDEVKKEVDRVSEDLERVLRKDTT

SEQ ID NO: 16902 - protein, 181 aa, Artificial Sequence; identical to SEQ ID NO: 16901
  Synthetic sequence.

SEQ ID NO: 16903 - protein, 184 aa, Artificial Sequence
  Synthetic sequence.
DEVDEIVRRIEEIVRESEEMAERIVRDIKRVVEKSRKDVEDNVDELRKIVEKVEETAKRTRDEELLERLAREVEEVIKKSEESLKRINDTSKRVKDELEKKNTDLNDRTRRVAEELKKEVSRLRDRDAERKVRDLLRDLERVNTEADEKSKKLIKELEKVNKEAEDKSRKLIKELEDVLREARR

SEQ ID NO: 16904 - protein, 184 aa, Artificial Sequence; identical to SEQ ID NO: 16903
  Synthetic sequence.

SEQ ID NO: 16905 - protein, 184 aa, Artificial Sequence
  Synthetic sequence.
SSVDEIVKEAEKVVEDSREEAREIVERAEEIVRDSARKVDENVRRLEEIVRKVKEVADRTRSDELLEALAREVEEVEKESKESLRRIDEKTRKVIEDLKKLLEELDRKSEKVVRDLERKVDRLRDRDAERKVREVIERLKKVNDEVRKKLDELTRRLEDVNRKANERSTDLVRKLRRVLEEARR

SEQ ID NO: 16906 - protein, 184 aa, Artificial Sequence; identical to SEQ ID NO: 16905
  Synthetic sequence.

SEQ ID NO: 16907 - protein, 178 aa, Artificial Sequence
  Synthetic sequence.
SADRKIEEMRKEIKRSTDEARRLVEELIRKIERSNEKVKRDVEKLIEDIRRVIRRVREDNTLDEKDVKRVEDEVEKIIRKLEEDLKRISEETRKLLEELKKRLKEIEEKSKKLIEDLEREPNSEELKKKLEDIVREDEKLVEELTRLAEDIVRRDTKLVRELLERAKRVVDRVREEVK

SEQ ID NO: 16908 - protein, 178 aa, Artificial Sequence; identical to SEQ ID NO: 16907
  Synthetic sequence.

SEQ ID NO: 16909 - protein, 178 aa, Artificial Sequence
  Synthetic sequence.
DAEELVRELEERIKRSHERLEELLREVKRLIERSHEELKRLNEEVLRELDRVLDEVRKRKKDVEELLRELEERVRRIKERSKESYRRSKESLDRAKEVLEELYRRSKRSLEEFERELREKGVDKDVVRELERIVKENSELAERVFREVEKIVRENTKLAEDSVRELKRLVEELKKRVK

SEQ ID NO: 16910 - protein, 178 aa, Artificial Sequence; identical to SEQ ID NO: 16909
  Synthetic sequence.

SEQ ID NO: 16911 - protein, 176 aa, Artificial Sequence
  Synthetic sequence.
SDVEDVVRKLRELVKTNLKKVEDRVRKLKEEVEENVRRAEKIVRELEEEVERLLKLVADGRVDKDELRRLVERIKRELKRVLDEDKKTVDEIDKEVKRLVEEDRETVDRIREEIKKRVRGREVAEEVERRLERSHRESRKLADEVRRALEKSNRKTRELLRRVDERVEEVREELDR

SEQ ID NO: 16912 - protein, 176 aa, Artificial Sequence; identical to SEQ ID NO: 16911
  Synthetic sequence.

SEQ ID NO: 16913 - protein, 177 aa, Artificial Sequence
  Synthetic sequence.
SMEELVDKVEKELEESSRRSKELLDEVRRLLEESNKKTEDLLREVEELLKDVEREAEEKGSSEEKKDRLRKLADRIRDELKKVRREDEKSLEEIEDRLRKAEKEDRDSNREIRDKLRKDGVDEDVVRDVERLVEENRERVKRIADEMRKLVKENEDRARDVVRRLRELVKRLRERVE

SEQ ID NO: 16914 - protein, 177 aa, Artificial Sequence; identical to SEQ ID NO: 16913
  Synthetic sequence.

SEQ ID NO: 16915 - protein, 175 aa, Artificial Sequence
  Synthetic sequence.
KELEDIARDLERLLRENKKLIKEIVDRLRRLLEDNTRKVKKIVDEVKKLLDDLDKLRKDGVDEKEIEDVVREIAERLKRVLEEIEESIRRIEKVIEEVARESEKLSEDIEREIRKKITGKEVADKVREDLERSNDEMRRVIEKIREDLRRSLKEAKERLDEIKERIDRLLDAARK

SEQ ID NO: 16916 - protein, 175 aa, Artificial Sequence; identical to SEQ ID NO: 16915
  Synthetic sequence.

SEQ ID NO: 16917 - protein, 181 aa, Artificial Sequence
  Synthetic sequence.
KLEELLTEVRRRIEEVSRDLERVLREVEEDIKRTSDELDRVNRKVETEIKEVTERAEEKGVDRRDLKRLKDEVDKMSKESRDRNEKTIREVRELLKRIRDENRKSNEEVRRVEEDIKRKVRDEELVREVIERLKELVKKDKKLVEDVLRELKRLVDEDRKLVEDSLRRAKEIVDRARERVK

SEQ ID NO: 16918 - protein, 181 aa, Artificial Sequence; identical to SEQ ID NO: 16917
  Synthetic sequence.

SEQ ID NO: 16919 - protein, 179 aa, Artificial Sequence
  Synthetic sequence.
SIEDVLREVERLLREVIERNRKVHEEVNERSREVERELKRVHDEANRESEEVIREAKRKGIKDIERVEEKVKELNRENAERIKRVVEEVRELNERNRESSERVEEEIKKLLKTLADLVRAGVPVEELERRAREIVKRVRELVDTHRENLERIVERAKELIKELEENLRDIVREIRERVR

SEQ ID NO: 16920 - protein, 179 aa, Artificial Sequence; identical to SEQ ID NO: 16919
  Synthetic sequence.

SEQ ID NO: 16921 - protein, 176 aa, Artificial Sequence
  Synthetic sequence.
KEVEEVADRSRRVVEESKRRLDDVVRRVKEDSDRLRRDIERMVKRIKEIVKRVREEIGKDKRELVERVREEADKVVETARKLLDEVEKHARDIVRRIEELARRDKRSVERSEEEVKRVDDRKILKELLDRDRKSVKESEDEVKRLLDSNHELSRRIREELKRLLEKVKELVDRVRT

SEQ ID NO: 16922 - protein, 176 aa, Artificial Sequence; identical to SEQ ID NO: 16921
  Synthetic sequence.

SEQ ID NO: 16923 - protein, 176 aa, Artificial Sequence
  Synthetic sequence.
KEVEDVKRKLEKIARDSEEALRRVVDELRKIVTESKKKLDKAVKEVKDDSKRVEETIGKDKREVVDEVRRHAEEIVKRIEDLAKKDKDLVDEVVKTIEKLMTDDKRLVDEVVRRLEKTRDRDIMRKLLEEVKRSIDESKKRVKELVDEVRDSVRRSEEEVERLLRSNHRLSDEVRK

SEQ ID NO: 16924 - protein, 176 aa, Artificial Sequence; identical to SEQ ID NO: 16923
  Synthetic sequence.

SEQ ID NO: 16925 - protein, 176 aa, Artificial Sequence
  Synthetic sequence.
DDVERVIEEVKRVVDDSKRRAEEVVEESRKIVTDSERKVREMVRDVRRIVKEVEERIGKDKKDVVEEVKRVAKEVVETAERLVREDKRSSEDSVRKIRRLVTEDERLAREVAERLKRTRDRRIVKKLLEDVRKSVKESKDTVDKLVEENKRSVDRSLRELEKLLKEVEDLIREVTR

SEQ ID NO: 16926 - protein, 176 aa, Artificial Sequence; identical to SEQ ID NO: 16925
  Synthetic sequence.

SEQ ID NO: 16927 - protein, 176 aa, Artificial Sequence
  Synthetic sequence.
DEVDEVVKRSRDVVTESEKRLRDVVRRSKEIAEDSRRRVREVVERLKEIVREVEERIGKDKKDVVREVRERVKKVVEELERLVKEDEDSSKRSVEEIRRLAERDKRSADESVKELRKTTDRRVVEELLRRDEKSVEDSLRRVEKLVEDNRKTSEDIEREVRRLEEEVRKLVEDVTK

SEQ ID NO: 16928 - protein, 176 aa, Artificial Sequence; identical to SEQ ID NO: 16927
  Synthetic sequence.

SEQ ID NO: 16929 - protein, 177 aa, Artificial Sequence
  Synthetic sequence.
REVDEVVERMKELVATVKRENDEVVKELKKLVKELEDDNRRVVEESKKSVEDLARRVGKDKREVVEEVRRTSKELVERNEETAKRVDDLVRRLVEENRRSVTEVEELVKELVKELRRESTSRDLVREVEKRVRDIVEESRKLAEETRKKVEDIIEKSKRIAEDTLEKNKEMVERLER

SEQ ID NO: 16930 - protein, 177 aa, Artificial Sequence; identical to SEQ ID NO: 16929
  Synthetic sequence.

SEQ ID NO: 16931 - protein, 175 aa, Artificial Sequence
  Synthetic sequence.
REDELVERLVDKVRRSSKEVRDRAEEMVRRNEKLVRDVEEDLDRLVEENKKLVDSVSRLRGEKAEEAVRRSKKVVDDIRERVKRALDRSRKVVEESREELERLLKRDKELVDEIKERVRIKEVVDRLRELVERSEKDVRKVVEEDKRITDKLEKRVREVVKRNEEITDELRERVR

SEQ ID NO: 16932 - protein, 175 aa, Artificial Sequence; identical to SEQ ID NO: 16931
  Synthetic sequence.

SEQ ID NO: 16933 - protein, 188 aa, Artificial Sequence
  Synthetic sequence.
SSIERVAKLVEEVERHVRKSIKDVEKLVRDVERHIEESVKTVSKLVEDVKRAVEELRRKVKEKEELDELVREVKRRIEDVVRRSRDLVRKNEELLRRVAEEVRRLVDENRELAERVVEEVRRIGTSEDVERLVREVVKRLEEIVERSERLVREVEERLKEIVERSRRLSKENEDELRKIEKEVRDRVK

SEQ ID NO: 16934 - protein, 188 aa, Artificial Sequence; identical to SEQ ID NO: 16933
  Synthetic sequence.

SEQ ID NO: 16935 - protein, 173 aa, Artificial Sequence
  Synthetic sequence.
KDVEDAERRLKELLDRLKRFVEESVKTSKKIVDDSKRVVEESAKRSRDIVREVKDRVPEDLVREVEKLARDTERRSEKLVTDNAEIVKRTVEESKDLLKKVEEVVREVVKRARDENVREKIEELVKEVDKLIKDVVRRMEKLNREVKKSADDSAREVEELNRRVREVVERVRT

SEQ ID NO: 16936 - protein, 173 aa, Artificial Sequence; identical to SEQ ID NO: 16935
  Synthetic sequence.

SEQ ID NO: 16937 - protein, 173 aa, Artificial Sequence
  Synthetic sequence.
DEVEEVEKELRELVKRSEEVAREVKDRLRKLVEESERVVRESRRKSREIVEEIRKKVREDLVREVEELVKRTIERSTELMEDNKRLVEEVEDRARKLVKENEDLAREIVKEVRDRNVKDEARRLVEEVKRSVEKSVKELEDLVEEVKRSVEESVKEAKELNDRVDETVKRRAT

SEQ ID NO: 16938 - protein, 173 aa, Artificial Sequence; identical to SEQ ID NO: 16937
  Synthetic sequence.

SEQ ID NO: 16939 - protein, 173 aa, Artificial Sequence
  Synthetic sequence.
RSVDEVEKELRELVERITRFVEKSVRDSRKIVEDSKREVEKVKDDLRKIVEEIRRKVPEKDVERVKRVVEEVERRVETLAEENRKIVERTERRSKELVDTVREVVREVVEKVRKDNSEEDAKRLVKEVAELIKRVVEEMKKLNDEVEESARRSVEEARRLVEEVKRLVDEVAT

SEQ ID NO: 16940 - protein, 173 aa, Artificial Sequence; identical to SEQ ID NO: 16939
  Synthetic sequence.

SEQ ID NO: 16941 - protein, 184 aa, Artificial Sequence
  Synthetic sequence.
EVEELVERVLRELERLVRENKESSDRIKEELRKLVEDNEKSVRDTKRTAEKLVDDLRRKKDEERVEELARRIAKTVEKLVEEDRKSVEDTIKRVEDLVREDEKSVRDSVRKVRELVKRVEENVKDERVVRKVREDVKRVERLSKEIVDDSKREVEKVVETSRRIAEKSTDVVRRVKRELEEITR

SEQ ID NO: 16942 - protein, 184 aa, Artificial Sequence; identical to SEQ ID NO: 16941
  Synthetic sequence.

SEQ ID NO: 16943 - protein, 180 aa, Artificial Sequence
  Synthetic sequence.
SMKELIKRVKDLVDEVRKKVERLIEEVSKLVDDVKRHIRELIETVKRLVKEVADLLRAGREKEEVVKLLEEVVRRVKKLSKENEERLRTVVERSKKLVDDLRRDAERVAEEVRKLVEDVNDEEARRLVEKVERDLKDIVRRVEELSRRNVERLKEIVKESRELVKEVVERLKRIAEEVTT

SEQ ID NO: 16944 - protein, 180 aa, Artificial Sequence; identical to SEQ ID NO: 16943
  Synthetic sequence.

SEQ ID NO: 16945 - protein, 175 aa, Artificial Sequence
  Synthetic sequence.
KEKEDVKRRLEELIRRLEEHSKKVKRDLERVIKELDDEVRRVKERHEDVIRRLKDRDTSEKVLRDEAERIRRESEEINKRLEEKAERIKKEADDLLRENEERVKKIERELERLRTEGKLDDDVVRRVKELLRRVLEHTRKVVEDVRRLLKRIREKLEEISRKLDELLRRIEEKRR

SEQ ID NO: 16946 - protein, 175 aa, Artificial Sequence; identical to SEQ ID NO: 16945
  Synthetic sequence.

SEQ ID NO: 16947 - protein, 177 aa, Artificial Sequence
  Synthetic sequence.
DREDEVRKDIERIERELRRVVDELRKEVEDSMRKLDEEVKRLEEHIRESVERLEERVSEDRDDRVVKTIVKEADRDHKELERELDRLRKEVKKTNDDLERKIRKLEKEAEDVLRELAKRGIDEKVLRDLKRVVDEVRKELKDVLDRHNKVVREVERKLEEVIDKHRKAVEKVKRDAK

SEQ ID NO: 16948 - protein, 177 aa, Artificial Sequence; identical to SEQ ID NO: 16947
  Synthetic sequence.

SEQ ID NO: 16949 - protein, 177 aa, Artificial Sequence
  Synthetic sequence.
SREEELKKEVERLVREAEKHVEDNRKHVEDSVRELEKLVKELADKARESADRLDKKVKEDRDKRVVEKILREAEKINKDLKDTVKKILDEIREDHKRLEDNIRRLEEELRKVLKELKDRGIEERVLEELKRVVDDIRKKHKDILKRHRDVVRKVEKELRDILREHNEVIREVKDKLE

SEQ ID NO: 16950 - protein, 177 aa, Artificial Sequence; identical to SEQ ID NO: 16949
  Synthetic sequence.

SEQ ID NO: 16951 - protein, 183 aa, Artificial Sequence
  Synthetic sequence.
SEVERILKEAKRRLDEVVERLRKSAETLRRMLERVSRELKKSHDELDRVLRRVEDALRKRNLDEKSVRRIKKEIDEARKKSKKVLDEIEERAERVKRESREVLERIKKRIEDVIRRLAEIVREQRRDAEELRKEVEDMVRDLERLVREHSDRVRKIVTDLDRLVKEHNEEVRKIVERLDEEVK

SEQ ID NO: 16952 - protein, 183 aa, Artificial Sequence; identical to SEQ ID NO: 16951
  Synthetic sequence.

SEQ ID NO: 16953 - protein, 179 aa, Artificial Sequence
  Synthetic sequence.
SELDEILERLKEVLERVKRKLEESNRRLEEVLDRVLKKLTESVKRLEDELRRVLKELRENNRPDDRLKEKVERVREESEEMRDRLRRLIERVREESKRILEELERRAREVKKRAEDVRRRGKPIEEIKKDVERIVRELEDLVRRHEKRVEDIVRELEKIVRDHNERLKEIVRRAEEDVR

SEQ ID NO: 16954 - protein, 179 aa, Artificial Sequence; identical to SEQ ID NO: 16953
  Synthetic sequence.

SEQ ID NO: 16955 - protein, 179 aa, Artificial Sequence
  Synthetic sequence.
RELEEILKRLEEVLERVLRELRKSVERLRKELERVLKELRDSNRKLDKVLREVLEELRKKNKDATDLKRRLDEARKESKDVIKTLDERVKRVKEESDEMLERLKELLDRVREEAERVARRGEPAEDLERRVKEIERRLKRLVDEHNRRLREIVRELEEIVKRHKERVEEIVRELKRRVD

SEQ ID NO: 16956 - protein, 179 aa, Artificial Sequence; identical to SEQ ID NO: 16955
  Synthetic sequence.

SEQ ID NO: 16957 - protein, 179 aa, Artificial Sequence
  Synthetic sequence.
SELDDIVRRLDEMLKRVEDELRKSDERLDELLKRVKKELEKSNRDLERALREVLKELEDRNRPNDELKRRIDEVREESRRVIEELDRTVKEIKRRSEEMSKELKRTADEVRKRADEVRKRGKDARELEEEVERIVRELEKLVEEHKEELERLARKLEEIVRRHEERVRRIVKELEDRVK

SEQ ID NO: 16958 - protein, 179 aa, Artificial Sequence; identical to SEQ ID NO: 16957
  Synthetic sequence.

SEQ ID NO: 16959 - protein, 179 aa, Artificial Sequence
  Synthetic sequence.
RELDEILRRLREELKRVREELEKSLKRLEDELRKVEEDLRESNERLERMLERVLRELRKRNRPDDELKKKLDKVRKESEDMSRRLKETADRVREKLKDSKRKLDEKVKRVEKRLEEVRRRGKDVDELRKELEKIAREAREYVKRNKDDLRRIVEELRKIVKKHKDKVEEDVRRLKKDVD

SEQ ID NO: 16960 - protein, 179 aa, Artificial Sequence; identical to SEQ ID NO: 16959
  Synthetic sequence.

SEQ ID NO: 16961 - protein, 173 aa, Artificial Sequence
  Synthetic sequence.
RELEEILKKLEEVVRTVEELHKRTNEKLEKAVDEVRELHRKTNEDLKRAVDEVEKAGLPKELVDRLRELLKDNKRRSDEIIRKIEKVLEDNKRKSEEIVKRLREELKRLADVIKDLEKDRLDEEVKRLVEEARRSVEDDDRNIRRLVEEAKDSVRRDEETIKKLVDELREATR

SEQ ID NO: 16962 - protein, 173 aa, Artificial Sequence; identical to SEQ ID NO: 16961
  Synthetic sequence.

SEQ ID NO: 16963 - protein, 173 aa, Artificial Sequence
  Synthetic sequence.
SDLERILKRLREVIKRAEELHRKTNEEDERVVREVIELHRKTNEDLREVIERVARGGLDEKMIERLERLLKENTERSKEISERLKRETEENIERSKRIVEDIERLLEELRRVVKDLDKEELRKAVEELEEKLERSVREDKKTSDDSARRAKKSVEDDRRTIEKLVEEAERSRK

SEQ ID NO: 16964 - protein, 173 aa, Artificial Sequence; identical to SEQ ID NO: 16963
  Synthetic sequence.

SEQ ID NO: 16965 - protein, 183 aa, Artificial Sequence
  Synthetic sequence.
KDLEKLLDDIRKVLEEVTRRLKRISDELRRVLEEIKKRLDKDNEDLKRVIDEVKKLLDKKVRDEKRVKDLVDRAREIHRRHAEEVKRLVDKLREIIRRDEKSVEDWKRRLEKILEDLKRVVDRNERSREEIEKEIRDVEEELRRAVEENAELVKRVKEDAERVVRDSEKKSKEVAEELKDAVR

SEQ ID NO: 16966 - protein, 183 aa, Artificial Sequence; identical to SEQ ID NO: 16965
  Synthetic sequence.

SEQ ID NO: 16967 - protein, 182 aa, Artificial Sequence
  Synthetic sequence.
SELEKILKELKDASREVEKRLRDILREDKKMLKKVVEELEEILRRLDEEVKKVKERLKNKEVLERLEEEVRRLKERIKKLIEDLKRESERLEDTIRKLIRELRENTKRLEEKIRRLKKKGEPREEVVDRAKKEVDDHVKKAEDVVREVEKRSRESVKRLRDIVEELERLVKRLVDEAEREVK

SEQ ID NO: 16968 - protein, 182 aa, Artificial Sequence; identical to SEQ ID NO: 16967
  Synthetic sequence.

SEQ ID NO: 16969 - protein, 175 aa, Artificial Sequence
  Synthetic sequence.
SETEKLLEEVRRIIEEIKKRIDRSLEEVRRSVEEAKRRIEKSLEDVEKSVRRVKKILDEGDSSERLKRENDEHLKTHHEVVKKILKDNREHLRRHHETLKDIKRRIDKVVEDLRRAGLDDRVLKEVEDLAREVKKRIDEVDKRVAELHKEVEDRLREVDKTVEELHRRVKKRADD

SEQ ID NO: 16970 - protein, 175 aa, Artificial Sequence; identical to SEQ ID NO: 16969
  Synthetic sequence.

SEQ ID NO: 16971 - protein, 180 aa, Artificial Sequence
  Synthetic sequence.
SIEDVEREVKRLIERTKRHNDRVLETIRRLLEETKKHNEKVLREIRELIKRVEDTMRRRGVDERLRDELRKILEDLERESRKLKEDNKRALEELARMSKKLKDDNDRALERLKDTVKEERSEETIKRLLDEVREYVRKSEEDSERLLRDVERYVKESKERSERILKEARRLVKEVEDKIR

SEQ ID NO: 16972 - protein, 180 aa, Artificial Sequence; identical to SEQ ID NO: 16971
  Synthetic sequence.

SEQ ID NO: 16973 - protein, 180 aa, Artificial Sequence
  Synthetic sequence.
SIEEVLEEVRDLLRKTKEDTKRILDEIRRLLEETKKRLEEVLREATKLLREVEDLVRKSGVDERLLEEIKRIEDELRKKIETIRRRNDEALKRLTDLVEENKKRNDDILRKLKEERDEDRDEEEVKRLLEKARKLVEESKRESKEILDRARKYVKESLEEIERLLDELRKLIEELRRRIE

SEQ ID NO: 16974 - protein, 180 aa, Artificial Sequence; identical to SEQ ID NO: 16973
  Synthetic sequence.

SEQ ID NO: 16975 - protein, 176 aa, Artificial Sequence
  Synthetic sequence.
SSEEILKEVKELIEESNRASEEVLKEVKKLLDESKKRSDEVLEEVERELKRLEESASRIDDEKRLREVRDVLRRIRERLDRVRKENEKILKEVKDTLKKVKEDNEDISRRLEEEIKKKGADEDVVREMRRLVEEDKRRIKEALDRLRKLVEDDKRRIEEVLREMRELIRELEERIR

SEQ ID NO: 16976 - protein, 176 aa, Artificial Sequence; identical to SEQ ID NO: 16975
  Synthetic sequence.

SEQ ID NO: 16977 - protein, 175 aa, Artificial Sequence
  Synthetic sequence.
KEIEDILERLKETIKEIEDHIRRDLEELKKVIEELKRSLEEWKKRAERLIEELERLIRETGPTKELEKEARDRLRELEEAMKRNVEKIDKIKRENEKNSEDLKRRLERVLRELRKSGLEERVLREAEERIRRLEEKLKEVNKRSEEMLRRLKEEHERVLREVKELIREIDDKARK

SEQ ID NO: 16978 - protein, 175 aa, Artificial Sequence; identical to SEQ ID NO: 16977
  Synthetic sequence.

SEQ ID NO: 16979 - protein, 182 aa, Artificial Sequence
  Synthetic sequence.
GEDEVLRKVEKLLREVKERAEKSVERVERLLKDVEDKLKESHDRAKRLLEEVKKAADRGDLREEELDRLRKKIEDAYKRSEDILREIKKEIKRVLDRSRETLKRVEEELKKVLDTLADLVRRNEEDLKDLDRRIEEVVKRLEDEVRRHTKEVEEMVKRLRELVREHTERVKKIVEDLKREVD

SEQ ID NO: 16980 - protein, 182 aa, Artificial Sequence; identical to SEQ ID NO: 16979
  Synthetic sequence.

SEQ ID NO: 16981 - protein, 175 aa, Artificial Sequence
  Synthetic sequence.
SEVEDVERRIREIIERLRRIVERHKEEVKKIIEKLEKLVRDHTERAKRIIERLKEVVDRKMPRELIKEELDRVREDSKRVLDELRRKLEEVRERSRKALEDIKRRLDEIRDELRRRISNEEVLKEVERLLEEVKELVERSHKEAEDLLKRVLDAMKRSVDEVEKLLEELKRRADK

SEQ ID NO: 16982 - protein, 175 aa, Artificial Sequence; identical to SEQ ID NO: 16981
  Synthetic sequence.

SEQ ID NO: 16983 - protein, 175 aa, Artificial Sequence
  Synthetic sequence.
SKVEKVEEDIDKIIRRLEELVEEHRTEAEKTVKKLDDDVRRHNEKVEKIIRDLEEVVRRRKPEKDIEDKLRRVKEESERVLEEMDRRLRRVEEESRRLHERAREELERVEDELRKKIENRKVLEDAKRLLERVMDEVRRSNEELKKLLEEVKRKLKKSVEDAERLLDEVRKRVEK

SEQ ID NO: 16984 - protein, 175 aa, Artificial Sequence; identical to SEQ ID NO: 16983
  Synthetic sequence.

SEQ ID NO: 16985 - protein, 175 aa, Artificial Sequence
  Synthetic sequence.
SEVEEVDKRIREIVTTLKRLVEEHNDRARKIIEKLRRLVKKHEDEVEEIVRRLDEAVERRLPREEIERKLREVEERSKEVHKRLEDELEKVKRESEKMKREADERLKKVEKDLRDTISNEEVLKKVKELLKEVKRRLERSLEELERLLEEVLKLMKESNDKAKELLERVREKVER

SEQ ID NO: 16986 - protein, 175 aa, Artificial Sequence; identical to SEQ ID NO: 16985
  Synthetic sequence.

SEQ ID NO: 16987 - protein, 177 aa, Artificial Sequence
  Synthetic sequence.
DFVERVKEEIKRIVERLKRLVKEHEDEVKRILDELRKLVETHKELSKDSLRKLEEVGDGSEDDIRRLLEENKKMDKEVNDKVRKLAKDVRDIDRRMNERVERLLREIEKTLEDLRRENKVDERVLEELRRLVKEVKERADRSSEKLNELLRKAEEDAKRSSEENNRRLEEVERRVRK

SEQ ID NO: 16988 - protein, 177 aa, Artificial Sequence; identical to SEQ ID NO: 16987
  Synthetic sequence.

SEQ ID NO: 16989 - protein, 181 aa, Artificial Sequence
  Synthetic sequence.
DEERKIEEIIDKSRRDWERLLREAREIIKRSEDEWRELLERIKRLIEETRKRAKDLKKADGRERVVEEIEERVRRINEETKKLVRELLEKDRKLIEDLRKKLRELREKDKRLIERIKEERDTEEIRRLLEEMDKLSREASKRVEDILRELEERSRRMADEVRKLNEENKKLLEEAKKELKD

SEQ ID NO: 16990 - protein, 181 aa, Artificial Sequence; identical to SEQ ID NO: 16989
  Synthetic sequence.

SEQ ID NO: 16991 - protein, 181 aa, Artificial Sequence
  Synthetic sequence.
DKEEIKEKLEELVERVVRELEKLLKELEDLSREVARRIKKIARDLEKLTKEVEEKLRRRPKTEELTELVKRLKEHSERLRRRIEELLRRLEEDSRRLVERIKKLVKDLRDDVRRLKELIDRGELSEEELERLIKELVDRARKLLEEVKKLIEDHREKLKRVLDEIKDLLRKHKETLDRTDT

SEQ ID NO: 16992 - protein, 181 aa, Artificial Sequence; identical to SEQ ID NO: 16991
  Synthetic sequence.

SEQ ID NO: 16993 - protein, 181 aa, Artificial Sequence
  Synthetic sequence.
SKEDILRELRDRVERIKREIEKIFRDAKRLSEEVKRRIEDLLRKLKKVSDDVRERLARKPDTEELRKLVEELERDSERLKKEIKDLVRELDEHSKELLTRIRKLLKELEERVRELEELIKRGDLSEEELKELIKRLVEDAKRILEELKKLLDDHERKARRILERIEKLIKEHEDKARERER

SEQ ID NO: 16994 - protein, 181 aa, Artificial Sequence; identical to SEQ ID NO: 16993
  Synthetic sequence.

SEQ ID NO: 16995 - protein, 181 aa, Artificial Sequence
  Synthetic sequence.
SEVEKLEEEVERSVRDLERELRDSEEKSKELMRRLDELVRRAKDHVRRSVEELRKTLSKGLDEDEVRDLERRVREDHEKLKEDLKRIVREAREALKKHRRRVEEIVKRVKERLEELRRRIGDDEEVRRILRDAERVIEEIKRRLEEDHKRLEEVIRRVEEKLRRILDEHDKVVKEIKEALR

SEQ ID NO: 16996 - protein, 181 aa, Artificial Sequence; identical to SEQ ID NO: 16995
  Synthetic sequence.

SEQ ID NO: 16997 - protein, 181 aa, Artificial Sequence
  Synthetic sequence.
SEVEEAEKEVEDIMRRLKRKVEENKRHVDESVKEAEKLLRDSETRTRDIARRLKEELDKGLDEEEVKRLAREVDRLLREHREEVKKIIERIDRDNDRNREHVEKVVREVEELLRDLERKIGRDKELTRILTRLREVIERVKRALEKSHDDHRRAVEEVRKELKRDHDDLRRVIEKVRRDLK

SEQ ID NO: 16998 - protein, 181 aa, Artificial Sequence; identical to SEQ ID NO: 16997
  Synthetic sequence.

SEQ ID NO: 16999 - protein, 181 aa, Artificial Sequence
  Synthetic sequence.
SEVEEAKRRVDDIVRKLEELLKDSRRESERIMRELKRLLEELKRHVEDSVRKLREVLSRGLDEEKVERLIREARKDNERLKRELERILREVEKALKRHRERVEKIDREVRERLKDLERRIGDDRELREILRRAKEVIDKIREDLERDHDRLREVIEEIKKTLDRIHEEHRRVVKEVEDTLK

SEQ ID NO: 17000 - protein, 181 aa, Artificial Sequence; identical to SEQ ID NO: 16999
  Synthetic sequence.

SEQ ID NO: 17001 - protein, 181 aa, Artificial Sequence
  Synthetic sequence.
SEVEEAEKEVREIMKELDKLLEDSKRESDDIRRDLDRVLEENKRHVDKSVTDLERVLSRGLDEEAVRELLRRAREDNRRNKEHVDRLVKKAKDKLDEHKKKVDDIIEKARRELKRLEDEIGDDKELRRILRELEEVIKRVERTLREDHKELKRVIDRMKEDLERSHEEHERLVEEVERKLR

SEQ ID NO: 17002 - protein, 181 aa, Artificial Sequence; identical to SEQ ID NO: 17001
  Synthetic sequence.

SEQ ID NO: 17003 - protein, 181 aa, Artificial Sequence
  Synthetic sequence.
SEVEEAKKDVERIMRELEKLVRDNKKHVDDSVRKLKKLLDDLRKHVEDSREELERVLRRGLDEELVKELRKRAEDDNRRLKEELDKIKEEADRDNEENAKHVKKVVDRARKMLEDLRRKIGDDRDLRKILEDLERIIRRVEEELRRSHERHKEVVDRIKKVLDEIHRRHREVVKEVEKELR

SEQ ID NO: 17004 - protein, 181 aa, Artificial Sequence; identical to SEQ ID NO: 17003
  Synthetic sequence.

SEQ ID NO: 17005 - protein, 181 aa, Artificial Sequence
  Synthetic sequence.
KEVEEAEDKVRRIVEDLKRKLEDLERHVEESVRRLEDLLRRSKKKSDDIMEKLTRTLSKGLDEEEVKRLTEEVERLLREHRRELRRIVEEARKDNERLETRLRKIKREVEELLKELEREIGDDKELRRILKRMKDAIERVERELRRIHTRHKEAVDRVREELKRNHDELAKVIRKVREDLK

SEQ ID NO: 17006 - protein, 181 aa, Artificial Sequence; identical to SEQ ID NO: 17005
  Synthetic sequence.

SEQ ID NO: 17007 - protein, 181 aa, Artificial Sequence
  Synthetic sequence.
DEVERADEDVERIVRELRRVLEENRRHVKESVERLERLVRKSKKDSKKIMEDLKRVLDRGLDEESVKKLRDDARKELEKHREELRRIEEEAEKDNRRNEEHVRRLEKRVEEELRRLETEIGDDTELRKILKKMKDAIREIKRTLDESHREHRRVVEEVKEELERNHKELKEVIDKVAKDLE

SEQ ID NO: 17008 - protein, 181 aa, Artificial Sequence; identical to SEQ ID NO: 17007
  Synthetic sequence.

SEQ ID NO: 17009 - protein, 176 aa, Artificial Sequence
  Synthetic sequence.
DEVEDILRRVREAVERARESLERIHREHKKVVDEVRKALEKVLEDHARVVDEFRRKSGSESEEAKKILDELRRDHEELKKRLEKIEREVREDNERLERELRELEERVRRKLEELERRNVRKDELKKEVEKLEEELKKELKRLKDHVKKSKEDLRRKLEDLKRHVERSVKRAEEEAR

SEQ ID NO: 17010 - protein, 176 aa, Artificial Sequence; identical to SEQ ID NO: 17009
  Synthetic sequence.

SEQ ID NO: 17011 - protein, 176 aa, Artificial Sequence
  Synthetic sequence.
SEVEKVLRDLERAVKEVSERHRRNHEELRKVIKRVKEEHDRIHDEHRKVVEDLKRKIGTESEDAKRILDKLEEDNRRLKKHIDDSKERVDRVVKRHKEHLDRSLKRVKEMLDELRKANVPREEIKKEVDRLKKELDENLKRLERDSERLKKELEDNLKRLEEHVRRSKEEAERDAK

SEQ ID NO: 17012 - protein, 176 aa, Artificial Sequence; identical to SEQ ID NO: 17011
  Synthetic sequence.

SEQ ID NO: 17013 - protein, 176 aa, Artificial Sequence
  Synthetic sequence.
SDLEEVLKRLEDVVRRLEEELRRIHKEHRDVVRRVTEEHKRILEELKRVVERAREKDGEESREVKEILRELEEVLRDLKRHIERSRKELEDDNRRLKKRLDEILKKIREVLERLRRKNVDRDRVTKEVRDLEEELRELLERLRAHVKRSEKKIEENLRRLEKRVEDLKKKIDDRTR

SEQ ID NO: 17014 - protein, 176 aa, Artificial Sequence; identical to SEQ ID NO: 17013
  Synthetic sequence.

SEQ ID NO: 17015 - protein, 179 aa, Artificial Sequence
  Synthetic sequence.
RELEDIKRKHKKVVDDVREKLKESHRRLKEVIEEARRRLDEVRKKLEKVIREILTSAGTEDERLKRVEETVRRVLEELEELIKRLDDKAKRMLDEHRKILEEIVKRADKSHKELDEMIKRRLPIEDLKRYVEEVKRDLDDLIRRSEELVRRIKEDLDRALKELEELVRRIKKKLEEDRK

SEQ ID NO: 17016 - protein, 179 aa, Artificial Sequence; identical to SEQ ID NO: 17015
  Synthetic sequence.

SEQ ID NO: 17017 - protein, 182 aa, Artificial Sequence
  Synthetic sequence.
SELDELRERVERHSRELRRTLEEAKKLVDDHKRTLREVLERIKKRVEDVKRELEKLVRDGVDERFLERLKKKLEDIVRDIERRNKELNEHSKKLAEELRRILKKLEDHSRELEKRMREEGGELREELKKIIDELRRVNEEAAKTLDEIIKRLEDVNREVNRTSKEVIDRLRKVLEEAERRTK

SEQ ID NO: 17018 - protein, 182 aa, Artificial Sequence; identical to SEQ ID NO: 17017
  Synthetic sequence.

SEQ ID NO: 17019 - protein, 182 aa, Artificial Sequence
  Synthetic sequence.
EELDRIRKEVEDHERKLREVVKDIERKVEEHAKRLKKVIEDDERRVKEWKDTLEELIRRGVSEEVLKRLAEELEKHKERSKKLNRELNKHSKELVDELRRRLKRLKEHSDELEEKIRRRGGELKDEVRRVIKELRDVNRKVADALRKVEEKLKRVNDEMNKESKRTLDELDKALEEAERRAR

SEQ ID NO: 17020 - protein, 182 aa, Artificial Sequence; identical to SEQ ID NO: 17019
  Synthetic sequence.

SEQ ID NO: 17021 - protein, 182 aa, Artificial Sequence
  Synthetic sequence.
DLLRELEARVRKHKRDLEEVLKKIEEEVRRHKKKLEDVLEELRRLVEDLMRELKELLEKGVPEKVLKELADKLRRLVEDARRLLRELKEHSRKLEEDIRRRNTELNKHSEKLEEDMRRKGGELREELKRIIDELREVNERVNDESRKVIKELRDANKEADKKVRDIIRRLEDILRKAAEDTR

SEQ ID NO: 17022 - protein, 182 aa, Artificial Sequence; identical to SEQ ID NO: 17021
  Synthetic sequence.

SEQ ID NO: 17023 - protein, 182 aa, Artificial Sequence
  Synthetic sequence.
KDLERLEKEVKEHKEDLERIVREAEKLVEDHERELEKVLRELEKTVRDVKRELEDLLRRGASEDVLRELAKKLKKIVEDMEKKNEDLNRHSEELLRRLDKILKELNKHSEDLMRKAREEGGKLKEEVDRVLDELRKVNKKAADDLERVIRELEDVNRRVNERSREIIETLKRVLDEVREKTR

SEQ ID NO: 17024 - protein, 182 aa, Artificial Sequence; identical to SEQ ID NO: 17023
  Synthetic sequence.

SEQ ID NO: 17025 - protein, 182 aa, Artificial Sequence
  Synthetic sequence.
DELRELKRKVDEHTRELERILKEIEDRVRRHKEKLDETVKRDKDRVDEWLRRAEELVRRGVSEEVVKRLAEELEKHKRTSEELNRKLNEHSKKLEDDIKTKLDELNKHSKELTEEMRRRGGELREEVEKIERRLREANKRAADALKKVIDELRRANEEVNRKSEETLKTLDKILEDVERKTR

SEQ ID NO: 17026 - protein, 182 aa, Artificial Sequence; identical to SEQ ID NO: 17025
  Synthetic sequence.

SEQ ID NO: 17027 - protein, 182 aa, Artificial Sequence
  Synthetic sequence.
DDLERLAEEVKRHSEDLDRIVEEIRDRVRRYKEKLDEVVKEDEKRVREWRDRLEKLVRAGVSEEVLRKLAEDLEKHKEDSDRTNEKLREEVKRLEEEIRKTLEDLNRHSKELVERARRRGGKLKDELDKIITRLEEANRKAAEDLRRVVEELRKAHEEMNRKSEKTKKDLDEVLEEAERRTR

SEQ ID NO: 17028 - protein, 182 aa, Artificial Sequence; identical to SEQ ID NO: 17027
  Synthetic sequence.

SEQ ID NO: 17029 - protein, 182 aa, Artificial Sequence
  Synthetic sequence.
DDLERLKRRVEEYRRKLEEVLKTIEEEVRRYKKEAEKVLDEDRRRVEDWKRKLDEMVRRGVSEEFLERLARALEDHKRKSDRDNDRLREKVRRLEEKIKELNDRLRKEVEEIVKRARDRGGSLEEDVRRIIDELRRVHKRANEDSKRVVDELRDVHRKVNETSEETKKRLDKVLKEAEDRTR

SEQ ID NO: 17030 - protein, 182 aa, Artificial Sequence; identical to SEQ ID NO: 17029
  Synthetic sequence.

SEQ ID NO: 17031 - protein, 182 aa, Artificial Sequence
  Synthetic sequence.
KKLDDIRREVERLTDKLEKIVKRIKELVDRYRRKLERVLEEDDRRVKEWKRRMEELLRRGASEDVMREIAERLERHKEESKRLNDELREELKKLEREIEKTLRDLAEELEKLKEDIKRKGGELKEEVDKVLKDLDRALKKAADDLKRVIDELREVHERINRTSERTLTKLDRALEELEKRLR

SEQ ID NO: 17032 - protein, 182 aa, Artificial Sequence; identical to SEQ ID NO: 17031
  Synthetic sequence.

SEQ ID NO: 17033 - protein, 182 aa, Artificial Sequence
  Synthetic sequence.
KELDEIRELVKRHKDKLKKIVDEVKERVDALKRKLKEILDEDRERVKKWVRDMEELVRRGVSEEVLKRVAEELEKHKKKSEEDLRRLAEDLRRLEEEIRKRVEDLNRHSKELVEDIERKGGKLKEDVDRVIRDLERVNEEANRRAKKVIDELRRVLEEAERTLRKTLEDLDRALEELARATK

SEQ ID NO: 17034 - protein, 182 aa, Artificial Sequence; identical to SEQ ID NO: 17033
  Synthetic sequence.

SEQ ID NO: 17035 - protein, 183 aa, Artificial Sequence
  Synthetic sequence.
DEAEKILEELRKVVRELEEELRRNHEELKRVIEDVERKLRESNRRVEKVIKEVTDEKGSEDDEARKVLKELKEKLDEHKKRVDEVKKKLEEELEKHKRKLDKVVKEVEKFLREAEDRLRKEGTDEDVVRELEKLVEELKRRVTEVVETVARDSERLREELRRIVEESKRLVEELKRRAEEASR

SEQ ID NO: 17036 - protein, 183 aa, Artificial Sequence; identical to SEQ ID NO: 17035
  Synthetic sequence.

SEQ ID NO: 17037 - protein, 179 aa, Artificial Sequence
  Synthetic sequence.
SELERVVEDLRRAAKKLADDLKRVIEEHRKYARDNKERLKKVLERLKRLAEELKKELERDGKSDEVRKRLEELLDRLRRLVEEAIRENKKSVDDSRKNSKRVEDELRDRLRKLDEKLKRDVKDSREVLEDVRRLIEDLERLITELRKENERVIRESEKLSRDIEREVERVIRELEETIR

SEQ ID NO: 17038 - protein, 179 aa, Artificial Sequence; identical to SEQ ID NO: 17037
  Synthetic sequence.

SEQ ID NO: 17039 - protein, 171 aa, Artificial Sequence
  Synthetic sequence.
KEVEDVKREIDKVLEDARRLLKESDDTLKKILDKARRDLEESDRRLKEILDKVRKDGLDEELLRRIEEYAKRHHDRNREILERLRELVKRHHDRNRDIVRRLEELVDKLKKDNIPFEELKDTVDKLRREIERRITESRRHVEELRRRVEEMLERSERNVREAEKKLEEDKK

SEQ ID NO: 17040 - protein, 171 aa, Artificial Sequence; identical to SEQ ID NO: 17039
  Synthetic sequence.

SEQ ID NO: 17041 - protein, 182 aa, Artificial Sequence
  Synthetic sequence.
DEVERVEEELKKSDDELRRRMEEVKRALDKDNEDAKRMLDEVKKELEKILRKVEKEVKDKESVDRLRKKLEDIKRELERILEELSKIHEDIKKRLDDLLRESEEHSRRLIEEIRDLERRGSDKKEVVERLDKLVKEHHERNKRIVEEAKRLVEDSREKTRRIAERAKELVRRLKELVDRLSK

SEQ ID NO: 17042 - protein, 182 aa, Artificial Sequence; identical to SEQ ID NO: 17041
  Synthetic sequence.

SEQ ID NO: 17043 - protein, 182 aa, Artificial Sequence
  Synthetic sequence.
DRIEDVKRKVKEIKEKVDRLLEESSKKVDDLNKKVRDLLTESNKRIEDIVRELRELAKRDLKEEELRKVLEDLRRRIEKIIKDNEEINREHEKVVRDIVKENKEINDELRKEIERIREELGTESEEAKEVLERLKRILEESRRASEENKKKLEKSHEELKRASDENKRKLERILDELREALR

SEQ ID NO: 17044 - protein, 182 aa, Artificial Sequence; identical to SEQ ID NO: 17043
  Synthetic sequence.

SEQ ID NO: 17045 - protein, 171 aa, Artificial Sequence
  Synthetic sequence.
SAKEKIDKTLKDIYRKHEEVVRRVEKKHRDIHREHEEVVRRVEEEHRRILDELRKAPVDEDVIRKIEKNVEEVKREIDKSDDDIRRNIKEVKDEMDKSNEELKRKIDELRKANLPEEEAKKFLDKLDKEVRDSMKRLEDHVRETKKRVEESVRRLEEHVKRTEEEVRETAT

SEQ ID NO: 17046 - protein, 171 aa, Artificial Sequence; identical to SEQ ID NO: 17045
  Synthetic sequence.

SEQ ID NO: 17047 - protein, 171 aa, Artificial Sequence
  Synthetic sequence.
SVEDEVRRDLKRIYEKHEEAVRRVEERHERSNERLEDVIRKVEDKHREILKKLEDEPVEEEFIKELEKNVRTVKKKAEDKLRESEKNSRDLKRKIDESNKRLRDKIEELERANLPEEDVKRVLDKLDEEVKDSVRELEEHVEKNERDVEEIAKDLERHVEETRKEVDKTAK

SEQ ID NO: 17048 - protein, 171 aa, Artificial Sequence; identical to SEQ ID NO: 17047
  Synthetic sequence.

SEQ ID NO: 17049 - protein, 171 aa, Artificial Sequence
  Synthetic sequence.
KVEEKVRETLRRIYERHRKIVKEVEEKHRESNERLRREIERVKRKLDEILKKLEEAPVDEDVIRRLRKELRDLEEKMERKLRESERNSEEVKRRAEESNKRLRDKIKTLEEANLREDRVAEVLKKLKDDVDKSAEELERHVKRNRDEVRKIVEDLDRVLEELRTKVDEEAR

SEQ ID NO: 17050 - protein, 171 aa, Artificial Sequence; identical to SEQ ID NO: 17049
  Synthetic sequence.

SEQ ID NO: 17051 - protein, 171 aa, Artificial Sequence
  Synthetic sequence.
SVEDKVRESLERIYKKHEKVLRDVERTLKEIHEEHREAVERVRRELERIKRKLEELPVDKDMIRRLEELIKELERRADESDDDLRRKIDELRRRAEESNKKLKRDIDRLREAKLPDKDVERVLKKLDDDVRKSVKELTDVLKRLREEVKRSVEELEDVLRKLDKEVDDTAK

SEQ ID NO: 17052 - protein, 171 aa, Artificial Sequence; identical to SEQ ID NO: 17051
  Synthetic sequence.

SEQ ID NO: 17053 - protein, 171 aa, Artificial Sequence
  Synthetic sequence.
DVEDRIRKSLEEIYRRHETEVRKIKRKHDESHRRHEKVVREVTEDLERIKRRLEELPVDEEAIKKLEEDIKRLRERIKESDKRNEDNIREVEKEARKSNDELRKDIEKLDRDRLPEEDAKRVLDELEEKVRRSVKKLREHVEENEKRVEDSVEELKRILEELRKAVDETTR

SEQ ID NO: 17054 - protein, 171 aa, Artificial Sequence; identical to SEQ ID NO: 17053
  Synthetic sequence.

SEQ ID NO: 17055 - protein, 182 aa, Artificial Sequence
  Synthetic sequence.
SKKDEVEKLLKESERHSKKLVEDAKRLSDESKKHVEELVRRAEEELEKSDRDVKKVKDDNRPKDELKKVVEDLERENERLNRKIKEELKRHKDENERLTKELRELVKRHTDEVKEITDRLNVPEEVMDRVRRRLERDIRELRKALKRVEDTNEEITRELEKAMKEVKDTSDRILEKLRRARK

SEQ ID NO: 17056 - protein, 182 aa, Artificial Sequence; identical to SEQ ID NO: 17055
  Synthetic sequence.

SEQ ID NO: 17057 - protein, 182 aa, Artificial Sequence
  Synthetic sequence.
SVKDKLKELLKDSKRNSDRLVERAKELLDRSRKHSKELEDRARKLLEDSRRKVEELERANLREDELTRVVRKLEEENKRLNTELEKLVRDHERDNKRLVDELTKLSKEHEDRVREIAKKLDVEREVLEKARRDLERDLRENKKALDEVRRTLEEDSRRLREVLEEVKRISTKIIERLREIRR

SEQ ID NO: 17058 - protein, 182 aa, Artificial Sequence; identical to SEQ ID NO: 17057
  Synthetic sequence.

SEQ ID NO: 17059 - protein, 173 aa, Artificial Sequence
  Synthetic sequence.
SEKEDAEKKLRDILTDLARIVREVEEALKKILDDIRKVSEESKRASDESLKRARDAGIDEKLLEELERHNRKLKRDDDRLLKELEEDIRRLKEDIDRLLEEVAREVDRLREELDRLRGEELEELLRRLEEAVRRIAERLRKLLKELEEKARRLAEESKKLLEKDKEDVKRAAE

SEQ ID NO: 17060 - protein, 173 aa, Artificial Sequence; identical to SEQ ID NO: 17059
  Synthetic sequence.

SEQ ID NO: 17061 - protein, 173 aa, Artificial Sequence
  Synthetic sequence.
SEKERIKEESKKSLDDLRRASERSKEELDRILKRIDEASKRSKEESDRSLKEVKDRGIDEELLRELKRHNEELKERDDRLLEELKRKVEELKRTDDDLLRRSKEKHEKVERELKDLDGEELKDVLRELRETNRKLVEDSRKLLEELDRDVERLADESRKLLEDDKRKVREVAR

SEQ ID NO: 17062 - protein, 173 aa, Artificial Sequence; identical to SEQ ID NO: 17061
  Synthetic sequence.

SEQ ID NO: 17063 - protein, 173 aa, Artificial Sequence
  Synthetic sequence.
SDEERIDELSKKSLEDLKRVSDDSKRKLDDILKKIEDASRESEDKLRRILEKARRDGIEERLLTELERKVRELKKDDRRLLEELRKKVERLKERDDELLDRSRRKHEEVKRRLKDLDGRELERILEELRTDNDRLAKESDKLVKELEEEVRELIKRSETLLEELRKDVEELAK

SEQ ID NO: 17064 - protein, 173 aa, Artificial Sequence; identical to SEQ ID NO: 17063
  Synthetic sequence.

SEQ ID NO: 17065 - protein, 171 aa, Artificial Sequence
  Synthetic sequence.
DAKERVDDALKKILDDHRRVLKKVEDDHRDSHREHRRVVEEVKRELEKVLKKLRDAGVPEEIIREAKELVEELVRRAEESDKRNEDNIREVKERAEESHRRLRRLVEEIRKANLPKEDLDRMLEKLREIVERSRDKLRRHLEKNKREVDDSKRRLEKMLRDLEKKVRDAER

SEQ ID NO: 17066 - protein, 171 aa, Artificial Sequence; identical to SEQ ID NO: 17065
  Synthetic sequence.

SEQ ID NO: 17067 - protein, 171 aa, Artificial Sequence
  Synthetic sequence.
DDEERVKRKLEEVLRKHKEVVDEVIERHRRSHKRHRDMLREVDKKHRRILTELEKAGVDEKIIREAKEHVDRSREKLKESDERNEENIKKVTKELRESHKRLRDKVKELAEANLPVEDLKRVLEDLDREVRESKERARKHVEDNERKVEESKKRADDNLRRLERKIREAAR

SEQ ID NO: 17068 - protein, 171 aa, Artificial Sequence; identical to SEQ ID NO: 17067
  Synthetic sequence.

SEQ ID NO: 17069 - protein, 171 aa, Artificial Sequence
  Synthetic sequence.
SVEETVDEELKKIHETHKRVVDKVRREHEKSHKKHRDILKRVEEVHRRILTDLERAGVDESIIKEARDHVERSREELRKSDEDNKRNIETVDDKARRSDEELKKDIDELRKAKLDKKDLDEMLRRLKRKVDESERDLKKHLDDNKRAVEKSREDAERNLKELRDKIREVKR

SEQ ID NO: 17070 - protein, 171 aa, Artificial Sequence; identical to SEQ ID NO: 17069
  Synthetic sequence.

SEQ ID NO: 17071 - protein, 180 aa, Artificial Sequence
  Synthetic sequence.
REEEEARKVLEELKRDVERNERESKEILDKDKRDVEEWVKELEKMLEESKKLVDDVRKAKKDLREEELEREVRRIEDTNRKLNTDVEEIVRRHVDKSEKLVERDKRLVEEWERKAEEIKKRLSTIEELKKAVEDIIRTLREVLEKSRKTLKDSNDRLRRALEKAREDSKRSIRRLREELR

SEQ ID NO: 17072 - protein, 180 aa, Artificial Sequence; identical to SEQ ID NO: 17071
  Synthetic sequence.

SEQ ID NO: 17073 - protein, 185 aa, Artificial Sequence
  Synthetic sequence.
SVREDAKRLLEELERAVRELVERLKKLIERHRRASEDTRRELEKLLRELEKAVEELKRGNKEEEKVRDVLRKLKERAEEIKKRLREIHEELRKHSEDLKRRLTEALDTLRKDIERIKRELTRDVRGTKALEDVKEALDRILERVKRAIEEARKKLDDVDEHNREVIERVEKEIDRILKDVEDAAR

SEQ ID NO: 17074 - protein, 185 aa, Artificial Sequence; identical to SEQ ID NO: 17073
  Synthetic sequence.

SEQ ID NO: 17075 - protein, 185 aa, Artificial Sequence
  Synthetic sequence.
SVEEEARELIERLRKLSEDTMRRLTELLKEHERLSRETKKEAERLLDELRKKVDDLTRDNRDDEEVRRVDEKLKRDVEKIKRDLRKIHEEVKKHSEELRRELEKIHKDVDDTVKEIKDRLDKKVKDDEVLERVKRELDRILDHNKKVVDEAERALRRVDKHNEDVLREVEKTLERILDKVKESAR

SEQ ID NO: 17076 - protein, 185 aa, Artificial Sequence; identical to SEQ ID NO: 17075
  Synthetic sequence.

SEQ ID NO: 17077 - protein, 178 aa, Artificial Sequence
  Synthetic sequence.
SVEEKLEKIVRDLERRVRKSEEDLRRMVEEVERTVEKHREELKRVVDTLRKIVRDKGADEDLIRELEKLKDDLRKRNDEARRRAEELKRRLEDLIRRSREESERLRKELDDVIRDDVKDEKVARDIKDKVREIIRRNEEVLEEVDRRARELIERLERTIEKSERDVERIIRELRERAK

SEQ ID NO: 17078 - protein, 178 aa, Artificial Sequence; identical to SEQ ID NO: 17077
  Synthetic sequence.

SEQ ID NO: 17079 - protein, 176 aa, Artificial Sequence
  Synthetic sequence.
SKEEEAEKLVRDLEDSSRKHKDRLRKLVRDLEELVKEHERDLKRIVEELKKLVDDASRSKREDVLKTVEDRLRELEEKLERSTRTIREVVKRVEEDLDRSTEEHEKLVEDIRRELEKRGGIKELEEELRRNLKEVREVTEDAKRKLRDILRKVEDASRRVKEMLDKILKRVEEEIR

SEQ ID NO: 17080 - protein, 176 aa, Artificial Sequence; identical to SEQ ID NO: 17079
  Synthetic sequence.

SEQ ID NO: 17081 - protein, 177 aa, Artificial Sequence
  Synthetic sequence.
KLDEDIRKLLKEALDRNKEMLERLKKTLDEALEKVKKLLEDLRRVNKEVEDELRRAGLPEDSLRKVKKESDRSLREIEREVREAERRLKEILDELKRVLDRSKEILDELKKDLDRVRGEDVLREVIRRIRKVIEDTDRTWKRLIDEIRKEVKDVLDKARRLIRESEKLMEDIKRRTK

SEQ ID NO: 17082 - protein, 177 aa, Artificial Sequence; identical to SEQ ID NO: 17081
  Synthetic sequence.

SEQ ID NO: 17083 - protein, 177 aa, Artificial Sequence
  Synthetic sequence.
DMEKRIEKLLKDMLDRVRELHKRVREVNKEVNKRVKELHDEVRKVNEKVNKAVKDRGLPEELVERVRRKSETTRKTNEEKLERINEESRETERTNEKLLDDIRRRLEELRRDLERVRGEEVLARVIERIRKDVEKVLREAEKHIEESRRLARKVLEELRRHIEENRRLLEEVDRRRR

SEQ ID NO: 17084 - protein, 177 aa, Artificial Sequence; identical to SEQ ID NO: 17083
  Synthetic sequence.

SEQ ID NO: 17085 - protein, 171 aa, Artificial Sequence
  Synthetic sequence.
EVEKKVEELLKRIEDDNKRVADRSRKLLRELKKRLEDVVRESRELLRRILKKLKEAGGRDEVEREVRRVVEENERRLEEILRRVEEVVKRNEDELRKSHDRLRKAVEKMRRAKIREDEVADRLRKLRKESEEVVERSDRHLKDLERRIEEMAERSRRHLKRLEDKIREDAR

SEQ ID NO: 17086 - protein, 171 aa, Artificial Sequence; identical to SEQ ID NO: 17085
  Synthetic sequence.

SEQ ID NO: 17087 - protein, 178 aa, Artificial Sequence
  Synthetic sequence.
SMEDRVREMLRTIKRVIEEAHERSKKILDEDRKVLKAVEDAVRDVLTKIKKLLDDARRRGQVSDDLVREITEKIKRILDEVRRIIEKNERELERWRREDEEILKDLERLLRELEKDVRTTKVDEEVVKRAKKLLEEIEKLARESLERLRDNLRKTEKLLKDLLDEAKRLLEEIKETVD

SEQ ID NO: 17088 - protein, 178 aa, Artificial Sequence; identical to SEQ ID NO: 17087
  Synthetic sequence.

SEQ ID NO: 17089 - protein, 178 aa, Artificial Sequence
  Synthetic sequence.
DIEEEVKKILDEIRERIKKMKRDLERLSKEDEDVLRKVKKDVDEVLKRAEESLRDVKRRGRVDDEVVERLKRRLDRLREDVRRIVEDNKRRLKEWNERTEEVIRRLKKRLDDVRREVRTTKVFEEVLRKLEEILRDIKRKADELRKRYRENIEETERLLEELLRRAEELLRRLDETAR

SEQ ID NO: 17090 - protein, 178 aa, Artificial Sequence; identical to SEQ ID NO: 17089
  Synthetic sequence.

SEQ ID NO: 17091 - protein, 181 aa, Artificial Sequence
  Synthetic sequence.
SEAEKLLEDIRRIIKEVKENVERSLEKIKRLIEELEKNARDLVRRIRKLIEDLERKVRRDGNTEELRREVEKLEEELREHVKRHEEKTEKLAEELKEHNERHKTESEKVERKLREDLKRIEDEKVIRDIEKLIEDLKRISEKANEDNKRLIDDMRRISKEVARTIKELIERLRKIVEEARK

SEQ ID NO: 17092 - protein, 181 aa, Artificial Sequence; identical to SEQ ID NO: 17091
  Synthetic sequence.

SEQ ID NO: 17093 - protein, 181 aa, Artificial Sequence
  Synthetic sequence.
SEAEELLERIKKLIEDLKRDAERLLREIEEMIKDIRRHVEEDLRRLREVIKEIKRLVDERGNTDDLERRVEEISRRNEKNIKDLEDKVREIVRRLEEVLKKHKEDTDRLVEKLKEDLKRIKDEEVEREIRRLIEEMKRISEEVRKEIKRLIDELEEIVRRAKEALKKLNEELKRIVDEAKR

SEQ ID NO: 17094 - protein, 181 aa, Artificial Sequence; identical to SEQ ID NO: 17093
  Synthetic sequence.

SEQ ID NO: 17095 - protein, 178 aa, Artificial Sequence
  Synthetic sequence.
SKVEEVLKRLERLIRELKRLMDEVREDNREVLERLERYAERNERENRELLKKLEDVARRRSPREELRRELKEIHDRNRKSIEELEDRLRKVHERNRDIIRRLRETLRKIEEDLKELTKDGVSKEELDKMLKTAERVLREIEKDIEKLDRDLKRVVERIRDRSRRLDEAAEEIVRRIED

SEQ ID NO: 17096 - protein, 178 aa, Artificial Sequence; identical to SEQ ID NO: 17095
  Synthetic sequence.

SEQ ID NO: 17097 - protein, 178 aa, Artificial Sequence
  Synthetic sequence.
SKMEEVLKRLEKLLRELEEYVERNERENRKLLEELEDYVRRNEKRNKEILEELRDVVRRRSPREDLRRKLEEAHKENRKSIEDLRRKLERIHERNKRSVEELRKRLDEIKKEVDELRRDGVSDEELRKALERLRRVVEKVEDISRELDDRLRRVVEKAEEISRRLDEEIKEVVDRAEK

SEQ ID NO: 17098 - protein, 178 aa, Artificial Sequence; identical to SEQ ID NO: 17097
  Synthetic sequence.

SEQ ID NO: 17099 - protein, 178 aa, Artificial Sequence
  Synthetic sequence.
SKVEKVLDDMRRIIEEAERLLEEVKRRHDEIIERVKRYAEENRRRNEELIEDLKRVAEKRGPREDLRDKLRRIHKENEDSTRELRDRVRRVNEESRELVERLERKLRDVARRVDELRKDGISKDDVRRLLEELRKVVEDVKRLSKKMNDRIEKIAKEIEEESERLDRTIAEIVKEIEK

SEQ ID NO: 17100 - protein, 178 aa, Artificial Sequence; identical to SEQ ID NO: 17099
  Synthetic sequence.

SEQ ID NO: 17101 - protein, 181 aa, Artificial Sequence
  Synthetic sequence.
DEVEKVLEELRRLLKEDEDIVRELLKRLKELLEDIDRIAKETEKEWRKILREIEELRRKPIPEEDVKRLRERVERVLRESEKRVKELRERLKELLKKIEEDLRRSEKRLKELRDDIRRKGLPEDAEREVDRVVRTIEESTKDAREKVKRMADEIERIIKEVEDLNRKLVEEIERVIREVER

SEQ ID NO: 17102 - protein, 181 aa, Artificial Sequence; identical to SEQ ID NO: 17101
  Synthetic sequence.

SEQ ID NO: 17103 - protein, 173 aa, Artificial Sequence
  Synthetic sequence.
DSEETLRELVKTIEDSSRKVKKRNEELARELRRRIEEAREANDRLVETIRKEIRELPVPEETVRRLEELIKTLKERSEELVRKLEDKIRRILEKSEKLLRETKKELKELTDKLKDLRREELEKTARKLIEDDEKKARDTEREWEELIRDIERLVRESLEAWKRLREEIRETVR

SEQ ID NO: 17104 - protein, 173 aa, Artificial Sequence; identical to SEQ ID NO: 17103
  Synthetic sequence.

SEQ ID NO: 17105 - protein, 173 aa, Artificial Sequence
  Synthetic sequence.
KSEEELRKLVRELEELIERMERTNEKLLRELKEVLDRARERNEELVRRLEDLIRRLPVDKDTVEELKRLIEELKRKSEEILRRLEKKLRDHRREVKKLADDLRRKIKELEDKLKDLREEELRKEAEDLIREIEEKVRRSKRNLEELIREIRELVERSEDEWRKLIKRIADAVK

SEQ ID NO: 17106 - protein, 173 aa, Artificial Sequence; identical to SEQ ID NO: 17105
  Synthetic sequence.

SEQ ID NO: 17107 - protein, 173 aa, Artificial Sequence
  Synthetic sequence.
SSEETLERLLREIERVLEEARKRNEDLVRKIREVIKEALERNKRMLEEIKKEIDRLPVEEELVKDLRDKLDKHRREVEKIITELKRLIDELKKESDDLLDEIRKKLKDLKDLLKDLRSEELLRTAKRLLEDIERIVRETLKKWRDLEREIRKLVRESTENLKRIIEEIRERAR

SEQ ID NO: 17108 - protein, 173 aa, Artificial Sequence; identical to SEQ ID NO: 17107
  Synthetic sequence.

SEQ ID NO: 17109 - protein, 174 aa, Artificial Sequence
  Synthetic sequence.
SKVDEVIRDLARLLDELRRHVDDSVRRMDEVVKRSTREADELAKRLDELVKEVEKKPGDKRVERMVREIERLVREVLEELKKKYEKLKREVEENLRRLEETVRDIVEKARKVTEDGVSKEKIDRIIRELERILEEAKKKHEDVLRRLEDSLRRVAELLKAALDRLREIVDRLRR

SEQ ID NO: 17110 - protein, 174 aa, Artificial Sequence; identical to SEQ ID NO: 17109
  Synthetic sequence.

SEQ ID NO: 17111 - protein, 174 aa, Artificial Sequence
  Synthetic sequence.
SKADDVIRKLRELLEELRTHVEKSIRDLRKMLEDSTRHAKRSIEELERLLEEVRKKPGDEEVRKTVEEISRRVKENVKRLEDEYRRLEEEVKKNLDRLRKRVEDIIREVEEMRKDGVDEEKLKDLIRKLRDILRRAAEAHKKLIDDARESLERAKREHEKLIDRLKKILEELER

SEQ ID NO: 17112 - protein, 174 aa, Artificial Sequence; identical to SEQ ID NO: 17111
  Synthetic sequence.

SEQ ID NO: 17113 - protein, 174 aa, Artificial Sequence
  Synthetic sequence.
SKVEEVVRTLDELLKRLEEHVKESIRRIKKVIDDSNREADELIRDIDRLLKELEKKPGSKELTDEARKIAEKIRDVLRRLKEKYERLEKDIRDNVRRITEEVKRIEEDVERLKEDGVDKDRVERIIRELRRILEEIRDLHRKLEEELRRSLKEVEDRLRELLKKLEDILRELRR

SEQ ID NO: 17114 - protein, 174 aa, Artificial Sequence; identical to SEQ ID NO: 17113
  Synthetic sequence.

SEQ ID NO: 17115 - protein, 180 aa, Artificial Sequence
  Synthetic sequence.
DEVEDLLRKLKDTIRRLKAHADRDLKKLEEILEKLRRHVEKNLRDLERILKELKDLSRTIDDEELRRRVEEVIKKDRDNNRRLNDESRRASEENRRNLETLAREVERVVKELEDELSRVRVEEVAERVRRVIKELRKLLEEIARALEDVNKKAKEINDKADEDSKRVNDELKRIIKEIRD

SEQ ID NO: 17116 - protein, 180 aa, Artificial Sequence; identical to SEQ ID NO: 17115
  Synthetic sequence.

SEQ ID NO: 17117 - protein, 180 aa, Artificial Sequence
  Synthetic sequence.
SEVDELRRRAEESSKKIRKIAEELTKRLKDLLETIRRLMRKIEEDMKRTSEEIKDLIRRGNTEEVLKRLEEKSRDLLEKVRKILEELKRELERLEKEVEERLEKLKRESEDLERRVSNATDDRLRDVVKKLHKKNKDILDEIRDIVRRLKEEVDTILKEIKERLEELHKNNERLLREAKR

SEQ ID NO: 17118 - protein, 180 aa, Artificial Sequence; identical to SEQ ID NO: 17117
  Synthetic sequence.

SEQ ID NO: 17119 - protein, 181 aa, Artificial Sequence
  Synthetic sequence.
SAKEKLEDLLRKLKRILDELEKTSREMKERVERIIRELEKTVREVHERIKRLIDEALKRNRGDDRVREIVEEIRKKSEDVNRETEEIAERLRRELKKLDDEDKDILRRLKERIEELRRKAEETSISEELKKELEDLLRKIEKLIKESEEKWRRLLEEIKREIERLRETYAEILRDVKRRDK

SEQ ID NO: 17120 - protein, 181 aa, Artificial Sequence; identical to SEQ ID NO: 17119
  Synthetic sequence.

SEQ ID NO: 17121 - protein, 181 aa, Artificial Sequence
  Synthetic sequence.
SAEETVRKLLEEIKEIIKRMEDRVREVLEENRKSIEDLEERVRRLHEEVERIIREALEDLRGDKRVDEIVKELRERSDRLNKRVEEILRELKKESEDLDREVKKIVEELRKRLEDAAEEVKRTKIDDEVKRELKRILEEIEKLIEELLRRMKESNKKIRKLAEDLTREYKRLLDEIRKRRK

SEQ ID NO: 17122 - protein, 181 aa, Artificial Sequence; identical to SEQ ID NO: 17121
  Synthetic sequence.

SEQ ID NO: 17123 - protein, 174 aa, Artificial Sequence
  Synthetic sequence.
REVEEVVKRAEEVIRRLEKEVEDIVRRVAKHLKDNEDHARRSVERLRRDIEELKKEDGDDEVRERIRRLKEDVDRDNKELRDNVERVKREIDRMVDELRKKLEDLKRRIDDVRRRGLLDELVKEVKKKIDDVLKKAEDLARKLKKEHDEVVARITEAHDEVKKRVEKVLKELED

SEQ ID NO: 17124 - protein, 174 aa, Artificial Sequence; identical to SEQ ID NO: 17123
  Synthetic sequence.

SEQ ID NO: 17125 - protein, 174 aa, Artificial Sequence
  Synthetic sequence.
SKVEDVIREIRELIKRLEKHVKDSVREVRKHIEDNKRKVEKLVKEVEDVIRELRKEDGDERVEEKVERLKRRIDEMLKDLEENLRRVKREVREDNRRLKKLIEDVKKKITDVERDGLMRELAEELRRRLDEVLEKATRLHRELEKRHDDVLREAEKRLRDLKREIDKVLDDLRR

SEQ ID NO: 17126 - protein, 174 aa, Artificial Sequence; identical to SEQ ID NO: 17125
  Synthetic sequence.

SEQ ID NO: 17127 - protein, 175 aa, Artificial Sequence
  Synthetic sequence.
EEVERVVKELRDHLAETKKKIDEIIKRLDDHIEENRERVERMVEELRRILKEIRDSNVREDEVRKLVEELLRRAREVLRESEKNIRDVKKEAEDVLRDLERNIRDSERKLEEVLRRGLAREVVDEVRKEHRDVLREAEELIKRVEKDHEKSHREVKKLIEDVERRLREVLKELRD

SEQ ID NO: 17128 - protein, 175 aa, Artificial Sequence; identical to SEQ ID NO: 17127
  Synthetic sequence.

SEQ ID NO: 17129 - protein, 175 aa, Artificial Sequence
  Synthetic sequence.
KEAEDTIRKVSKHIEDNKRKVEEMIKKLKEHLKETEEKIRRIVKKVRDEVRKLEENNVPEDEIKELVDRLRKELKDVLDDLKRNIEEVEKEAEDILRESEKNIRDVEKELEEMRRNGLDEKLVRDLKRRHKESHDEARKLIEEVRREHEEVLKRAEDLIRELDKRLKEVLDKLRK

SEQ ID NO: 17130 - protein, 175 aa, Artificial Sequence; identical to SEQ ID NO: 17129
  Synthetic sequence.

SEQ ID NO: 17131 - protein, 175 aa, Artificial Sequence
  Synthetic sequence.
SEAEEVVRRVEKHIRDTEKKIRDIVRRVKEEVDRNSERVREMVERVRKEIEELERAQVPEDRIEEEAKRLEEELKRILEEDKRNIDRLKEELDRELEDLRRNIREVERRLDELTRRGLKKEVVDELKKRHREVLEEARRLIEELKERAERSHRESKKLIDELREEIRRVLEERRR

SEQ ID NO: 17132 - protein, 175 aa, Artificial Sequence; identical to SEQ ID NO: 17131
  Synthetic sequence.

SEQ ID NO: 17133 - protein, 178 aa, Artificial Sequence
  Synthetic sequence.
SEVEDIVTKLRDKVERHREEVKRIIDTLKKLVEEHKRRVDDEVKKLDDTVKRLREANVDEETLREVEERIDERLRRVLDRSREVKKRLDKALDEVRKRSKEVHEELRRALEEVRKRSRDKRVDDLLREVEERLERSNREARKLLEEVKREMEESHRRLKKLLDEVREKVRRVVEELRK

SEQ ID NO: 17134 - protein, 178 aa, Artificial Sequence; identical to SEQ ID NO: 17133
  Synthetic sequence.

SEQ ID NO: 17135 - protein, 177 aa, Artificial Sequence
  Synthetic sequence.
KVEELVKEVDERIKKVLDDLRRALEDVRKKAEDSVRRMEELSEKVKRDLDRVIAKAEEKGLDEKDLDELRRILERLRRENKKLNEESRRDLEEVRKELEEVLKRAEEMVKRLKDTLRRDGVDEEVVKRLEEILRRLKETIDRVLERLKRRVEDHDRKVEKRVRENEKAVEDLKRRID

SEQ ID NO: 17136 - protein, 177 aa, Artificial Sequence; identical to SEQ ID NO: 17135
  Synthetic sequence.

SEQ ID NO: 17137 - protein, 179 aa, Artificial Sequence
  Synthetic sequence.
SVEEVLEEARKDIDRLIRRMEEISERAKEKIERLIDELRKISEEANKKNEEVLRELREKGGDNKERVDEIEERLKRHNEEHRRRTEDLERKLRKHVEEHKERTREIKEELKRLLKELEEANIPREDIKREVDRLLEEIRRLIERLRENVKKLLDEIRKLIEELDENVKRSLKKLRDDIR

SEQ ID NO: 17138 - protein, 179 aa, Artificial Sequence; identical to SEQ ID NO: 17137
  Synthetic sequence.

SEQ ID NO: 17139 - protein, 188 aa, Artificial Sequence
  Synthetic sequence.
SLDDILREVRRTSRELNEESRRIVDRAKRESEELLKELETILRDATRRLDDLLRKLDEKRQDEEVKKILRDLREEIKKLREDVKRELDRLRKHTEDLVRKVEELNRRSEEHLKKLEEEVDKAKKEGQDRETVVKELEDKVREHLRTNRELIERLEKEMRDHLREIKRKIEELERRIRKLVEEVKRRID

SEQ ID NO: 17140 - protein, 188 aa, Artificial Sequence; identical to SEQ ID NO: 17139
  Synthetic sequence.

SEQ ID NO: 17141 - protein, 175 aa, Artificial Sequence
  Synthetic sequence.
DELEDLVRKAEKLVRESEKKIKEIVDDARRLIEDSEREIREIVKKLRELSKRVEEELRRDGPTEELEKKLRRITEELDKLLEDLRDKNRRINEKLRKDIKELERENRDINRELTKRVRMKDLLKELRDKSKRVLEKLRRLLEEINKRSRDVLEKLKRLADEVRESNREVLDRARK

SEQ ID NO: 17142 - protein, 175 aa, Artificial Sequence; identical to SEQ ID NO: 17141
  Synthetic sequence.

SEQ ID NO: 17143 - protein, 172 aa, Artificial Sequence
  Synthetic sequence.
RELEEIVKDAERLVKKDTEDIRDKVRRAEEVVKKDTEDLEESVKRVKDKVKELEDANIRRDEARKVAEEMKKELKEVLDDNERKSRDLKTKLRKVLEENKKKVDEIREDLERRMKSEELLREIEERIKRSLDESRKLVREIEKKVDESNERSRKLVEDVEREIEEVLKRLAD

SEQ ID NO: 17144 - protein, 172 aa, Artificial Sequence; identical to SEQ ID NO: 17143
  Synthetic sequence.

SEQ ID NO: 17145 - protein, 177 aa, Artificial Sequence
  Synthetic sequence.
SSEDILREVKKLLDDSLDKLRRLIEKIKEDLDRSVDRHRKLSEEIRRRHERVREAVERRGSSEEKKERIERNIREVEEEIKKVDEESKRIVDKLEKELREVLRKSEETIKKIRKDIKDEGVDEDVARKLRELVREHSKEVEDKVRRAARLVEEHTERSDRVADKLRKHIEETKKRID

SEQ ID NO: 17146 - protein, 177 aa, Artificial Sequence; identical to SEQ ID NO: 17145
  Synthetic sequence.

SEQ ID NO: 17147 - protein, 177 aa, Artificial Sequence
  Synthetic sequence.
SKEEILKEITDRVRESRKRTKKLLDDVREELERSHRRLEKLIREVEKRLREVKRKVDESGQSEEMVKRVEDVVRTLTEELKKVLKENRDEIRRIEKRIKEIDEENDRTIRRIEDRIRREGADEDVVRDLRRLVKEDTDRARKVVRELEREVERDKEEVERIVDKAEKKVRELEERIR

SEQ ID NO: 17148 - protein, 177 aa, Artificial Sequence; identical to SEQ ID NO: 17147
  Synthetic sequence.

SEQ ID NO: 17149 - protein, 178 aa, Artificial Sequence
  Synthetic sequence.
DEVEKAVADLRRLNEEHTRDIDKAARDLERLVKKHTDEVRKLVRDLEKLVKDLKDANLREDEVEEVVRRIDETLKRILKRSEDVVREIERELDKIRRKSEEAVKRSEDMLREIARRSRDEKLEELLKEVEETTRRSLRRLEELLRKVERAVRESHKELKKLLDEVREKVKKVLEELRR

SEQ ID NO: 17150 - protein, 178 aa, Artificial Sequence; identical to SEQ ID NO: 17149
  Synthetic sequence.

SEQ ID NO: 17151 - protein, 178 aa, Artificial Sequence
  Synthetic sequence.
DEVEKAVRDLEKLNEEHTRRVEKVVTDLRDLVRRHTEEVRKLVDELRELVERLRRAKLDDKTVKKVADDLRKKLRDIEERSKEMVKKAEETLRRILEDSKRAVDESRDRLREIARRRRDKKLEKLLDDVRKTTETSHERLKRLLEEVEERVRRSHEELKDLLRKVKELVEKVLRELKE

SEQ ID NO: 17152 - protein, 178 aa, Artificial Sequence; identical to SEQ ID NO: 17151
  Synthetic sequence.

SEQ ID NO: 17153 - protein, 178 aa, Artificial Sequence
  Synthetic sequence.
SEVEKLAKELRDLVREHTKRVRELIDELKKRVEDHTRKVEEIVKRLKKLVDDLRDANLDKDEVRKALEEAKRRLDDVRRRSKEVTDRLDKTLKDIERESERAVREMDRRLREIERRSRDKKLEKLLKEVRELVKRSHDELKKLLDRVREAVEKSKRRLEKLLDTVRRLLEKVVRDLER

SEQ ID NO: 17154 - protein, 178 aa, Artificial Sequence; identical to SEQ ID NO: 17153
  Synthetic sequence.

SEQ ID NO: 17155 - protein, 178 aa, Artificial Sequence
  Synthetic sequence.
SEAEKLVEELRRLNERHTRRVEEVVRRLDEEVKKHRKDVRELVRELRKLVDELRKANLDEDTVRKVAEEAKKRLDEIRRKSERVVERMRRELKKIKDESEEMVKESRKRLTEIARRSRDEKLEELLREVEETTEKSHRDLKRLLDRVREKVEDSHKELEELLKEAKDRVDRVLEELRR

SEQ ID NO: 17156 - protein, 178 aa, Artificial Sequence; identical to SEQ ID NO: 17155
  Synthetic sequence.

SEQ ID NO: 17157 - protein, 178 aa, Artificial Sequence
  Synthetic sequence.
SLEDKVRDDVRKLLAEAKKVADDLRKVVEDHRKTVEDVIREIRRRVEEHLKKLKELIDAGVDERVLEELKRHSEKLVEDIERLLRELNKHSERLLREAEKILRELEKKVRDTKKELRDRGVDDRVLKRIEEEIRRLLKELREIVKDLERLDRELTDELRKLVEEVRRLSETVLDEARK

SEQ ID NO: 17158 - protein, 178 aa, Artificial Sequence; identical to SEQ ID NO: 17157
  Synthetic sequence.

SEQ ID NO: 17159 - protein, 182 aa, Artificial Sequence
  Synthetic sequence.
SLDEDVAEKMKELEKENKDLLDTIRRLIEELEKHARELLKRIEDLIRELTEDAKRLEDSNLREDELKRELDRLRDKVRKVRKEIEELLKEHEDRSRKVVRDIEEKLKESNRKVKELLEELKTRGVDRRILEEIRRTNEELTERVRDLVEEMRKTSEELLKEVRKIADEVRRTVEEALKRLEK

SEQ ID NO: 17160 - protein, 182 aa, Artificial Sequence; identical to SEQ ID NO: 17159
  Synthetic sequence.

SEQ ID NO: 17161 - protein, 179 aa, Artificial Sequence
  Synthetic sequence.
DEAEKILRDAKRLVEELSKKLEDNLREIKEVIDRLSEELDRNLKEHRDLIRKLEEDMDRKGVDDKEKKKLREDHDRYRKEVEERKKKLRDELKKYKERVEEMIEKLKRRLEEIEKRIRDEGKITEERAREVEEDIKRAEEEVERSIRESKKRTRDAEREVRESKKKSEDHIREVEKRIR

SEQ ID NO: 17162 - protein, 179 aa, Artificial Sequence; identical to SEQ ID NO: 17161
  Synthetic sequence.

SEQ ID NO: 17163 - protein, 183 aa, Artificial Sequence
  Synthetic sequence.
SELEELLKELKEIVERSADHLRRSNDDLRKIIEEVTKTLEKILEDLKRIVEEVVDRARKKVSDKDRVRELKKRLEEDLRRVEKKVRDIKKEAEDSLRKSEEDVREYKRKLKEDLDRLKEIIERNEDREEELKKKLKELKDRAKETNERHRRDVERLMEKLRRDLERLDREVKDLEKKLREEEK

SEQ ID NO: 17164 - protein, 183 aa, Artificial Sequence; identical to SEQ ID NO: 17163
  Synthetic sequence.

SEQ ID NO: 17165 - protein, 172 aa, Artificial Sequence
  Synthetic sequence.
SDREEIKRRVEEEAKKSRENLKETLREVDERVRDSERNLKRHHEEVKKAIDDLRRSDVPREEITKRLRELLRRSEKKIEEAMRDHDRILKEIKERADKAERDHDDRLRKLEERGLEKRILDDVRRLLEELKERYRRIVDEIKKLLERLKEAYKRNLDRVRELIERIEKEIRD

SEQ ID NO: 17166 - protein, 172 aa, Artificial Sequence; identical to SEQ ID NO: 17165
  Synthetic sequence.

SEQ ID NO: 17167 - protein, 180 aa, Artificial Sequence
  Synthetic sequence.
SELEEVKERIERLVRRHKEELEKVRREIEREVKKHEKDLEDLERRSREHIETAERLLAENRVREDEVRRILKENRDEAREVEKKSREHLDRLKKRLDKLREDSKRHLEDVERDLKRLKDRGDVDDRILEEARRLLDRLREENEKVLKEAEDMLKRLEDENRKMLEENEKLLKELKKEVDK

SEQ ID NO: 17168 - protein, 180 aa, Artificial Sequence; identical to SEQ ID NO: 17167
  Synthetic sequence.

SEQ ID NO: 17169 - protein, 180 aa, Artificial Sequence
  Synthetic sequence.
SEVEEVLKTIEKKDEEHKRELERVKEEVDEDAKRHRERLKKVDRDVKEEIKRLRKLLEDRTVDEEEVREELRKLTERLDKLRKDSEKHLRDVEDKLRRLRERSERHLDTVRKELEDMRRRGDIEEKILEEIKRRLDELRKRNEDLLRRVKELLDELREENRRLLEDAKRLLEEVLKRARD

SEQ ID NO: 17170 - protein, 180 aa, Artificial Sequence; identical to SEQ ID NO: 17169
  Synthetic sequence.

SEQ ID NO: 17171 - protein, 180 aa, Artificial Sequence
  Synthetic sequence.
SELEEVEKKVREDARRHKEELRRVEEEVKRNAEKHRDELRRVREDIERKIRTLRELLKERRQSEEDVKRRLDKLRDELKKLKERSKKHLDDVERRLEELRKESERHLREVEKELEELRTRGDVSEEILRRVKKLLDELRDENRRLLERVRELLERLREENERVLREVKKLLDEVKREAEK

SEQ ID NO: 17172 - protein, 180 aa, Artificial Sequence; identical to SEQ ID NO: 17171
  Synthetic sequence.

SEQ ID NO: 17173 - protein, 182 aa, Artificial Sequence
  Synthetic sequence.
SEREKLLKELKDNLDESRRRVEELLKRIKENLEEVKDRAKKTLDDLKRDIEELRKLVERRETREEEIKKKLKEHDEKTEKIKRDLRDHLRRHKEDTKRLVEELKKHLEDHKRKIEDIERKLKDEDVKRRLRDLSRRLAREHEKVIEKLRRLSDELEKIHREIEERLERLSDELRKEADKARK

SEQ ID NO: 17174 - protein, 182 aa, Artificial Sequence; identical to SEQ ID NO: 17173
  Synthetic sequence.

SEQ ID NO: 17175 - protein, 182 aa, Artificial Sequence
  Synthetic sequence.
DEARELLKRLREINEKLKKDVEEIERRLEKYNRDVKRKLDDSIRELKEKLDRLRERIRDEGTGREDLERVKKDVEDYLEENRRRAEESKRELERLLREVREKLKRSVERLDEALEKVDRDGLPEDVRRAVEELVRRHKDTVKKIEESVRRLVEEHKRTVKEALDRSRRIAEEIKRVLDEAAR

SEQ ID NO: 17176 - protein, 182 aa, Artificial Sequence; identical to SEQ ID NO: 17175
  Synthetic sequence.

SEQ ID NO: 17177 - protein, 182 aa, Artificial Sequence
  Synthetic sequence.
SEEEKLLTELKKLNDDLERRVRKSLDEIRRYNEKMREDVRRSDREVREEKKRLDEKLKKDGTDDDELRRVKKKLEDYLRRNEEEVRKSREEVRRYLTKNREDVRRSKEELRKLLEKVKKDGLPEEALKKVRELVERHKRTVDEALEKSERLLREHERTVDEVLDRSRRAVEEVKKTLDDARK

SEQ ID NO: 17178 - protein, 182 aa, Artificial Sequence; identical to SEQ ID NO: 17177
  Synthetic sequence.

SEQ ID NO: 17179 - protein, 181 aa, Artificial Sequence
  Synthetic sequence.
REAEEVRRRIEESHEEVRRRARKDERDLEESHKRLEEKAKELKDELRKILKDIDDLAKSNVSEESVKKLKEDLDRKLEEVERRMREDKKRHEDHLRESEKDMRRLKKEHRDRLEELRRAGLPEDVLRDIEKLVRDNEEALDRILKRTKELVDRNLEAIDRILKEVEELVRRIKELLDRAKK

SEQ ID NO: 17180 - protein, 181 aa, Artificial Sequence; identical to SEQ ID NO: 17179
  Synthetic sequence.

SEQ ID NO: 17181 - protein, 179 aa, Artificial Sequence
  Synthetic sequence.
SEVEEVLERLKRKLDEIERESRESAKKIRREIERIEKEARDSLRRLKKLIKEIEDRVRRDGRRRDELDELLKRLEDYVRRSVERLERLLEDLTKKVRDHERTLRRRLKRVRDDIERLKEAGIDREELEKLLKRLEEVVRESEKEIEDLLRRVRELIERIKREHEKILKEAEEVIRRVKK

SEQ ID NO: 17182 - protein, 179 aa, Artificial Sequence; identical to SEQ ID NO: 17181
  Synthetic sequence.

SEQ ID NO: 17183 - protein, 179 aa, Artificial Sequence
  Synthetic sequence.
REVEEVLRELEEHIERSKRKSEESLKEIRRRIEEIEERSRRSLTELKKRIDDIKRRVEKDGPREKELDDLLKDLKRKADEHAKRLRDLLKELEDRVREHERDLERNLKEIKEKIEELERAGIDKEDLKRLLDKVTEVHKESAKEIRKLLDEARKVIEDSLRAIRDILRKIKETIDRDKT

SEQ ID NO: 17184 - protein, 179 aa, Artificial Sequence; identical to SEQ ID NO: 17183
  Synthetic sequence.

SEQ ID NO: 17185 - protein, 179 aa, Artificial Sequence
  Synthetic sequence.
EEVERVLEKLKRHIDDSRRKSKRSVDEIRKHIERSKRRSEESVERVKRELERIEEKVRREGNRRDELKTDLDRLRRYVRKHVEDLRENLKRIDERIKEHEDRLDKNLEDLKREIEELRKAGVDEEELKKLLEEAEKVHRDSKRELRKLVKEARDVHRESMETVKRLLDELEREIRRAET

SEQ ID NO: 17186 - protein, 179 aa, Artificial Sequence; identical to SEQ ID NO: 17185
  Synthetic sequence.

SEQ ID NO: 17187 - protein, 179 aa, Artificial Sequence
  Synthetic sequence.
SEDEEALKKLKEHIDRSREESKRSLDRVKREIERIREEIERDLRRLREELKKIEDRLRRDGPRRDDLERLLRRVEEEVERLKKKLDKLLEELRKYVEDHKRRLDENLERIRDEIRRLREAGIDEDELRKLLEDAKRVHKRSKDELKRLLEEAEKVIRDAKRKIKKLLDELRKVLEDARR

SEQ ID NO: 17188 - protein, 179 aa, Artificial Sequence; identical to SEQ ID NO: 17187
  Synthetic sequence.

SEQ ID NO: 17189 - protein, 179 aa, Artificial Sequence
  Synthetic sequence.
DEVRRVLEELKEHIKRSEKRVRENEEEIRRHIEKSKRDSDESLKELARLIKKIEDDVRREGTREKDLDKLLKDLERYVEEHKKRLDDNLRRLEEHIKRSKEELEKNLRRLREEIEELKKAGIDEEELKKILDEAEERHRRIEERHKDLLRKAEEVHRDSLRRLREILRRAEEVIRREKT

SEQ ID NO: 17190 - protein, 179 aa, Artificial Sequence; identical to SEQ ID NO: 17189
  Synthetic sequence.

SEQ ID NO: 17191 - protein, 179 aa, Artificial Sequence
  Synthetic sequence.
KEVEEDLERLKKHTEDTRKRARDNLERIKEELEEIRKESEDSARKVRRDIEEIKRRVDETGPDRDELDRLLRRLEEYVKRHKDRLRELLRRVEEHIKKSIRELREDLRRLREEIEELKKAGVDERELEKLLKEHEKTIRDIEEEHRRLLKELKDVVRESSRELEELLKEAEDVIRRVKK

SEQ ID NO: 17192 - protein, 179 aa, Artificial Sequence; identical to SEQ ID NO: 17191
  Synthetic sequence.

SEQ ID NO: 17193 - protein, 182 aa, Artificial Sequence
  Synthetic sequence.
DEVREALKRLEDETRKNKKESDKSLERLKEESKKNKDESDKSVKNIEDKIKKLKEDLDRDGPDEDRLREVLKRLRDYLREHKERLDRSKRKLDEELKKHREDLKRSKDRLDEELKRLDKEGLPEEVKRALDELVKDHRRVLEESARRIDEIVERHRRLLDDSLRRIAELVRRVEETLREERR

SEQ ID NO: 17194 - protein, 182 aa, Artificial Sequence; identical to SEQ ID NO: 17193
  Synthetic sequence.

SEQ ID NO: 17195 - protein, 182 aa, Artificial Sequence
  Synthetic sequence.
DEVEKALKELEDDLRELKKRSEESLKNVEEEIKRAKKELDESLDNLRKKIEELKRRLEKDGTNEDDLRRVLEELRKYLEDVRRKLEEVLRKLRDYLRKHEEDLRRVERELEKKLEDLERAGLPEEVLRKLETIVRKIREELDRSKKKLEKLIEEAKRELERVLKEHEDLVKRVRDVLEDARR

SEQ ID NO: 17196 - protein, 182 aa, Artificial Sequence; identical to SEQ ID NO: 17195
  Synthetic sequence.

SEQ ID NO: 17197 - protein, 182 aa, Artificial Sequence
  Synthetic sequence.
DDVRETLTRLRKETERNKRESDKSLENLKRKSEDNKRKIEESLKNMKRRIDEVKRRAEKDGPNEDELRKLKEELKRYLDRLREELERSVKEATEYVRRHERRLRESLKDLKRKLEDLDRRGLPEEVKKELDEILRRHKEVLRESERRLEKLLRDHRRRLEEALEEHKKLIDEAEETLKRIRD

SEQ ID NO: 17198 - protein, 182 aa, Artificial Sequence; identical to SEQ ID NO: 17197
  Synthetic sequence.

SEQ ID NO: 17199 - protein, 182 aa, Artificial Sequence
  Synthetic sequence.
SEVEKALKELEDKTRKNKEDSERSLDKLRKDIEELRKKAERSIRNMRDKLRKLRDDVRKEGPDKDRLEEVLREVERYLEELRKDLERVLEELKKYLEEHKRRLEESRRRLKEDLDKLEKDGLPEEARRKLKELVDRHEEVLRRSLERLKRLVEEVRRTLEKILRDHERLLDELRRDLEKDRK

SEQ ID NO: 17200 - protein, 182 aa, Artificial Sequence; identical to SEQ ID NO: 17199
  Synthetic sequence.

SEQ ID NO: 17201 - protein, 182 aa, Artificial Sequence
  Synthetic sequence.
DEVEERLRELEETTKENKRRAERSLENVRKKSRDNDKRIKESLDNIRREIKRLRDKVRKDGPNREELKEVLDRLRTYLKEVEKDLRRSLKELEDYLRKLEKELRESLEDLKKKLEDLRREGLPREVLEKLKEIVERHEEVLRRIKKKHEDLVREHRKRLEEARKRHEKLVREAEKTLDDVRR

SEQ ID NO: 17202 - protein, 182 aa, Artificial Sequence; identical to SEQ ID NO: 17201
  Synthetic sequence.

SEQ ID NO: 17203 - protein, 182 aa, Artificial Sequence
  Synthetic sequence.
EEVERILDELRRRNEDMRRRSEENERELRKRNTELRKKVEDSLRRLREDLKRIKKLVEEGRVDEETLRKLLEDVERYLKEHRDRLRKSLEDAKKRFKEHEDRLKKSLEDVERKLEELRREGLPEEVTKALEELVRRHRKTLEESLRKAEKVLRDHKESLERSEKKLKELMEEVKKLLDDARR

SEQ ID NO: 17204 - protein, 182 aa, Artificial Sequence; identical to SEQ ID NO: 17203
  Synthetic sequence.

SEQ ID NO: 17205 - protein, 178 aa, Artificial Sequence
  Synthetic sequence.
SREDEIRKRLEESLERVKKIIEDIKRRIDESLERIKELLKEIDERSKRSLEKIRRKIEREPRSEKVEKEAREHMKRLDELLREVEEYIERSIKELRELLDELRRYVEESEERLKELRRRGGSEELLRRARKAHEDLLREVKRRIERAEEEHKRLLDELRKVVERSKTEIKKLLDELRK

SEQ ID NO: 17206 - protein, 178 aa, Artificial Sequence; identical to SEQ ID NO: 17205
  Synthetic sequence.

SEQ ID NO: 17207 - protein, 185 aa, Artificial Sequence
  Synthetic sequence.
SRVEDVERKLRRKLEELKEDIERLREESRRSLEELERDSDRNRRESEDSLRRVEERIRRIKDDEDKERVTRTVEEELERHERRLRESKKRLDDEERKHKKRLEEVRREVTEKVRTIREELEELERDGVDRETLRRVEREIERLLRELEETLKRSEEELKRIVDEHRKLLERSKRELEKLVDEVRK

SEQ ID NO: 17208 - protein, 185 aa, Artificial Sequence; identical to SEQ ID NO: 17207
  Synthetic sequence.

SEQ ID NO: 17209 - protein, 186 aa, Artificial Sequence
  Synthetic sequence.
REIEEVLKRVEKVVRDDSRRNKEVLTRNRRKVERWKETLEDVLRRVEKAVRELRKDAEDRLREKKEKIAKVEDLLDKIRKTVKKVLDEVKKLLDDSIRLSEEMLRESERTLRDIEREVDEVSKKTRTEDILREVEKKLKELLDRSRELSDEVRKRSDESNKEIKKELDRARDELRRLLERIEEELN

SEQ ID NO: 17210 - protein, 186 aa, Artificial Sequence; identical to SEQ ID NO: 17209
  Synthetic sequence.

SEQ ID NO: 17211 - protein, 186 aa, Artificial Sequence
  Synthetic sequence.
DEIEKVLEEVERVVEEDERRNRKVLEENKRLVDEWDRRVREVLKDVKRRVDELDTRARRDLRENEEKIRKVRKLLDEIREVVERALKKVRELLERSIELSKRVAEDSKRTLDDIRRVVEEVARKTKDKEILDRVKERLERLLEESRELSERVKREIEETNERIARELERVMETLKKLLKDIEDELK

SEQ ID NO: 17212 - protein, 186 aa, Artificial Sequence; identical to SEQ ID NO: 17211
  Synthetic sequence.

SEQ ID NO: 17213 - protein, 186 aa, Artificial Sequence
  Synthetic sequence.
KEAEDVLKKVDTDVTRDDEDNRKLLEDNRRSVEEDERRNRRVLEEVEKRVRDLAERVKRDLREDSKRLEEVERLLRRIEERVTRALEDTKRTLEESLKLSEDVLRDSHRTNRDIKRVVEEVTRKVRTREILKRVTEELERLLAESERLSEEAEERVRRSDDTSRRLSEEVRKELEELLRRIEERLR

SEQ ID NO: 17214 - protein, 186 aa, Artificial Sequence; identical to SEQ ID NO: 17213
  Synthetic sequence.

SEQ ID NO: 17215 - protein, 186 aa, Artificial Sequence
  Synthetic sequence.
REVEEVLKRVKETVEKDREDNTRVLERNRESVKEDDDRNRKVLKRVRDEVRKLLEEAKRDLKDDEKKLREVTDALRRIIEEVERVLKESHDTNRESIKLSEKLIRDSERTLERIERRVDELVKKVRTEEILKRIEEELKRLLEESRELSKEVEDRVRKSDKKSRDLSEKVKKDLKELTDEIRKRLK

SEQ ID NO: 17216 - protein, 186 aa, Artificial Sequence; identical to SEQ ID NO: 17215
  Synthetic sequence.

SEQ ID NO: 17217 - protein, 186 aa, Artificial Sequence
  Synthetic sequence.
SEIEDILERVREEVDKDRRKNDEVLRENERLVKKDDDDNAKADEDVRRKVTELEKRARRELKDNREKLKKVKELLERIKERVKEVLRRSHKTNRDSERLSEKVVRDSRKTLREIEEVVEEVSRRIRSEEILKRVAKRLKELLEESKRLSDEVTKRSRDTDEESERLSRKVDKEVKDLLKEIERELE

SEQ ID NO: 17218 - protein, 186 aa, Artificial Sequence; identical to SEQ ID NO: 17217
  Synthetic sequence.

SEQ ID NO: 17219 - protein, 185 aa, Artificial Sequence
  Synthetic sequence.
SEVEEMEERLRKLDEDSRRLSEDVKRRLDKINKEIKDLLDDVRRKLKEMLDKLTKDLRDLKGKEEDVERVVREIEEDVKRVLKEVKRLVEESRRLSEKVLRDSERSVRESRELAKEALKRVKEKRAEDKVRDVLRDNERTLKKDEDDNKRVLDEDEKRLREWEERARRVLEEVRRRLKELVEEVR

SEQ ID NO: 17220 - protein, 185 aa, Artificial Sequence; identical to SEQ ID NO: 17219
  Synthetic sequence.

SEQ ID NO: 17221 - protein, 185 aa, Artificial Sequence
  Synthetic sequence.
REVDKAREDLRRVDDELRKILERVRRELEKLDKESEERSRRLARDLDRLLEELERDLKDNKGKRERVDRVVREIKEKVRRVLETSKKLVEKSRKLAEDVLREVEELVRRSKTLAEDVLRKVKEREVERKVREVLKDNERTLRELRDTIRKVLEDNDKTLREDVRRNEEVLRRVDETLRELKKRVE

SEQ ID NO: 17222 - protein, 185 aa, Artificial Sequence; identical to SEQ ID NO: 17221
  Synthetic sequence.

SEQ ID NO: 17223 - protein, 185 aa, Artificial Sequence
  Synthetic sequence.
SEVDKVKEDLDEVDKDSRRISREMEERLKELDKRSREISDRVVRELEKILKEIEDLLRDLKGRSEDVREMVRRLRELVKRVLKESKELVDRSRKLSDDALKESKRVADESRKLVEDALRKIDRKEARDKIRRVLEDNERTLREDIEDNRKVLEDNDKRLKDDERKNREVLKRVDETLKELDERVK

SEQ ID NO: 17224 - protein, 185 aa, Artificial Sequence; identical to SEQ ID NO: 17223
  Synthetic sequence.

SEQ ID NO: 17225 - protein, 186 aa, Artificial Sequence
  Synthetic sequence.
DELRELEERLRRSVEEIKRDLKRIHDENREAVERSERKSKKILEELKREVEDVKRELREKLKDDKEKVERVTRLLETVIKELRELVERNREELEESDREVDKLIKEVEKVLEDAERDLEDLVRRSRDEKLVREIERRVRKMEEDVRELVKTIEKRSRDVIKKSEDILKRIKERVEELEKRVRDAVR

SEQ ID NO: 17226 - protein, 186 aa, Artificial Sequence; identical to SEQ ID NO: 17225
  Synthetic sequence.

SEQ ID NO: 17227 - protein, 186 aa, Artificial Sequence
  Synthetic sequence.
DELRELLETLRDEVRKDDKRNEDIHRENRKRVEESRRRSEKILRDLREVVKRLEDELRKKLKDDKDKVRKVKRLLDEVIKTVEEIIRRNEKVLRDSDKTVREAIRRTHELNRRIIEDLEELVRKTRSEELLKRIEKRVRDMIRRSRTLSARLEDLSRELDERSKRVVEDLKRRIDEAIKELEKEVE

SEQ ID NO: 17228 - protein, 186 aa, Artificial Sequence; identical to SEQ ID NO: 17227
  Synthetic sequence.

SEQ ID NO: 17229 - protein, 180 aa, Artificial Sequence
  Synthetic sequence.
DETEEVAKKIKELIERSRELVKKVKEKIDRLNEEIEKLVREVEKTIKELTDRIEELRKRGVDAKDIERLLKEIEERVRKMLEDVKRILERSIRESEKALERNEEVLKRIKEEVEEALKRVDREEMKKLLDDLRKAVDESRRRSEEILKENRKRVEKWREDLRRLLEKVKEDLDRIRERLR

SEQ ID NO: 17230 - protein, 180 aa, Artificial Sequence; identical to SEQ ID NO: 17229
  Synthetic sequence.

SEQ ID NO: 17231 - protein, 180 aa, Artificial Sequence
  Synthetic sequence.
SEVEEAKKTLDELNRDIAKKVEDVEREIKRMIEESERLTREVEERIRRLTKKIEDLRRGGVDRKDIKELLERILKDVDKALKDSHKSNREIIRRVEEALKTIEELLKRSDELVKRVLDRVDEERVKKILEENKRDAERWKRRLKKLLDDVRRLVKEDDDRNEELLREVTERVRRIEEKLD

SEQ ID NO: 17232 - protein, 180 aa, Artificial Sequence; identical to SEQ ID NO: 17231
  Synthetic sequence.

SEQ ID NO: 17233 - protein, 180 aa, Artificial Sequence
  Synthetic sequence.
SEVEKVKEELKKLNKEIADSSDEVDKDIERLIRESRKLTEDVRREIKRLIERIDELRRAGVDEKELDRLLKEIIKRVEDALRKSHESNRRIIKRVEEALKRDKELLERSDERVAEALKRVDDEEAKRILDENKKLVREWEEKSRAVLEKVKKLVKRDDDENKKLLDDVKKLVDEMRERAR

SEQ ID NO: 17234 - protein, 180 aa, Artificial Sequence; identical to SEQ ID NO: 17233
  Synthetic sequence.

SEQ ID NO: 17235 - protein, 180 aa, Artificial Sequence
  Synthetic sequence.
DLEREIRKIIEEAKKELERVNDEIRRIIEEMRRRSEESNKRIREIIERARRRLEELIRRGVPKEDVERVLEEAIRRVEELLKESRRILEEVIKRVDKLLKDSERILKRVEDLVRELLRRVDTEEVKKLLTDLKRLVDEIRKHNKRLLDELRKEVEKSERENRRLLEEVRRTVDEMRERAR

SEQ ID NO: 17236 - protein, 180 aa, Artificial Sequence; identical to SEQ ID NO: 17235
  Synthetic sequence.

SEQ ID NO: 17237 - protein, 180 aa, Artificial Sequence
  Synthetic sequence.
SAEDKARKIAEDAKKEAEDSNRDAHRIAEEAKRRARKINEEARELIERAKKELTRLRREGADKRAVKKAAEEAIEIAERALRESDKAARDAIRLAEEALRRSKRIAEEARKLARDALEKVKAEEAKKLLDELRKAAEDIRRNNEEALKDLRRAAEEIRRHNEELLRRAREAAKKARDDAE

SEQ ID NO: 17238 - protein, 180 aa, Artificial Sequence; identical to SEQ ID NO: 17237
  Synthetic sequence.

SEQ ID NO: 17239 - protein, 185 aa, Artificial Sequence
  Synthetic sequence.
SAEEAVKRVEELVRRVKERNKRLVEDVEREVRRVKKRSEETNRRVKKLVERVKEDLDKRVSDEEKVKRIEDLLREILDTVRRLDEDSKRLLDEILERARRLIKKSDELLDRILKRARDMVKDLKDDKDKLEEVLREVRDRLADVERKSERVVEEVERLLREVVRKNEDVLRRIEELLRDVEEKAR

SEQ ID NO: 17240 - protein, 185 aa, Artificial Sequence; identical to SEQ ID NO: 17239
  Synthetic sequence.

SEQ ID NO: 17241 - protein, 185 aa, Artificial Sequence
  Synthetic sequence.
SVEELVREVEKRARKVKRDSDKTNKDSTKLVKEVKDRSRRTNEEVKKEVERVKEDLEKRVSDKEKVDRLKKELEDILRRVTKLDEESTRELKKINEEVTRMDEKSKKELDRILEELRRMAEKLKDDEDKLKEVVDRIRKLLEDVKRENEDVKRRSRELAERVREENDKVSKEIRELLEEVERRAK

SEQ ID NO: 17242 - protein, 185 aa, Artificial Sequence; identical to SEQ ID NO: 17241
  Synthetic sequence.

SEQ ID NO: 17243 - protein, 185 aa, Artificial Sequence
  Synthetic sequence.
SAEEMREEVKRLVDKNRKDNREVEKKSTRLAEDVKRKSEETNRKIREEVERVKKDLEERVSDEEKVRKLKDDLRKILETVDRMDETSVRELEKINRDLRKLVAENDELTDRVLKEAEKLVKDLREKEEKLKEVLDEVRRLIKEINDHSREVSKTSEKLLRDVLKKNEDVLREIERLLEEVRRRIK

SEQ ID NO: 17244 - protein, 185 aa, Artificial Sequence; identical to SEQ ID NO: 17243
  Synthetic sequence.

SEQ ID NO: 17245 - protein, 178 aa, Artificial Sequence
  Synthetic sequence.
REVEEITKEIREMNEESKRLLEEVREKIERLSRESNRLLEDSKREIDEAIRRVEELLDKEDKKDVVEKLKEVVKRAHERNEKIVKDDRDVVREVKRLLEEIVRRDRELAERVIRRLKRDGDDKDIITEIERTNDETEERVRDIERRIKESSDRNDKRAKEISERIKRLLEEVDKKVKE

SEQ ID NO: 17246 - protein, 178 aa, Artificial Sequence; identical to SEQ ID NO: 17245
  Synthetic sequence.

SEQ ID NO: 17247 - protein, 184 aa, Artificial Sequence
  Synthetic sequence.
DLEELVKEVERRVRRNKTETDRLVEEVERSVRENRRRIEELVRRVEKEVRRIKEDLKRKLSDEDKVRRILEELDRVLREARERLKRVEDKNREVLERVRELAKESVRRTEDALRRAKELIDNIRDKDVLEKVAREIKRLIEESNRLDKEVEDEVREMSKDVNRELERIAEEIEKVLRDVERKLR

SEQ ID NO: 17248 - protein, 184 aa, Artificial Sequence; identical to SEQ ID NO: 17247
  Synthetic sequence.

SEQ ID NO: 17249 - protein, 173 aa, Artificial Sequence
  Synthetic sequence.
SLEELLKEVKKLVEDVHRKNKKNVEDVRRLVERLRKENEENVEEVRREVKKVKEEIGDKDVLDKLEKALKEVERLNEESTRRLEKVLREIEELNRKSSEDLKRVVDEVRKLINNNAPLEEVRRRVEELVTDVDRSSKENHRRIRKVVREVERTTEENHRRIRDIVRRVREEAK

SEQ ID NO: 17250 - protein, 173 aa, Artificial Sequence; identical to SEQ ID NO: 17249
  Synthetic sequence.

SEQ ID NO: 17251 - protein, 176 aa, Artificial Sequence
  Synthetic sequence.
SEIEKAVRELEELVKDNERKSKKSVEDSERIVKEIRDRVRRVVERVRKVVEDIARAGVPEEVIKEIKRIVEEAEKLLRDVIRRIETVVDENRRLLERSNRKIRKVVREAKELLDRLRDDELRKVVERARDLIRKIREESKRSHDRITKLAEDIKRELEKIERRLEKLAEELERKAR

SEQ ID NO: 17252 - protein, 176 aa, Artificial Sequence; identical to SEQ ID NO: 17251
  Synthetic sequence.

SEQ ID NO: 17253 - protein, 176 aa, Artificial Sequence
  Synthetic sequence.
SEVDELRKEVEEMVKRNKDETDKSVKESKEIVDEIRKRIKEVVDEVRRFVEDIRREGVDEKVIREIDKVVEEAKKKLDDVLEDIKRVVDENRKRLDDSNKEIRDVVKKADDLLKKLRSRALEDVARRLRELLKRINDKTRESHKEIKRLADEIRKKLEDIVRELEKLLREIKERAR

SEQ ID NO: 17254 - protein, 176 aa, Artificial Sequence; identical to SEQ ID NO: 17253
  Synthetic sequence.

SEQ ID NO: 17255 - protein, 176 aa, Artificial Sequence
  Synthetic sequence.
SEVDEVRERLERVVRRIEREVEKSERDSERIVEKNKRDTDRVDREIEKVVKKIRDRGVDERVVREVERVVEELRELLERSNEELRRVVKENKDLLREVIERVRKVVREIDDLLRKLRSRALEEIEKRARELLKRITELLRESHERIKRLAEEINKKTEKVVRDIRKLLKEIEDKVT

SEQ ID NO: 17256 - protein, 176 aa, Artificial Sequence; identical to SEQ ID NO: 17255
  Synthetic sequence.

SEQ ID NO: 17257 - protein, 176 aa, Artificial Sequence
  Synthetic sequence.
SEIERLREELERVVRAIERTVTESVRESKEMVDRNKRATEKSVRDSEDMVREIEERGVPKEVIEKIRRVVKENKELLEESNRKLEDVVRKNEELLREVERAVRDVVRRIEKLLRDLRSRELERVAKEARDLLREIKKLLDESTETIRRLVKEINDETERSHRKITELAKRLKEEAK

SEQ ID NO: 17258 - protein, 176 aa, Artificial Sequence; identical to SEQ ID NO: 17257
  Synthetic sequence.

SEQ ID NO: 17259 - protein, 176 aa, Artificial Sequence
  Synthetic sequence.
DEVRELVEEVERVVKRNKDESKKSEEESREIVREIEKRVEDLVRTVEEVVKEIERKGVPEEVIKKIREIVKRVKKLLDDVRRKIEKVVRENKELLERSNREIERVVDRARELLKKLRSRELEKVADTLRKLLKEINEKLERSVRRIRELAKEIKDELRRIEEELRKLAKELDDEAK

SEQ ID NO: 17260 - protein, 176 aa, Artificial Sequence; identical to SEQ ID NO: 17259
  Synthetic sequence.

SEQ ID NO: 17261 - protein, 174 aa, Artificial Sequence
  Synthetic sequence.
DRTREVMERIERLLEDSRRKTDKVRREIRKLLEDVHDKTRRVAKEIRDLLDEIRRLLESGVDSKEVERRVREVFDRLRRLVEESERLLEEILRRLEDMARRSKETSERIVRELEREGIEEEVVKKARKKVRENAEEAEEVRRRIRRSVEENRKELRRLEKELKDVLDEIRERVR

SEQ ID NO: 17262 - protein, 174 aa, Artificial Sequence; identical to SEQ ID NO: 17261
  Synthetic sequence.

SEQ ID NO: 17263 - protein, 174 aa, Artificial Sequence
  Synthetic sequence.
RELEEVRKDIERLLKEVEDTNRRAKERVKRLLEEVHDDTRRAVERIRKLLDEIRKLLEGGVDDRDVRKLLEDVLRELERLVRRSVEELERVLKELEDLNRTSIRLLEKIVDDLRRAGIDEEVVKEIEKMLEKIARHARKSDKEAKESVEDNRRRLEKVRKEVEDMLDEIRERAR

SEQ ID NO: 17264 - protein, 174 aa, Artificial Sequence; identical to SEQ ID NO: 17263
  Synthetic sequence.

SEQ ID NO: 17265 - protein, 174 aa, Artificial Sequence
  Synthetic sequence.
DREKEVADRIRKLLEEIREESERVAKEIRELIKEVHKRTKEVAEEIRRLLKEVEELLRNGVDSEEVRRLLKEIVDRLRELVKESEKELDRILDRLKKLVEKSKRESEKVVKELRDAGIDEEVVKEIERRLRENERKLRELEKEIKKLVEDNRTRLRELEDEIRRVLKKITDEVT

SEQ ID NO: 17266 - protein, 174 aa, Artificial Sequence; identical to SEQ ID NO: 17265
  Synthetic sequence.

SEQ ID NO: 17267 - protein, 180 aa, Artificial Sequence
  Synthetic sequence.
SELEKAVEDSRRLDRRVEETLRDVTRRVRETNKEVEDMLEEVRERAERLLREIEEKLTDEAVERVLKKIIDDIERLLREIKKLLEDSNRELRRVVKEIRKLLEESLKRSRDAVEEVRRKGLEDELRKVIDENRKSVETIEEELRRVEKEDEDTLREIEEKLRKAIEELEKKLKEILDRLR

SEQ ID NO: 17268 - protein, 180 aa, Artificial Sequence; identical to SEQ ID NO: 17267
  Synthetic sequence.

SEQ ID NO: 17269 - protein, 173 aa, Artificial Sequence
  Synthetic sequence.
REREELVERVRELLKEVEDRDREMVERSERLNERIRERDKEVEDRSRKLDEDIERLLRAGARDDEVRRLLEESLRTTEKAVEDTERLLRESLERSKEVVKETKRLLDEIAEEIKRIGGEEVLKEVKDAVDTLKKHSEDVIRKDEESVRDLRRHSEDVLRKNKEMVDDIKAKAE

SEQ ID NO: 17270 - protein, 173 aa, Artificial Sequence; identical to SEQ ID NO: 17269
  Synthetic sequence.

SEQ ID NO: 17271 - protein, 181 aa, Artificial Sequence
  Synthetic sequence.
DEEDKLREVLKDVERRVREMLRENNELIREVAETSERLLRENNELIERVRKEVTRLLKELEKVSDKRLVKEVVDRVRKLVDELKKHADKLVEESTRLVEELKKHADDLVRRVRELVERVERKIKDIREIVETIRKILREIEEHAERNKTRLEEENKKVREHVERNKKDLEETLKEVEDRAR

SEQ ID NO: 17272 - protein, 181 aa, Artificial Sequence; identical to SEQ ID NO: 17271
  Synthetic sequence.

SEQ ID NO: 17273 - protein, 181 aa, Artificial Sequence
  Synthetic sequence.
SKEDKLREELKEVEKTVRELLKRNNELIERVREEVERRLEENNRLIKEVKDRIDDLLRKLKDDSDERSVRRVRETVTRLVEELKRHADRLVEEVRRLVEELKKHADEVLERVKRLVDDVTRKAKDIREIVKTIKEILDEIRRHLERNKDRLEKELTRVRETAEKNKRDLEKVLEDVDRKAK

SEQ ID NO: 17274 - protein, 181 aa, Artificial Sequence; identical to SEQ ID NO: 17273
  Synthetic sequence.

SEQ ID NO: 17275 - protein, 182 aa, Artificial Sequence
  Synthetic sequence.
DEAEKLEREVRKELEENREELERSTEESERLLKHNEDELRKSEEESKKLLREVEKELRRVPKEKLDKVERDARDILRKNKEMVDRVRKTVEDILRDNRRVVDESRRLSKEIERRVREVSESSDKRVLDEVVKEIRRLIEEVKRTTKEMNKKIRKLFEESNRKLEEAHRDIRRKAERVKRELK

SEQ ID NO: 17276 - protein, 182 aa, Artificial Sequence; identical to SEQ ID NO: 17275
  Synthetic sequence.

SEQ ID NO: 17277 - protein, 182 aa, Artificial Sequence
  Synthetic sequence.
KELDEIREEVDRVLRENERRLRTVKKEARDVLEHNRKRLEELRRKIEEVLKEIEEELKRVPEKKADEVRKRIRDILEDLRRVLREVAETAKRILDELDKVVRESEKLSRKIKDDVTKILKSKDEEVLRRVLERIRRLIERVKERTKRMTDDMRRLIEESNDKLRRAEERIRKLLEEVKRTLK

SEQ ID NO: 17278 - protein, 182 aa, Artificial Sequence; identical to SEQ ID NO: 17277
  Synthetic sequence.

SEQ ID NO: 17279 - protein, 182 aa, Artificial Sequence
  Synthetic sequence.
KKVEDIKREAEKVIKESEESIRRNERELDEVIKESERSIRRNERELERVLKELRDSVARLRGEELERAKRVVDELEEFVKESKELLKRSLDELDKAVKDSKRLLEESLKRLEKVVREIEEKLRERPDDRIREELKKVADEIRETNKRIHEESKRVVDEVRRTNEEIHKRSAKVVKDIKDKIK

SEQ ID NO: 17280 - protein, 182 aa, Artificial Sequence; identical to SEQ ID NO: 17279
  Synthetic sequence.

SEQ ID NO: 17281 - protein, 182 aa, Artificial Sequence
  Synthetic sequence.
EEVERITEDAKRVIDESRKTIKRNEDDLRRVIEESRETVERNRKRLEEVLRELEERVRRLRGEELERARRVVEELRKMVETSVRLLRRSLEELKKLVKESVELLKRSLDELRKLVEEVRERLRERPDKRIEEELKRVAEEVKKINEDIHRRSKEEVDRVREINEKIHRDSERVAEEVRRRIK

SEQ ID NO: 17282 - protein, 182 aa, Artificial Sequence; identical to SEQ ID NO: 17281
  Synthetic sequence.

SEQ ID NO: 17283 - protein, 177 aa, Artificial Sequence
  Synthetic sequence.
EELERLKEEVEEIVRRLKRELERIEEEIAKMVRDSEKSLEEDEREVRKVVEELRRRGNGGEIEKLVEELRRLSREAVRRSEKLLEEIRRLVEKVVREVERVVDELRRRVEEVVRKIETEEILRRVKEEVEKVARDIKAIIEKVAREVKEVLDRIREVNKRAHEETRKVADEIEKRAK

SEQ ID NO: 17284 - protein, 177 aa, Artificial Sequence; identical to SEQ ID NO: 17283
  Synthetic sequence.

SEQ ID NO: 17285 - protein, 179 aa, Artificial Sequence
  Synthetic sequence.
DEVERIAKELTDVLDRIRKAVETDKEEIKRVLKEIEEAVRTNEEKLKDALRKIREGPVDEKIVRTAERLAEELVRNSRKILTDISDLARKLAENSERILRKIEKLIRDLVKELEDLRKESERALERVEEKARELVRRVDELLRRSHERTKELAERVRRLLKKSDEETERLARDVERKIK

SEQ ID NO: 17286 - protein, 179 aa, Artificial Sequence; identical to SEQ ID NO: 17285
  Synthetic sequence.

SEQ ID NO: 17287 - protein, 179 aa, Artificial Sequence
  Synthetic sequence.
SEVERITERLKEVLKEIKELVETNSEKLKRVLEEIKKAVEDNTRTIKKVLEEITRAPVDKDIVKDIREELERLVEESRRILEEVERLIRELMKNTERILEEAERLAERLVRKLEALRDGSEEMLKRVEDEARRLTERVRKLIEDSDRETEKLVRRVRELVKRSHEKVKELVDRVRKRIE

SEQ ID NO: 17288 - protein, 179 aa, Artificial Sequence; identical to SEQ ID NO: 17287
  Synthetic sequence.

SEQ ID NO: 17289 - protein, 179 aa, Artificial Sequence
  Synthetic sequence.
SEVERIAEEVKRVLEKIRRDVEENRKRIEEALKRIEKELRDNERRLREVLDEIRKRPVDEEIVKEVKKRAEDLVRNSERIVREVERLARELLKKTEDILRKIKRLAERVLKKLEELRDSSEDALRAVEEEIRKLEDEVRRLIETSHKEVEDLAKEVTDLLRESNERTEDLRREVDAKRR

SEQ ID NO: 17290 - protein, 179 aa, Artificial Sequence; identical to SEQ ID NO: 17289
  Synthetic sequence.

SEQ ID NO: 17291 - protein, 184 aa, Artificial Sequence
  Synthetic sequence.
SDEERLLRTITRVLEENKKSVDDDLKKNEDVLDENRRRVERWEEALRELLKRVEDKVKDLKKDGRDEELKRVIELVRRALDRVRDELKKSLDESKELVDESRRTLDESRRLVEEVLREVKELLREGVDTDEIRRVLEKVKEELDRTDEKSRDLSRKVRDRIRESNREIEKLLEEVRERLERETK

SEQ ID NO: 17292 - protein, 184 aa, Artificial Sequence; identical to SEQ ID NO: 17291
  Synthetic sequence.

SEQ ID NO: 17293 - protein, 184 aa, Artificial Sequence
  Synthetic sequence.
READELRTRAEKALRDNRESVERLKRELDRVLKENERTVRELKERVKEVLKDVDKKVKDLKKEGRDEDLRRLKDRVRRVLRRVEELLERSRRESERMVREVRRLLEESKRLVEEVLREVEELLRRGKPREEIRKVLEDVRREVEETDDRIRKVLERARRESEKVDRELKKELERVRKELEEETK

SEQ ID NO: 17294 - protein, 184 aa, Artificial Sequence; identical to SEQ ID NO: 17293
  Synthetic sequence.

SEQ ID NO: 17295 - protein, 175 aa, Artificial Sequence
  Synthetic sequence.
DRERRVLEELRKLSEDSKRLLERIRERMRRLAEETKRRARDILREVEELSRRVKELLDGGKDAREVLEDNKRVVDEVREKLKRLLEENKRIVDEVEKLLREVIRDNERVVEKVARDVREIEEVKDDVRRSSEEVKEEVERLIREAKKSTDEVRELLKELEKRLRESIEESKRKAE

SEQ ID NO: 17296 - protein, 175 aa, Artificial Sequence; identical to SEQ ID NO: 17295
  Synthetic sequence.

SEQ ID NO: 17297 - protein, 178 aa, Artificial Sequence
  Synthetic sequence.
EEVKRMEDRLEEVAKRADEESKKVMDELEKIVRDVLRESKRLTEELRRIADRVRKELRTDEVVRRVVKELDDVSKRNEEVVTKVLEELDRIVEKVEEINRRVLDELRRIVDEIRRRVTDKKELDRIEKRVREIKKRSEDSVRTIRERVRDAKRKLERSVEEDKREVKEIKERLEREAR

SEQ ID NO: 17298 - protein, 178 aa, Artificial Sequence; identical to SEQ ID NO: 17297
  Synthetic sequence.

SEQ ID NO: 17299 - protein, 178 aa, Artificial Sequence
  Synthetic sequence.
SEVDDLKRKLDEVVRRAKEESKEISERLEEIVRDAERLLKELHEEDERIVDRARKEIRTREMVEEFVRRSEDVARKTTEIVKKVVEELRRVSETNERVVERVLRELDEIVRKIEEDVTDRDKLEKIRDAVRKVKEELERSLEKDRKRVTEIEEKLKKLVEENRRTSKRVKEELEEKVR

SEQ ID NO: 17300 - protein, 178 aa, Artificial Sequence; identical to SEQ ID NO: 17299
  Synthetic sequence.

SEQ ID NO: 17301 - protein, 179 aa, Artificial Sequence
  Synthetic sequence.
RELEEIKKRVEDIMRRIEDLLRENEKKIDKVRKDIRKSLEENKRKVEEVRKDLKRLLDEREDDRLRELIKDAERLLKEVLDHSRKSVRDVEDLLEKLLRHSKELVERAKKALTDVLRKVEERPEEEVKKEIERLAKKLEEELERSNRESDRLVREARKHNEESDRRSEELARRVRERLR

SEQ ID NO: 17302 - protein, 179 aa, Artificial Sequence; identical to SEQ ID NO: 17301
  Synthetic sequence.

SEQ ID NO: 17303 - protein, 179 aa, Artificial Sequence
  Synthetic sequence.
KREEDVKRDLKRVADESRKSDEDIKRRLDRLVKEIRELHKKTTDELKKVADEVRDRLRKVKDDKDVLRKILDDLRKMLEEVKRTDDRIVERLEKLVREVERLAEESLKRSKDKLREVIKRVKDIDELREDVKRVEDENRTSLREIKRAIEKVLDESRKLVEENRRRAEKIIKEVEDTLR

SEQ ID NO: 17304 - protein, 179 aa, Artificial Sequence; identical to SEQ ID NO: 17303
  Synthetic sequence.

SEQ ID NO: 17305 - protein, 179 aa, Artificial Sequence
  Synthetic sequence.
REEEEVTEELKRLADKSRKSDEDIERTDRRVTEEIERLHEETTRELEKVRRDVDRELKKVKDDKRVLEDILRKLDELLKRIKKKDEDILKELRELLEKSIRDLERSLEESRRALEDVVRKVKDIDELKKEVRKILEENKRSLERIRRHSTRVEEKSRKLIKENDDRLKKVIEDVRRKLK

SEQ ID NO: 17306 - protein, 179 aa, Artificial Sequence; identical to SEQ ID NO: 17305
  Synthetic sequence.

SEQ ID NO: 17307 - protein, 179 aa, Artificial Sequence
  Synthetic sequence.
SEKDKVTKELEDVARESRESDKEIKRELDEVVEESERLLREIRRRLEKVAEEVRRALEKVKDDKRVLKEILDRLREVVEEVKRLAEEVVKRNREVTRRIKELVRKSLEDSERVAREVIKKVREIEELKRRVEEIIRENEESVRRIAKRADDSNREIERLVDEIRRRAEEAIRRVTEKVR

SEQ ID NO: 17308 - protein, 179 aa, Artificial Sequence; identical to SEQ ID NO: 17307
  Synthetic sequence.

SEQ ID NO: 17309 - protein, 179 aa, Artificial Sequence
  Synthetic sequence.
KEEDDVRRKLEKVVREIDKLHKESTERDRKVREDSEETDRRIKEELKKVVKEVRDRLREVKDDKEKLRKILDDLRKMITDAKRLAEDSLRRSRELLKRSVETDERITDRLRKLLKEVIDEVDKIEELKDEVRKATEKSEDLVRRNEEHSRRVIEENERTLKDIADEAERVIKEVEDRLR

SEQ ID NO: 17310 - protein, 179 aa, Artificial Sequence; identical to SEQ ID NO: 17309
  Synthetic sequence.

SEQ ID NO: 17311 - protein, 179 aa, Artificial Sequence
  Synthetic sequence.
REDEEVTKELEEVIREIEELHERSTRKLKEVVDRSRELLDRVRRRLKEVVDRIRELLERVKDDKDVLREILEELRRVVKEVKDLLREILERNTRVTEDVVRTDEEITKRLRDMAREVIKKVREIEELRKRVEEAIRKSEELVKENTERAKKSNEELERRVRELEERAKRAIEEVKEKIR

SEQ ID NO: 17312 - protein, 179 aa, Artificial Sequence; identical to SEQ ID NO: 17311
  Synthetic sequence.

SEQ ID NO: 17313 - protein, 179 aa, Artificial Sequence
  Synthetic sequence.
SREEDVDRKLDEVIERSRRIDEEILRRDKEVVDEIRKLHKESTDRLKEVVDRVDKELKEVKDDKEKLREILKELREMVRRVEKTDDDISKELEDLLRESVRLAEESLKESEELIRKVIEEVKDIEELKKKVTEAIEENRESVEEIRRHSEEVKKESEKRVKENRDRARRAEERVEEMLR

SEQ ID NO: 17314 - protein, 179 aa, Artificial Sequence; identical to SEQ ID NO: 17313
  Synthetic sequence.

SEQ ID NO: 17315 - protein, 178 aa, Artificial Sequence
  Synthetic sequence.
DREREVKKRLDEVRERIERLLRRVEEESRRVAEEIRRLIEEVRRRNKKVTEEIRELLKRLKDKEEVRRVLERLRKLNKESDELLERILERLRRLVEKTNRLVKKIIEELRRLVEKIVREVPDVKELREELKKLERKIEKVAKEIHDHDKEVTERLEDLLRRITEHARKSDREIEETAR

SEQ ID NO: 17316 - protein, 178 aa, Artificial Sequence; identical to SEQ ID NO: 17315
  Synthetic sequence.

SEQ ID NO: 17317 - protein, 178 aa, Artificial Sequence
  Synthetic sequence.
DEEEKITRDLEKVEDEIRRLLEEVRRLSKKVKEEITKLLEDVNRESEKAVRKVRETLKRLETKEEVERVLRELEKLMRESDKLLKDIVERLRRLLEETNRLLKEIVDRLRKLLKELVERLDKVERLRKRVTDVIRKLEEVLKDIHRHDKEAIEEAERRLEDNHRRNRRVLEELKRRAD

SEQ ID NO: 17318 - protein, 178 aa, Artificial Sequence; identical to SEQ ID NO: 17317
  Synthetic sequence.

SEQ ID NO: 17319 - protein, 179 aa, Artificial Sequence
  Synthetic sequence.
SEEETVEELVRRAEEKSRRILEDSKKKVRDIERENDEILKRSRDRVKKAEDDLRRVVEKRDEEEVRKILEDLKRLLEKVIKTDEDIVKTSRDLLREVIKKDEEIVEKLKRLLRDMLEKAKDRGDERILRELERVVEEIDREHERTKEELKKVADESRKAHRESERDLERVIREVRERLR

SEQ ID NO: 17320 - protein, 179 aa, Artificial Sequence; identical to SEQ ID NO: 17319
  Synthetic sequence.

SEQ ID NO: 17321 - protein, 179 aa, Artificial Sequence
  Synthetic sequence.
SEVERVRKTVEEIKEKNERILKTSKDEVRRILEESERMLEESKKRVDEVREEAADVVRKRDEERVRRILRELEDLLRRVIEEDKRIVERLRRLLKRVIDTDRRILEESRKVLEDVIREAEERPDDRILEKLEEAAKRSDELHKRSRDDLRRVAEEIKKLHEETRRKLKKVVDEIRKKLK

SEQ ID NO: 17322 - protein, 179 aa, Artificial Sequence; identical to SEQ ID NO: 17321
  Synthetic sequence.

SEQ ID NO: 17323 - protein, 188 aa, Artificial Sequence
  Synthetic sequence.
STLEEVRERVDRVKKKLKKLLEEVTEINERSKKEIDEILKESEDRVRKVKEDLKRVVKEDKDGDRVRKIIEEAKKKLDEVLENSERIAREVKKDNDDSNREVKRVIEDIERKLDEIVKKIEDLERKGMDEEVLERVLRELEELTRRVEKEIRDLLKRIEDSSRRVRELATESRKKLEDLVREIKERLT

SEQ ID NO: 17324 - protein, 188 aa, Artificial Sequence; identical to SEQ ID NO: 17323
  Synthetic sequence.

SEQ ID NO: 17325 - protein, 183 aa, Artificial Sequence
  Synthetic sequence.
SSEEKVREEVERVREEITRLLRENEDTVRRVDEKAEKALRENKERVDRLREEVRKLLEKDKDKRLEEVLKRVEELLKRSIDKSREVLDRLRKMLEKSLKLSKDILKELEKLLRDIERRVRALTEDDFVRKVTEELKKVTDRIRKLLEESRKHTERVRREAEKLLKEIKDETKKVEEEVRRRAK

SEQ ID NO: 17326 - protein, 183 aa, Artificial Sequence; identical to SEQ ID NO: 17325
  Synthetic sequence.

SEQ ID NO: 17327 - protein, 181 aa, Artificial Sequence
  Synthetic sequence.
SSREKIKDDLRKAVEENRRLLREVRELLREMLERDERILREIERRLDEARKRLEEVARNNVPEKVVKRLVERVVEEVKRLLETSKKTVKEVVEEIKRLLEEIEKSSRDVVEEIRRLLEETGEGRAVEELKKELRRLEEESRRAVEDLKRLLDELKERTDRVVKKLDETLRKLKEDVDRKAK

SEQ ID NO: 17328 - protein, 181 aa, Artificial Sequence; identical to SEQ ID NO: 17327
  Synthetic sequence.

SEQ ID NO: 17329 - protein, 182 aa, Artificial Sequence
  Synthetic sequence.
REIDELRKELDEIRKRIEKVIEELKRHLDEVDKRAEDLAKELDDLTKTIERDAERRIREDKKSKEVVERVKRLLDKSNTDSDRVVKTVKRLLDENNKTSDKVVKDVKKLLDEVLKKVRDGPVDDKVIREVEERVKRIKEDVDRVLEDNSREVERVKRKVDKMLKRNKDEADRIRKKMDDDLR

SEQ ID NO: 17330 - protein, 182 aa, Artificial Sequence; identical to SEQ ID NO: 17329
  Synthetic sequence.

SEQ ID NO: 17331 - protein, 182 aa, Artificial Sequence
  Synthetic sequence.
SVIERLKEELKKIEEDARDMAKKLNKETEDILRRARKLARELEKHLEDVKRKIDELIKEDKKSEEVVKEVKKELDRNNEESKRVVEEVRRRLDESNKKSREVAEDVKRLLDEILEKVRRGPVDKKMIEEVERDVRRIKKEVDRLLEENTERIEEIKKEVDELLKRNTDEVEKVKKKVDEDRK

SEQ ID NO: 17332 - protein, 182 aa, Artificial Sequence; identical to SEQ ID NO: 17331
  Synthetic sequence.

SEQ ID NO: 17333 - protein, 179 aa, Artificial Sequence
  Synthetic sequence.
KIEEDLERSLKKSEDELKELRDRLRKSNKEVTDDAERIKKEVEDSNREVEKRVRDLERRGVDKDELRRVLEELSKIVEEIKELIERLLEELTKIVEDLERELKELLKESRRIVEELRRLRSEEARKVLEENEEVVRRIVKKVEDILDDHRRVVKEVRDRIERLLKEHKKIVEDADKDLT

SEQ ID NO: 17334 - protein, 179 aa, Artificial Sequence; identical to SEQ ID NO: 17333
  Synthetic sequence.

SEQ ID NO: 17335 - protein, 173 aa, Artificial Sequence
  Synthetic sequence.
REEEEVAKKLERAAEESRRLHEESKRDHERATDEIRRKAEATLRELKRVIDEIERLADERDKEDVRRRAEELLRRVKKASEDIVKELRDLVERSLRRDKEIVDRSKKVLDEVIREVDVEEIRRRVETLERENRKAEEESRDKVRKSERRLEELNKRHEDLVRELEERLERKRK

SEQ ID NO: 17336 - protein, 173 aa, Artificial Sequence; identical to SEQ ID NO: 17335
  Synthetic sequence.

SEQ ID NO: 17337 - protein, 173 aa, Artificial Sequence
  Synthetic sequence.
DEEEKVLRELEEVIRTSRRLHKRSLEELDRVLEESKALHRESKRALEDVTREITKLADDRDKKDVVRRLKELLERILRTDEKIVRDSEEALKRIEEEDKKIVRRSEEVLKRVIDKVDVERIRKLVDDLRKENEKALRESKKRVEEIRRRNEEAIKDSKKDVEDLERDLERKRK

SEQ ID NO: 17338 - protein, 173 aa, Artificial Sequence; identical to SEQ ID NO: 17337
  Synthetic sequence.

SEQ ID NO: 17339 - protein, 173 aa, Artificial Sequence
  Synthetic sequence.
SDEERVLEELKKVIKESRDLHKESLDDLRRVIEKSRRLHEESLERLRRAIEEIERLMDERDKKDVVREAEKILREVRKEDEDIVRDSERVLERVKRTDREIVKRSKEVLKRAIDKVDVEEIRDLVRTLEEDNKRMEERSRRTVRKLEKENDDARKESERLVEELERRLEEKRR

SEQ ID NO: 17340 - protein, 173 aa, Artificial Sequence; identical to SEQ ID NO: 17339
  Synthetic sequence.

SEQ ID NO: 17341 - protein, 183 aa, Artificial Sequence
  Synthetic sequence.
RDVEEVKKRSDTTLKRIEELIRRVNERSKKSIKEIRDRAKEVEDEVRELARKIEEDARRRKESKELLEELLRRIKKLVDEIVDEIRRLLEKNKRIVEDSKRILEELVEENSRRVEEIKKRNKELDEVVRELEKINDKSRKRVEDAVRSNEKLLEDSERDIRRVIERLKKLLEDLKRKLEEIER

SEQ ID NO: 17342 - protein, 183 aa, Artificial Sequence; identical to SEQ ID NO: 17341
  Synthetic sequence.

SEQ ID NO: 17343 - protein, 183 aa, Artificial Sequence
  Synthetic sequence.
SDAERVMEESRRTIEKIKKDAKEMNERSRKTVDEIRERLERLLRELERIAEEIRRELEKRREVKDEVRRLLEEVEKLAREIEETVRRLVEKNTDLVRRSLERLDELVKTNHDLVEKIKDRNKELEEFVRELKKLNDKSRKDVEDLKRSNEEINEDSKRKVEEIIRRLEELLKEIRRELEDVER

SEQ ID NO: 17344 - protein, 183 aa, Artificial Sequence; identical to SEQ ID NO: 17343
  Synthetic sequence.

SEQ ID NO: 17345 - protein, 184 aa, Artificial Sequence
  Synthetic sequence.
SVEEDLKRLVDEIRRRVEKVKRDLERIVDENRKRVEESKEESKKSVEEIERRVREAAKRISDERLIKTLRRIVEEVERVNREVLRKDDELLRESEKVVTEVVKRLDEIVERARKVVEEVAKRIRDEKVADEVRKRLRKMIRDLEEVAREVKRELERLHEETERSSRDAKRRSDKMARDLERTEK

SEQ ID NO: 17346 - protein, 184 aa, Artificial Sequence; identical to SEQ ID NO: 17345
  Synthetic sequence.

SEQ ID NO: 17347 - protein, 184 aa, Artificial Sequence
  Synthetic sequence.
SSEEKLRELVKRIKRRVEEIIRRLEESVERDRDEVRRSKERLEALVEEIRRRVDDIEKRIDDERLIRTLREIVRRAEEVVRRAVEEDRKISDENEDVVRKVVKRLEKILREIEKVVKEVADRLRSEKAVREVEEELRDMERKLEKVAEEVTRRSKEVTEKLRESSDRVEKELRRIIEELERVAK

SEQ ID NO: 17348 - protein, 184 aa, Artificial Sequence; identical to SEQ ID NO: 17347
  Synthetic sequence.

SEQ ID NO: 17349 - protein, 184 aa, Artificial Sequence
  Synthetic sequence.
SVREDLKRLVKEIEDEVRKSKKDLDDSVREDKREVRESKEDSKRSVKRSEEEVRKIKKRTDDDELVKRLEDILRENKRVNDEAMKRDDKVSKENEDVVRKVVREDEDVLRTARRVVKEVSERIRDEEVAKRVRELLEEIMRRLRKTSEEARRRSKKITDDLRESSKKVREDSERLRKRLEEEAK

SEQ ID NO: 17350 - protein, 184 aa, Artificial Sequence; identical to SEQ ID NO: 17349
  Synthetic sequence.

SEQ ID NO: 17351 - protein, 187 aa, Artificial Sequence
  Synthetic sequence.
DAERKITRLLEEIRRESKRSSEEIKKSLKENEDEVRRVVEEIRKRLREIEKEVKEVLDRLRDQREVVDLLRRVLERVREIVRRIEDELRRVLEKSERSVEEIHRRNEEVVKKVEDVVREVRKLAKENSEKLVEEVLREVKRIIEENRTLSERVKEHNEKSHRESEELAKRVKELLKEIERDIRRLEK

SEQ ID NO: 17352 - protein, 187 aa, Artificial Sequence; identical to SEQ ID NO: 17351
  Synthetic sequence.

SEQ ID NO: 17353 - protein, 181 aa, Artificial Sequence
  Synthetic sequence.
SDAERVLKESKESLEELERRVTEALKRSRDSLRRLKEVADEARRRLEEVLERIARKKDSREELRELLERLRELVEKVVRDVREMLKRDEDLNRRVVEEVREILDRDRKLVKRVMDELDKDKNSEVKERLKRSLEETEKRVREVEERLKKTVEDTRKVVEDIERELERLLREVEEVVRRIEK

SEQ ID NO: 17354 - protein, 181 aa, Artificial Sequence; identical to SEQ ID NO: 17353
  Synthetic sequence.

SEQ ID NO: 17355 - protein, 181 aa, Artificial Sequence
  Synthetic sequence.
EEAERMLRESEASLRRIEKIVREALEASRRTVEELKKVVERVLREVRKLIEEIEKKKDVREELEKLLREVEERVRRVEEEVKEVLDRDRELVDRVLRRVRELLERDEKLNRDVVRRVDKDNMDEVRERLKKTVEDSKRVVEKAEEDLRRSLEDTERLVREASRRLRDLLRELRRIVEEIKR

SEQ ID NO: 17356 - protein, 181 aa, Artificial Sequence; identical to SEQ ID NO: 17355
  Synthetic sequence.

SEQ ID NO: 17357 - protein, 181 aa, Artificial Sequence
  Synthetic sequence.
SEDEKALRESKKTTDEIRKRVTEMEKRSREVVKEIRDIIERVLREVRRVLEEIRKKKDSREELDKLLRELEKLVKDVVKEVTELVDRDRELNKEVVKELRRLLEEDERLVEEVVRRIEKDKNSEAKKRLKDSLDRTRKTVEEMTRRLEKTVKETEDLLREARERLEELLRELERVADEKRR

SEQ ID NO: 17358 - protein, 181 aa, Artificial Sequence; identical to SEQ ID NO: 17357
  Synthetic sequence.

SEQ ID NO: 17359 - protein, 181 aa, Artificial Sequence
  Synthetic sequence.
SEDEKVLRDSRKVLREIEEVVKEVLKRSKKLVEELEDIARRVLKESEDSNKEARDKKDLREELRRLLEEDERLVERVTREVREVLDRDRRLNKEAVERVERLLEEDEKLNRDALRKLSKDNNDEVERRLRKTVRDTKEVVDRAREKLERTVRTTEETVKEIEKRLEESLRRSREDVKEREK

SEQ ID NO: 17360 - protein, 181 aa, Artificial Sequence; identical to SEQ ID NO: 17359
  Synthetic sequence.

SEQ ID NO: 17361 - protein, 182 aa, Artificial Sequence
  Synthetic sequence.
RVEDALRKLLDDVRRLVEEAERRLRTSNDKSRRLVEEAKRRLEESNERSEKLVRDVRRRIRDEDVKRVLEELLKRDHDVVRRVLERIDEMLERNSRLVKRVLEDIRRLLKRVREVVERIKRVRSKVVEEVLKELEELIKTAKKIIEDVLRASEDTIRRLEEIIRKVEEDSKRIIEEIERAAR

SEQ ID NO: 17362 - protein, 182 aa, Artificial Sequence; identical to SEQ ID NO: 17361
  Synthetic sequence.

SEQ ID NO: 17363 - protein, 182 aa, Artificial Sequence
  Synthetic sequence.
SAEDKLRKLLDDARRTVKEVEERLKKLNKKLEEDVKRVKRELRESNKKSRELVEKVKREVTDEDVKKKVEDLLKRDHDVVRRVEKELDDMLRRNHKLVRDVLRELRKLLEDVERVVERARRVRSEVVEEVLEELKKLIETVKRRAKEVLDRSEETIREIRKRAEDVLRESERIIEDIERMTR

SEQ ID NO: 17364 - protein, 182 aa, Artificial Sequence; identical to SEQ ID NO: 17363
  Synthetic sequence.

SEQ ID NO: 17365 - protein, 183 aa, Artificial Sequence
  Synthetic sequence.
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDEEVVKKVEKEIRELLERLKEEADRVRERSKKILTDLKKSSEDVKRESERMLKKLEDEIR

SEQ ID NO: 17366 - protein, 183 aa, Artificial Sequence; identical to SEQ ID NO: 17365
  Synthetic sequence.

SEQ ID NO: 17367 - protein, 183 aa, Artificial Sequence
  Synthetic sequence.
SVEERLEDLLREVTETLDTSRRRLEKLDREVDKKVKEVEKRLRETLKESEDTVRDVERRVSEELVKLVRDILERNEEVNREAVKRIRDILDEIKKLVEEVVRRDAEIVKEAERVVERVARDIRSEEVARRVEKELEDILRKLRKSSEEAERRIEEMLRRLDKVVKEMLKRSRDLLRTLEETTK

SEQ ID NO: 17368 - protein, 183 aa, Artificial Sequence; identical to SEQ ID NO: 17367
  Synthetic sequence.

SEQ ID NO: 17369 - protein, 181 aa, Artificial Sequence
  Synthetic sequence.
SIREDVERLAEELDRKSREIATRAKRELDEILRKDKEISDRARKELEEILKKLKEIADRDKDERKIRRVLEEAEDLVRRVVELNKKSLEEARKLVEDVLRLLEESLKESKDLVERAKERITGKEVEKRLDDALKRNAEEVEDVKRKLKDVLREVERTVRESEKDLRRVLEEVERAVREIRR

SEQ ID NO: 17370 - protein, 181 aa, Artificial Sequence; identical to SEQ ID NO: 17369
  Synthetic sequence.

SEQ ID NO: 17371 - protein, 182 aa, Artificial Sequence
  Synthetic sequence.
SEVDEVLKRSRDVLKRIDEIVKKVLTDSKRVLEDLRRIVKEVLDESKKVLEEIRKIKDSREDVTELVKRLHKRNKDVLDRVRKVVERNHRLNKRALEEVARLVKELHDLNKRALDEVRSDERAEEVERAMRKSSDDLRRKLEEVERRLRKSSEESKKVLKDAEREIRRSSDELRKVLEDIRR

SEQ ID NO: 17372 - protein, 182 aa, Artificial Sequence; identical to SEQ ID NO: 17371
  Synthetic sequence.

SEQ ID NO: 17373 - protein, 182 aa, Artificial Sequence
  Synthetic sequence.
SEVEDVLTKSRKVLKEIEEIARKVLEESKRVLEEIRRVVEEMERRSEDVLRELRRIKDKREEVREVVKDLHKKNEDVLRRVKKMIEENHRLNETVLREVRRLVKELHELNKDALRRVKDLERADEVRDEVRKSSEELRRVLEEAEERIRRSSKESKELLKRVKERIEELSRRLEKVLREIEK

SEQ ID NO: 17374 - protein, 182 aa, Artificial Sequence; identical to SEQ ID NO: 17373
  Synthetic sequence.

SEQ ID NO: 17375 - protein, 184 aa, Artificial Sequence
  Synthetic sequence.
DAEDELKKAEDRLRKSDEEAKKSIEDVKRELRRLLEESKKEIEKLIEELRRLLERAKEKPKDETILRRLEEIVRRIEERLRRAVEENAEIVKRIEERADRVVEESEESVRRIVEEIKKAKDRLRTEEVVERVLRKVERLLEENERLVKEVEDELRKLLEDLKRSSKKVRDEVKELAKRLRDEVR

SEQ ID NO: 17376 - protein, 184 aa, Artificial Sequence; identical to SEQ ID NO: 17375
  Synthetic sequence.

SEQ ID NO: 17377 - protein, 184 aa, Artificial Sequence
  Synthetic sequence.
SAEERIEEVKERLRRSDEEAKRKIDRLVEELRRLLEESKKEAEKVKKELRKLLEEVKRKPKDEKILKKIEEIVREIERTVEDMLRRNAEIVKRIEDRARRVVEESNDSVRRIEKRVDEALREVRTEEVVKRVEDELRRLLEENKKLVDDILDEVRRLLEELEKSSRKVKEDLDRLLEELRREDK

SEQ ID NO: 17378 - protein, 184 aa, Artificial Sequence; identical to SEQ ID NO: 17377
  Synthetic sequence.

SEQ ID NO: 17379 - protein, 179 aa, Artificial Sequence
  Synthetic sequence.
SAAEEVKKRITDLLRKDEEVVKRASEAVERLLEDDKRVVEDVRREIEEILRTLEKVTREGKDKKAIRTIVRDLERVIRRVLEASARTVKRIEDLIEKLLRESRETVDELRRVLEEAAREGSIDKDDVKRAEDEVRKSHKKVEDDLRRLKEEVERSLKDTEDKARRAKEEVERLLRESER

SEQ ID NO: 17380 - protein, 179 aa, Artificial Sequence; identical to SEQ ID NO: 17379
  Synthetic sequence.

SEQ ID NO: 17381 - protein, 179 aa, Artificial Sequence
  Synthetic sequence.
DEDDRVRKEVEKMLRDDDRIVKEIEKRLKDLLDRDRKVVREVRELVEELLRRLEKVIKDGAPEEVIREIVERIRKRLKELLEKSAKTVDEIRKLIEELLKKSKKSVDDLVKRLEDVRREGSISEEDVDRLRREVDKSNKDTKKILDEVRKEVEDSLRKTKKIIDDALRRVDELLKEAER

SEQ ID NO: 17382 - protein, 179 aa, Artificial Sequence; identical to SEQ ID NO: 17381
  Synthetic sequence.

SEQ ID NO: 17383 - protein, 182 aa, Artificial Sequence
  Synthetic sequence.
SVEERVEDIKRSNEESNKRLREEVEKIKEELKEINKRVEDTVREIEKRLEELLRRVRSDKEEKFKDVKKLVEDIVRRLREIVKENHEIVKEVLKELDELVEKSTRTVEESKKRLDEMLRKIRDERVVEEIDKIAKEVNTRNKKVVDEIRKRAEEVKEESKESLKRLRKIAEEVLEELKKRAT

SEQ ID NO: 17384 - protein, 182 aa, Artificial Sequence; identical to SEQ ID NO: 17383
  Synthetic sequence.

SEQ ID NO: 17385 - protein, 175 aa, Artificial Sequence
  Synthetic sequence.
DLAEEVRKDVEDLERTNEKVVRDIRKLLEDLNREHKRVSDEIRKRIEELKEKLKRIKDEDEVRKVVEELERTLERVRKRVKDTVDKSKELLKRLLERSRETVERVKKKLDDVRRDGAIDDDDVRRIKKRAEDSHDRVKKELDRIAKSNEELLRKTEEEVRRLLEELEEILRRTRK

SEQ ID NO: 17386 - protein, 175 aa, Artificial Sequence; identical to SEQ ID NO: 17385
  Synthetic sequence.

SEQ ID NO: 17387 - protein, 179 aa, Artificial Sequence
  Synthetic sequence.
DEVEEALRRVEESNRRVKEEVERAVERVKRSDDDVRRLVEEMEREVRKLIDDIRRLAEAGKSADVVRKLIKEVEDKLKEVLERVRKLVETSKKLLDEILKRVEELVRRSKEELDKVLKDGSADKDEITELKKHSERLLEEAERLVRDLKRHSDELLEEVEERLRRLREDLKRLLDEVET

SEQ ID NO: 17388 - protein, 179 aa, Artificial Sequence; identical to SEQ ID NO: 17387
  Synthetic sequence.

SEQ ID NO: 17389 - protein, 179 aa, Artificial Sequence
  Synthetic sequence.
SAVEKAVRDVERTNEEIRRVVEEVRKEAEKTHRDIRRVVEEARETAERLLREIEELAKKNAPKEAIEELVRRVLDLLRRALEEVREAVERSDRRLEEALERVRELLERSNKLVDDVRREGSISEEAVKRLKDENKKTLDEVREIVKRLAEENKRLLEEVEKTVRDLKRELEKLLREVAK

SEQ ID NO: 17390 - protein, 179 aa, Artificial Sequence; identical to SEQ ID NO: 17389
  Synthetic sequence.

SEQ ID NO: 17391 - protein, 182 aa, Artificial Sequence
  Synthetic sequence.
KEVEDVVKEIEEVLDRLRKEVKKIKEDSDRLNEEIEKVVTDLVKELDRLLREIDDLIRKLKGDSEAVRRAVEELKREVDRVLREVEEMVKETKRLNDESNEKVRRVVEDLRRLIERVLRDATDDRARKTLEDLKRRIEELLRRVDETNERLKRHSDDLLRDVKRRLDEVRERIDRLLDKAER

SEQ ID NO: 17392 - protein, 182 aa, Artificial Sequence; identical to SEQ ID NO: 17391
  Synthetic sequence.

SEQ ID NO: 17393 - protein, 182 aa, Artificial Sequence
  Synthetic sequence.
DEVDEAVKRLREILRRIREIVEKVRKESEDVNDEIRRIVEEVTKRSEDALRELRELIRRNKGREEDVKRVADRIRELDDRSNDTVRRLVEKTRRLNDESNKTVRKLVEELKREVKKVEARVTDERVREELRKVEEDIDRLLKEVTELNERLKRHSEKLLRDVTRENRRSKEAVTRILEEARR

SEQ ID NO: 17394 - protein, 182 aa, Artificial Sequence; identical to SEQ ID NO: 17393
  Synthetic sequence.

SEQ ID NO: 17395 - protein, 182 aa, Artificial Sequence
  Synthetic sequence.
SEVEELLDRLREVNKRIREEVRKVTEESKKAIEEIKRIVDDMVDKVRKILEKLKELIRDNRGDRESVRKVVEELRELIRRVLEEVRKLIERVKKRNDESNDTVRRLVEETERIVDEAEKRVKDDKAREDLRRVKEHSERLLREVTKLNKDVEKELKELLDEVRERLKDLKRRIDKILEEAER

SEQ ID NO: 17396 - protein, 182 aa, Artificial Sequence; identical to SEQ ID NO: 17395
  Synthetic sequence.

SEQ ID NO: 17397 - protein, 181 aa, Artificial Sequence
  Synthetic sequence.
SVRERVKDEMEKVLRDDKEVSKRVTDEARKVLEEHRKITDEVRRRSKELIRELKKVRDEGRPEEKIKEIADRIREVDDRSNRRVRESVKKLEDLLRRVVKESEETVRTLRKLLEDVLREVDREEVRRTVDEVRRRIDKSLEESKKLVEDISREITELLRRTTERNKESKREVDKILEDARK

SEQ ID NO: 17398 - protein, 181 aa, Artificial Sequence; identical to SEQ ID NO: 17397
  Synthetic sequence.

SEQ ID NO: 17399 - protein, 181 aa, Artificial Sequence
  Synthetic sequence.
SIVERAEKELRRLLKEDEEVSDRVRKEVKRLLKEDKEILDDVRRRIEKILREIEEVARRGEDKRAIRKLVEELKRVIDKAVEESRDSVRRIKDLLDKALRESEETVRRIKTLADDLLRKVDREDVRRIIKEIKERVKKSLDESREIIERAKREVDKSLEESKKVAEDAKRRIERLLREVER

SEQ ID NO: 17400 - protein, 181 aa, Artificial Sequence; identical to SEQ ID NO: 17399
  Synthetic sequence.

SEQ ID NO: 17401 - protein, 179 aa, Artificial Sequence
  Synthetic sequence.
SEVEKVVREVEKLIREIERHSKEVNKRSKEDIDRIREKIERAIRRVEELIRKVKEVTERGDRRKEEVLEELDRIVEEVETMAKRVREELKEIVDKSRELMRRSEELLDEILKRAAELARRVGVKEDLDRIRERLERLKKRTKELLERDEREVERVERELEELIRDIRRKIEKLKRDIEK

SEQ ID NO: 17402 - protein, 179 aa, Artificial Sequence; identical to SEQ ID NO: 17401
  Synthetic sequence.

SEQ ID NO: 17403 - protein, 175 aa, Artificial Sequence
  Synthetic sequence.
SDLEDVIKKIEELLRRVEERLRDAVRKIEELLRASDERLREINEESRELLRRVKELKDAGIDKRDVERILRDIVRRSKKLLDEVHRTNEEILRTIERVVEEVKKELDKILKEVEDKVRDRKLVDDIRKEVERIVEEARKLLERIKREVKESSERAERLHEEDRKRVEDALREVKK

SEQ ID NO: 17404 - protein, 175 aa, Artificial Sequence; identical to SEQ ID NO: 17403
  Synthetic sequence.

SEQ ID NO: 17405 - protein, 175 aa, Artificial Sequence
  Synthetic sequence.
KEAEDVLEKAKRLLKRSDEVVEEANDESRRLLDKIRKLVDTVNEESKRLLDRVRELREAGTDKKDVKKILEDIVRRSEEMVERVERLLREVVERSRELVERVHELNKEILERIRREVEDKDAVRDVEREVRRSSKRLKELHEEDKRRVRKILERLKRLHEKDRRDLEKVMKEVED

SEQ ID NO: 17406 - protein, 175 aa, Artificial Sequence; identical to SEQ ID NO: 17405
  Synthetic sequence.

SEQ ID NO: 17407 - protein, 175 aa, Artificial Sequence
  Synthetic sequence.
DDLDEVIKDIERLLKESDDDVERVIREIKKLLDEVRKRVRDANEDSKRLLREVERLAEAGLDRERVEEELRKIVEKSRKAVEEVKRLLDEILKRVTDAVREVHELNKDILRRVRERVRDERLVREIERRVRKSSEDLRRRLEEIRERVEDIERELRKLHEEDKKRVEDILTEVRR

SEQ ID NO: 17408 - protein, 175 aa, Artificial Sequence; identical to SEQ ID NO: 17407
  Synthetic sequence.

SEQ ID NO: 17409 - protein, 174 aa, Artificial Sequence
  Synthetic sequence.
SEKERVVEEVRKKLEEIRRRTEEMIERVERLLDEIRRRNKELVERNKELNKRIAEIVRDRNNKDEVKELIDRSKKSTDDVNEESRDLARKVKELVDRANKESRRLVEEVRKEVEDLIDSELARDIKRKLEKILEDSERLVDEIRKRIEKIKRESDETVRESRESSRRLLEEVKR

SEQ ID NO: 17410 - protein, 174 aa, Artificial Sequence; identical to SEQ ID NO: 17409
  Synthetic sequence.

SEQ ID NO: 17411 - protein, 179 aa, Artificial Sequence
  Synthetic sequence.
SEVERLLEDNRRTIREDEERNKRVVDTWRELTRRLEERIEKVLTDNKKTVEDLVRKRGRDRDVLRIIKELEDLSKKIEDDLREIIKRDRELARELKERSDELLKRLRELSKRIEKVLRDRRRDDDELRKDLERLDEESKRASEKLEEEVRREIKRSKELIEEVERKVEEIDKRADERLN

SEQ ID NO: 17412 - protein, 179 aa, Artificial Sequence; identical to SEQ ID NO: 17411
  Synthetic sequence.

SEQ ID NO: 17413 - protein, 179 aa, Artificial Sequence
  Synthetic sequence.
SEVERVLEKLKRDVEKNERDNRRVLKKLREDVKKDADDNRKVLEDLRRAVEELRREVGRDRDVERILRELEEALRRIEEESKKLIRRLEDLLREIERKSRELLKRLRDLLRRIAEVLRANTNDTKDLVDEARKVLETSKRLSDELKKEVEKMLRESREMSKRLKEEVDRILKEVRDKAR

SEQ ID NO: 17414 - protein, 179 aa, Artificial Sequence; identical to SEQ ID NO: 17413
  Synthetic sequence.

SEQ ID NO: 17415 - protein, 174 aa, Artificial Sequence
  Synthetic sequence.
DELEEVIDRNRKSLKEIEERNKKVIEDLRRAIKEIEDRLKEVLDRVKKRIEDIERRVPGKEILDKVREMVKELEDRVRELVKELRKLVKELEDKVREHSKKVRKLSKELEDELRKEGPVEELRKKIEDVDRKVRKESEDLKRELKKLLDEIRRKVRELEERAKRVEEEVDREAK

SEQ ID NO: 17416 - protein, 174 aa, Artificial Sequence; identical to SEQ ID NO: 17415
  Synthetic sequence.

SEQ ID NO: 17417 - protein, 174 aa, Artificial Sequence
  Synthetic sequence.
SELEEVIRDNERSLKEIEDKNREVTKTVREEIKRIAKKLKEVLDRNRETVRDIERRVKGEEILREVRELSDRLEEDARRILEEVKELLERLEREVEKHSREVRDLSRKLADRLRKEGPVDELRRRIKEVDKEVEEKSEKLKREVKAVLDRVEKLAEEIRKKVEDVDRTVEEKAR

SEQ ID NO: 17418 - protein, 174 aa, Artificial Sequence; identical to SEQ ID NO: 17417
  Synthetic sequence.

SEQ ID NO: 17419 - protein, 174 aa, Artificial Sequence
  Synthetic sequence.
KEMEDLEREVERVLKRLEELVRELLETVRRTLTRLKRKLDEKKKELDKVNEDLDRVTREGRDRREIIKEAEKSLEDLKRDLERIKREIDKINDELRKRVKEIVDRARKILEDLRRNNLEERVVKKLEDAIEEIKRKLEKVHDEHRRTVEKIEEDIRRVEEEHRRTIKEIKEKLK

SEQ ID NO: 17420 - protein, 174 aa, Artificial Sequence; identical to SEQ ID NO: 17419
  Synthetic sequence.

SEQ ID NO: 17421 - protein, 174 aa, Artificial Sequence
  Synthetic sequence.
SESERLAKEVEKKLKDAERLVKELHEEVDRMNRDLERKLREISERAKKTTEDVERVAERGEDRREIDKDLRRVNKEVKDLIDKLEDEARKSHEEHARVLKEIEDRLREVLKEVEANNLPEEVIKKVRKDIEEITRKLERSNREHERTLREIKKRAEKVHEDHRREIDRIREELK

SEQ ID NO: 17422 - protein, 174 aa, Artificial Sequence; identical to SEQ ID NO: 17421
  Synthetic sequence.

SEQ ID NO: 17423 - protein, 174 aa, Artificial Sequence
  Synthetic sequence.
RESEELEREVERVLRELEELVKRLHDDVRRVDEELDRKVRDLHKKVRDVLRRVEKLVRDGRDAREIRKELEDAHERHRRMLEKIEDEARKSHEDHKKVLEDIKRRAEEILKKLRDENLEDRVVDRLRRKIEEIARRLRKSNEDHRRSLKEIKDKLEESNERLRRALEEIAERLR

SEQ ID NO: 17424 - protein, 174 aa, Artificial Sequence; identical to SEQ ID NO: 17423
  Synthetic sequence.

SEQ ID NO: 17425 - protein, 175 aa, Artificial Sequence
  Synthetic sequence.
SEKDEVITRVETELRRVKTEDRDVARRVKEELEDLKRRLERVIEDNERTLRELKKELKERNKPDDEAERLLEKSREVAERVLRKLEEIIKRIEEEIKKMLDESEKIVEEIRDVVRRKGVDEDVVRELEKLLRDWEKRSREVEEKLRRLLDELRETLKEIEKELRRLDKEIKERLR

SEQ ID NO: 17426 - protein, 175 aa, Artificial Sequence; identical to SEQ ID NO: 17425
  Synthetic sequence.

SEQ ID NO: 17427 - protein, 175 aa, Artificial Sequence
  Synthetic sequence.
DREEKVKRRVEEELDRVRRTDDRVLKRVEERLREDEKRNEEVIRRNEKTLRELEKRLRDNRKPDDRMRELLERSRRKAEEALRKTKKIVRDVREKMREAKEESRKIEERIKETIREKGVDEDVVRELEELLKRWKETSERVKRELTDLLRKSEETSKEVTKTLRELDKRIEDELR

SEQ ID NO: 17428 - protein, 175 aa, Artificial Sequence; identical to SEQ ID NO: 17427
  Synthetic sequence.

SEQ ID NO: 17429 - protein, 174 aa, Artificial Sequence
  Synthetic sequence.
SREEDLKRKIDEVDKEWKKLTKKLEEEIREVEKEWRKLSKELERKIREVEKRLKEAKDRNVDKDDVDRRARELVERIKREAEKINEDVERLLKEIEDRIREINKDVDRLLKELEAAGVPEEVIKTLRERVKDIHREDKEIIDRLREKAERIKEHDRKLLEDLKRTLDKLRREME

SEQ ID NO: 17430 - protein, 174 aa, Artificial Sequence; identical to SEQ ID NO: 17429
  Synthetic sequence.

SEQ ID NO: 17431 - protein, 174 aa, Artificial Sequence
  Synthetic sequence.
DEREEIKKELDRIIRESEELVKKIKDVIRKLIEESKRLVEKIREDIKRSNDKLDEVTRRGVSKEDVERVLEKSREDSKRLLEKNRKLIEEVKREIRRLIEENRKLIEEVREEIERRNVEEEVKRRAEDLLRRSDEKSKRIAEEAERRLDRSDEESEKILRDNEDMVRKWREKEK

SEQ ID NO: 17432 - protein, 174 aa, Artificial Sequence; identical to SEQ ID NO: 17431
  Synthetic sequence.

SEQ ID NO: 17433 - protein, 174 aa, Artificial Sequence
  Synthetic sequence.
DETEKITKDLEDLIREDEKLVKDARDTLAKSNEDSRRLVEDLRRLIKESNEELERVVREDVDERELKKLADESRERSKDALRRNKELIDRSREESKKIITRSDELNREIRKRVEDINVEEDVVRRLERLSEESRERLERILRDNKRRLDKSLEDSKRLVEKNDRDLKKWKEDRR

SEQ ID NO: 17434 - protein, 174 aa, Artificial Sequence; identical to SEQ ID NO: 17433
  Synthetic sequence.

SEQ ID NO: 17435 - protein, 177 aa, Artificial Sequence
  Synthetic sequence.
DERETVREELKELIERLRDLNRKIEELLRRSNEEIRRLVEEIRRRLKEMNDEIRRVLKKVDREIIRKLVRESEKLTEEVRRELKTIVDESRKLVDKVRRENERLVREVKKRLEDAKRKGSIDDKVLKEAKELLDASEKHLRDLIETNERVLKRWEEELDKIAEENERVLRKWEEEAK

SEQ ID NO: 17436 - protein, 177 aa, Artificial Sequence; identical to SEQ ID NO: 17435
  Synthetic sequence.

SEQ ID NO: 17437 - protein, 175 aa, Artificial Sequence
  Synthetic sequence.
SEREEVLKKIREMSKRDNEKNKRILDDVRRLSKEDNKDNDRLVEEHRRKITELEDRVRKEGPREEIRKESRRVLEKTAEDFKRSIDRNRKANKEVRDKVKKSIDENKKVLDDAKTEVGEDEVLREVEELSRRDEKRSKEILEEVSKLSKDDEDRSRDLLRKAEEENRRLEEKLRK

SEQ ID NO: 17438 - protein, 175 aa, Artificial Sequence; identical to SEQ ID NO: 17437
  Synthetic sequence.

SEQ ID NO: 17439 - protein, 175 aa, Artificial Sequence
  Synthetic sequence.
SEKETVLEDIRRMSKEDNEKNERIVERARRILEKIEEKNRRVKEEAKKMLERIKKLVKDRGPDKDLKRELEEVVKTLEELHKRLIDELRRVVEEVERLVRESIKENRKVLKDAADRVGEDRVVDEVRKRSEEDERRSRELLEEVRRAVKRVEDKSRTTVREIRERVKEVKKRLDD

SEQ ID NO: 17440 - protein, 175 aa, Artificial Sequence; identical to SEQ ID NO: 17439
  Synthetic sequence.

SEQ ID NO: 17441 - protein, 178 aa, Artificial Sequence
  Synthetic sequence.
SEVEDVVRKVRKLVEKSTRDNKRVLEKVRKLVKESSDKNKKVLDEVEELIERLREKLERIRNDKEKEELKKEIDDVLERVERLHKELKKENDDVLREVEEVSRELKKRNDEVLKRVKEAGVDRDALEEIRKRVEDNKRRSDESLEEIRRLVEENKRRSEKTLKEIREKAKRLKDEIDR

SEQ ID NO: 17442 - protein, 178 aa, Artificial Sequence; identical to SEQ ID NO: 17441
  Synthetic sequence.

SEQ ID NO: 17443 - protein, 178 aa, Artificial Sequence
  Synthetic sequence.
SEVEKVEREVDEMVRDSTKENEDILREVRERLKKIKEDLDRTVTEVRRLLKELEEKAREVRDERLKRRLEEELDRILKEVEELAKKLKDDVEEVLKEVKKLSKRLKDKNDKVLKEVEEAGVTKDMLDRVREKVKRNKEESDKSLDEIRRIAEEVKRRIDELLKEIKKRAEELKRKLRK

SEQ ID NO: 17444 - protein, 178 aa, Artificial Sequence; identical to SEQ ID NO: 17443
  Synthetic sequence.

SEQ ID NO: 17445 - protein, 178 aa, Artificial Sequence
  Synthetic sequence.
SEVEEVLKRARELVERSTRENRKILERARKMLEDARKTNEDVLRDVERLLDELRRELEKIKEDRLKEELKKKIDDILRKVEKLHREIKKRIDEVLEELAKLSKELKEDNDRVLKEVEEAGVDKEVLDEIRELVKENKKRSDDSLREAEKRLRELKEESDKTLDEIRRKLEKLKEEIDR

SEQ ID NO: 17446 - protein, 178 aa, Artificial Sequence; identical to SEQ ID NO: 17445
  Synthetic sequence.

SEQ ID NO: 17447 - protein, 178 aa, Artificial Sequence
  Synthetic sequence.
DEVETVRKDVERLVRTSNDENRRILETARKLIKEVREKNKEVTDRVRDLLRRIEEEVKKVKDKELKDRLKKKIDEVRERVERLHKEIKDELKEILDELERLSTELKEKNKKVLKEVEDAGVDERILEEIRRRVEENKKRSDESLKEARELLRDVERESDETLKEIEEEARRLKEEIDR

SEQ ID NO: 17448 - protein, 178 aa, Artificial Sequence; identical to SEQ ID NO: 17447
  Synthetic sequence.

SEQ ID NO: 17449 - protein, 175 aa, Artificial Sequence
  Synthetic sequence.
DEVKKVVDEARKLVEDDKRTNEEVLRRTRELLERDERKNEEAVKRIRDLLKEIKKLVEAGVDKRELKKRIDELLERLERLVRDSERLNEEILKEDRKVVEESEERNERIKDRLRKLPVDEELLKRIDELIKESKRRTKEAHRESEELARKTKKSTRDLLREVEKRLREIKEEIKR

SEQ ID NO: 17450 - protein, 175 aa, Artificial Sequence; identical to SEQ ID NO: 17449
  Synthetic sequence.

SEQ ID NO: 17451 - protein, 175 aa, Artificial Sequence
  Synthetic sequence.
SDVEKVVDEVREKVKRDKEDNRRVAKEARELVKESSEKLERLVTEVKKLIKTIEKLVRDGVDKRDLERKLREVEEEVKKMADRLREENEKILRDLEEMVKESRERNERIKDEVRKLNVDDELLKEIDKLIKESKKETDDLLKEIKDLIDENKRRIDKLLREIEKLARKVKRDIEK

SEQ ID NO: 17452 - protein, 175 aa, Artificial Sequence; identical to SEQ ID NO: 17451
  Synthetic sequence.

SEQ ID NO: 17453 - protein, 175 aa, Artificial Sequence
  Synthetic sequence.
SDVEKVVEELRRLVRKDEEDNRRAVEETRRLVEDSSRKLEEMVRRVRDLIRKVEELVKSGKDKRELTKRLDDILERVKEAAKRLRDINERILERDREMVKRSRDTNEEILDRARKLRVEERLLREIEKLIRESKKKTDDLHRESKKLIEDNKKRIDDLLKEIKDRVERVKEEIRR

SEQ ID NO: 17454 - protein, 175 aa, Artificial Sequence; identical to SEQ ID NO: 17453
  Synthetic sequence.

SEQ ID NO: 17455 - protein, 175 aa, Artificial Sequence
  Synthetic sequence.
DEVKKVVDEVRKKVEEDKDDNRRAVKETRELVEESSRDLKRLVETSRRLIEEVERLVEKGVDKRRLKELLEEILREDRRAVEELDKKNREILRRDRKAVEDSEKKNEDIRKEVEELDVEERLLREIRKLITESKKTTRDLHRDSKRLIDENRKRIRDLHEETRKLVKEVLDKIRK

SEQ ID NO: 17456 - protein, 175 aa, Artificial Sequence; identical to SEQ ID NO: 17455
  Synthetic sequence.

SEQ ID NO: 17457 - protein, 175 aa, Artificial Sequence
  Synthetic sequence.
SDVEKAVDEVRKLVKDSNEKVERVLREVRKLIEEDERKNREVFERVRKLIEDILRLVKGGTDKRELEKRLRDVLRRVKEAVEDSRETNERILTDVKRIVEELRKENEDIEDRVRKLRVDEKLLRDIREEIERNRRELEKALREIKKEIEKTKRKTDRLLETIKELIDRVVEEIKR

SEQ ID NO: 17458 - protein, 175 aa, Artificial Sequence; identical to SEQ ID NO: 17457
  Synthetic sequence.

SEQ ID NO: 17459 - protein, 175 aa, Artificial Sequence
  Synthetic sequence.
DEVETVKRRVEELVKRSNEELKRIVEETRRRVEDDERDNERIIREIKKKLKDIEELVKSGTDKRDLKRKIEEILRELKEAVDRSRELNKEILRKDREKVEELRKRNKDIEDEVRKLPVEEEILKTIRRLIEKNREDIDRLHEESKREIDRTKERTDRLLDDVRRIAERIKEEIDK

SEQ ID NO: 17460 - protein, 175 aa, Artificial Sequence; identical to SEQ ID NO: 17459
  Synthetic sequence.

SEQ ID NO: 17461 - protein, 175 aa, Artificial Sequence
  Synthetic sequence.
REVEEVLKEVDELVRKSNEDLKDIVRRTRDLLRKDKERNDEVVRRSEELIRRVEELVRRGRDKRELTKRLKEILDEDREAVKESKKLNEEILTEDREAVRELEKKNRKILRDVERLPVDEEALERIKRKIDENEKEIRELHKESEKRIRDTLRATDKLHKDTRRRVEEVKEEIKK

SEQ ID NO: 17462 - protein, 175 aa, Artificial Sequence; identical to SEQ ID NO: 17461
  Synthetic sequence.

SEQ ID NO: 17463 - protein, 175 aa, Artificial Sequence
  Synthetic sequence.
SDVERVVERARDLVRKSDDDLRKMVAETKRLVEESSKKLDKIVRESRELIRDVKRLVEEGKDKRDLRRELKKILDRDRRAVEELRKDNERILERDRRLAERDDELNRKIEDELRKLNVDEELLKEIKKRIDESREKTKRLHEESRKLIEDNKRRIDELHKETKEEVERAKKEIED

SEQ ID NO: 17464 - protein, 175 aa, Artificial Sequence; identical to SEQ ID NO: 17463
  Synthetic sequence.

SEQ ID NO: 17465 - protein, 179 aa, Artificial Sequence
  Synthetic sequence.
EEVKRALEELDELVKRIEEDSRRMVKEAEDLVEKIRKEIEDLLRRSRKLNEDIRRLIDRDNEDKTVERLLRRDEELNEEIKRRVDEVLKRIKELLDRMNKRSEDLLRRLKERLEELAKDGKISEDILRRADELLKRLRRKDEELTKKIERLLEKVAKEVEDINRESKRSADEVRKRVRK

SEQ ID NO: 17466 - protein, 179 aa, Artificial Sequence; identical to SEQ ID NO: 17465
  Synthetic sequence.

SEQ ID NO: 17467 - protein, 179 aa, Artificial Sequence
  Synthetic sequence.
SSVKEVRDELKRLVDEIRKESEDMVERLRRLVEEIRKRNEELVRRSEELNERARRLIERDNNDKEVERLLDEDRKLNERIKRESDDLLRKLEELVKEINRRSKELLDRLEELLRRAKKEGKVDDKILKEAEDLLRDLERRDRELTREVEKLLEELRRTSEETNKRSKESADRVEDEVRR

SEQ ID NO: 17468 - protein, 179 aa, Artificial Sequence; identical to SEQ ID NO: 17467
  Synthetic sequence.

SEQ ID NO: 17469 - protein, 179 aa, Artificial Sequence
  Synthetic sequence.
KEVEEALKRVRELVKRAEDMNEELLRRSRKLNDEIRRRIEEMLRRLEEVVRRIKELVDRDNDDKTVRELLKKIEELIERVIRTVRKLLKRDKELNDRLRRESERVLREIRKLLEEARKDGKVDEKILTEIEKRLKDLEKKSRDSNRESEESLERIRRKVEEIARRVRELLDRLRREVER

SEQ ID NO: 17470 - protein, 179 aa, Artificial Sequence; identical to SEQ ID NO: 17469
  Synthetic sequence.

SEQ ID NO: 17471 - protein, 178 aa, Artificial Sequence
  Synthetic sequence.
SRLEEVTRRARKLVEDITRELRKAVEDSRRVVDKIRRLNEELTRRSRELVKEVKDKVRDKDKLKEVEERIRRLNEESRRLSKEVADELRRINEESKKLLDEVAERIRKLLEDLRAESDTEKVREILEEIRRLLEELEREVKELNEESKRRLDELEKRSEETNKESEDLLEKVRRDVEK

SEQ ID NO: 17472 - protein, 178 aa, Artificial Sequence; identical to SEQ ID NO: 17471
  Synthetic sequence.

SEQ ID NO: 17473 - protein, 178 aa, Artificial Sequence
  Synthetic sequence.
SELEDVVRRLDELVKRIKEENRETLERSRRLVEEAKRTNEETEDRMRRLVEEIEKKVRGDEELERVREEIERANEDDRRRVDEMAKTIRKVNEEDKRRLDKVRREIEELLEDLRRKSDTEEVRRLLEEIRRKLEDAKRHVEELSEESKKLLKELEEHVREVNKKSEKLLRELKDKVKT

SEQ ID NO: 17474 - protein, 178 aa, Artificial Sequence; identical to SEQ ID NO: 17473
  Synthetic sequence.

SEQ ID NO: 17475 - protein, 178 aa, Artificial Sequence
  Synthetic sequence.
SELEKLVEDVRRLVEKIKRDNRKTLKELEELVREIVERNRDTLRRSRELVDRIKKRVRGEKLLDDVVKDIERVNRDDERRLREVMREIERANDEDRKRVEEAAKRIEELLEDIRRKSDTEDVRRVLKEIKELLERVREHVERLNRDSERLLKDLEEHARRLSKESKELLRELEERVRT

SEQ ID NO: 17476 - protein, 178 aa, Artificial Sequence; identical to SEQ ID NO: 17475
  Synthetic sequence.

SEQ ID NO: 17477 - protein, 178 aa, Artificial Sequence
  Synthetic sequence.
SEVEKIREDVKKLIEESKKLNRDILEEVRKMIERWRDTTRRIRERIRKLIEEAEEEIKRSTDEELIERIKKKIDDVLKEIEDLLRKTKEEARKVLEDVERLLREDKRRNDKALEDVERAGASSEVLEEVKRLVEESKRESDEILKRVKKLVDDLARTDDKVLEDIKREVDRLKKELED

SEQ ID NO: 17478 - protein, 178 aa, Artificial Sequence; identical to SEQ ID NO: 17477
  Synthetic sequence.

SEQ ID NO: 17479 - protein, 178 aa, Artificial Sequence
  Synthetic sequence.
SEVEKIKKDVDRMITEWEKRSRDIAKTVDELIEDSRRLNETIRRDVDRVARELKERIKRTTDEELIERIERRIDEILDEIRELLKRDEEKNERVLREAERLLRETKERVKEVRKRVRDKGVSDDVLKKIEEALKRLADRDDDILRRIETLVRKTRRESEELLKEVEDKMRKLKEELRR

SEQ ID NO: 17480 - protein, 178 aa, Artificial Sequence; identical to SEQ ID NO: 17479
  Synthetic sequence.

SEQ ID NO: 17481 - protein, 178 aa, Artificial Sequence
  Synthetic sequence.
SEVEKLTEDVKRLIEKSKRNNRDILRKVKEDIDEWRKRTKKIADEVRKTERDLEEKIKRTKDEEIIKRIKKEIDEILKRVEDLVRDTKERVKEVDTEVKKLAEDNKRENDDVLKKVREAGVSDEVLRRIEEDLKRSKKETDDILKEVKDLLTDLLRRDDEVLEEIKRRAERIKEEIDR

SEQ ID NO: 17482 - protein, 178 aa, Artificial Sequence; identical to SEQ ID NO: 17481
  Synthetic sequence.

SEQ ID NO: 17483 - protein, 175 aa, Artificial Sequence
  Synthetic sequence.
REVEKILTDVRRLIEEWRKKTEDIKREVDKLIEEWRKRSDEIADRSRKLAEEIERLLREGVPREDLRRMIKRILDEDRRLLKESRDKAKEIRDRVEKLVRETDKKVKEIEDRVRKAGVEERVLRKIRRDLERLKKTDDDVLKTIEKKLRELEERDRRLHKESREIAEKLKEDIDR

SEQ ID NO: 17484 - protein, 175 aa, Artificial Sequence; identical to SEQ ID NO: 17483
  Synthetic sequence.

SEQ ID NO: 17485 - protein, 175 aa, Artificial Sequence
  Synthetic sequence.
DEVETIMEKVERDVKRWEELTREIKRRSDKLIEDWKKRSEEVLRESTELIKTIEKLLREGAPREDLDRLLKEILKRDRDLLKESRDRVREAEKEDEDLLRETKKRVKEIKDEVREAGVDESVLRTIDELVRRLEEEDRKVHEESKELARRLEKEDKRLHEESKKLIDELEKKIRD

SEQ ID NO: 17486 - protein, 175 aa, Artificial Sequence; identical to SEQ ID NO: 17485
  Synthetic sequence.

SEQ ID NO: 17487 - protein, 175 aa, Artificial Sequence
  Synthetic sequence.
SEVEKILDEVRKLVKKWDDETRKILEEIDKLIEDSERLLEKIERRSKKLADEIRDLLRKGAPREELKKRLEEILKEDEDLVREDEKLNEEILRRLEELVKRTDDEVRKIDKRVKEAGIDKSVLDEIRERVTRAKEKDKRVLERVKREVERTKEESKRVHEKSREIIERLKKEIDK

SEQ ID NO: 17488 - protein, 175 aa, Artificial Sequence; identical to SEQ ID NO: 17487
  Synthetic sequence.

SEQ ID NO: 17489 - protein, 174 aa, Artificial Sequence
  Synthetic sequence.
DEVRKVRKELDDAVRKLRRDHERVIRESEKVSKEIEDRARDVERRLDKVVDELRKKDVKEEIEREVERIREEVRKKLEEILDRVRKINEKAREHSERNKRDVERVKKEVADRLRDGDSREEVMKRLRDMIRRLKEDAEKLKRELKRRHERVKELLDKVRRELEKLEKEVDDKVK

SEQ ID NO: 17490 - protein, 174 aa, Artificial Sequence; identical to SEQ ID NO: 17489
  Synthetic sequence.

SEQ ID NO: 17491 - protein, 174 aa, Artificial Sequence
  Synthetic sequence.
DEVREVERESEELSEELRRRHEEVVKESEEVSKEIEERIREVIRDLRRVLRKLEEDGVRKEILEEIEKVVRDVEREAERILREVERVNERVRELSKRNIKETEEVNKKVRDELRDGDSREEVVKELRELHDRSRKKVEDIAREARDMHRKAADKLRRLMEDLKRVLEEIRKKVE

SEQ ID NO: 17492 - protein, 174 aa, Artificial Sequence; identical to SEQ ID NO: 17491
  Synthetic sequence.

SEQ ID NO: 17493 - protein, 171 aa, Artificial Sequence
  Synthetic sequence.
SRVDKIRRELRELLERDREDLERAMRELRKIDKDIDERLKEVVERLRRIDERIDREDRDREELEELLRRSEDTVKKISDEIEDLLRRSEERLRRVLERSKKTNDEIRERLRRVDVSKEVEKEVEDAIRETEKRAREVEEENRKSVEDVRRKMKKVEEENRKSVEDVRRKAT

SEQ ID NO: 17494 - protein, 171 aa, Artificial Sequence; identical to SEQ ID NO: 17493
  Synthetic sequence.

SEQ ID NO: 17495 - protein, 171 aa, Artificial Sequence
  Synthetic sequence.
SRVDKIRKELEDLLREDEKRIRDMVKRLREIDEKIDRELEKVARELRELLKRVEDSPDDREEVERMLDEIRRRLDEILERIERLLRESERAVKEVEKESRRTNDEIKKRLEKVDVPEEVEKKVRELVERTEETVRDVERENKESVKRVREKAETVKREVEKRAKEVRDKAK

SEQ ID NO: 17496 - protein, 171 aa, Artificial Sequence; identical to SEQ ID NO: 17495
  Synthetic sequence.

SEQ ID NO: 17497 - protein, 179 aa, Artificial Sequence
  Synthetic sequence.
SEMEEVEERLKELDDKDKRDVDEARKRLEKLDRDIDRRIKEVTKRLRDLNRRIEEELRRNKEKKEELDKLLRESEETTRRILDEVRKLLERSRREVRKIVEENKETIERSRKEVEKIRREGVLTEEVEKKNRKSADDSRETAKRVEEENERTIKRLEEELREVEEEDRKTVEDLRRTLK

SEQ ID NO: 17498 - protein, 179 aa, Artificial Sequence; identical to SEQ ID NO: 17497
  Synthetic sequence.

SEQ ID NO: 17499 - protein, 179 aa, Artificial Sequence
  Synthetic sequence.
DEVREVTKELRDLDREDKKRVEEATKRLRDLNEEDKRLVKKVADDLREDLKRIRERLERNKEKKEDLERLIKEIEEKLEKIKRDNDKTIRESRRTTEELRRENRKTIEDSRRRVKEIRDRGVLTEEVEKENERSVKKSEEDLKRVKDEDEESVKESRKAVREVEEELRKRLKELREELK

SEQ ID NO: 17500 - protein, 179 aa, Artificial Sequence; identical to SEQ ID NO: 17499
  Synthetic sequence.

SEQ ID NO: 17501 - protein, 170 aa, Artificial Sequence
  Synthetic sequence.
SEDETVRREVRELIRRLRKHSEDVKRESDKLLDEIRRRVKEVEDRVKEAVERLDRKKRDERLRDVVEKIDRLLEEVKDRIRKVERDSKEMNKKDEERVERVVRKLEEILDREGVDEDVVRKIRTVVKKIEEDNKKTADELRKLHKDIKKEVDDMEKRIRKVLDEIDKEIK

SEQ ID NO: 17502 - protein, 170 aa, Artificial Sequence; identical to SEQ ID NO: 17501
  Synthetic sequence.

SEQ ID NO: 17503 - protein, 170 aa, Artificial Sequence
  Synthetic sequence.
DEEERARRELEDLLRRLREHSERVAKEVEEVVERNRRKSEEVEKRVREMLKRLDEKKRDEELKRVVEEVKEMLKRLRELNEKVVEEVRRILEKDRRLVDKVRRDLERLLREKGVDKDVVKEIRDRVREAERRNREVVEEIRKLLKEIDKTTRDVEEEIRKLLKRIDEEIN

SEQ ID NO: 17504 - protein, 170 aa, Artificial Sequence; identical to SEQ ID NO: 17503
  Synthetic sequence.

SEQ ID NO: 17505 - protein, 170 aa, Artificial Sequence
  Synthetic sequence.
DEERKARTEVKKEVDDLKKHVKDVADEVREAVKKNRRKSEEVSREVRDLIRRLKETKDDEELKKAIKKLEELLERMRRLNEKVVKEIKKLLDDDDRLVEEVVEDVKRILREKGVDEDVVREIRELLKRIREENRRTVEEIRKLLKRIDEATEELVREIRRVVKEIEDKIR

SEQ ID NO: 17506 - protein, 170 aa, Artificial Sequence; identical to SEQ ID NO: 17505
  Synthetic sequence.

SEQ ID NO: 17507 - protein, 170 aa, Artificial Sequence
  Synthetic sequence.
DREEKLRKELKKLIDDDRKKSEDVEREVRKLIKENEDKSRKVEEEVRKLAEELDTKKRDKELEKVIRDLERLLEELKELNDRVRRTLEELLKKLKELNERARKELEDILRDKGVDEEVIKEIRTVVKRVNEESEEMTKRIRDVVREADKTTEDVRRKIEDMVRRIDERTN

SEQ ID NO: 17508 - protein, 170 aa, Artificial Sequence; identical to SEQ ID NO: 17507
  Synthetic sequence.

SEQ ID NO: 17509 - protein, 185 aa, Artificial Sequence
  Synthetic sequence.
DELRRIEEEVRRRFEEMARRHRKVKRDIEELVKEVTKRNKDTEREIEELVKRMKDEIDRIKEDEKLERLLREAAERLKELLKRDKKLVEDIAREIERVIKELRKINEEVSEEIERLLRELEKLRAEEEKVRRVVKKAREAVERSSREVEKVEREVKKLLDDLKKHSEEVEKKVRELLKRLEDRAR

SEQ ID NO: 17510 - protein, 185 aa, Artificial Sequence; identical to SEQ ID NO: 17509
  Synthetic sequence.

SEQ ID NO: 17511 - protein, 185 aa, Artificial Sequence
  Synthetic sequence.
SELEEIVKTAREIMDRVRREHDRVATEIRELVKRLEEANRRVREEIKRLVKEVEERIRKIKEDKRLREVLEEIARELEKLLKEDKDLLRKAAEDLKRLIEDLRRINEEVEDIARKVIEELRKSRAPREEVEKVVKEIEDVVRESSERVRRVVEEVKKLLRELAKHSEDVEREVRELLKKLAREVD

SEQ ID NO: 17512 - protein, 185 aa, Artificial Sequence; identical to SEQ ID NO: 17511
  Synthetic sequence.

SEQ ID NO: 17513 - protein, 185 aa, Artificial Sequence
  Synthetic sequence.
DELKEIRDRIKKRVEELRRENEEVREEIERIVRKAREDHRRVERELEDLVRRARDKVEKIKDRETLKRLLDKVEKDIRKILDELRRLNEEVARTLEKLLRDDKRLVDKAAEDLRRLIEELKKSRADEEEVRRVVKEVEELLEDLKRHSEKVKEEVKRLLEESSREVERVEEKAREMLERLRERAR

SEQ ID NO: 17514 - protein, 185 aa, Artificial Sequence; identical to SEQ ID NO: 17513
  Synthetic sequence.

SEQ ID NO: 17515 - protein, 185 aa, Artificial Sequence
  Synthetic sequence.
SEAEKLRDEIRRIVEKAERDHEDVKKKIEDLVKRVEERNREVTKRIRDLVRDARRRLDEIKEDEKLERVLRKVERDLRELIKEDEDLLRRIAEALEDMLRKLEKLNRDVAEILKELLRKLRETRIEKDKLKKVEEEVEELLKKSNRKVREVKRELKELLDRLAKHSDEVRREVEELLRDLARRAT

SEQ ID NO: 17516 - protein, 185 aa, Artificial Sequence; identical to SEQ ID NO: 17515
  Synthetic sequence.

SEQ ID NO: 17517 - protein, 185 aa, Artificial Sequence
  Synthetic sequence.
SELEKIREDMRELVERLKEANDRMREKIRKILEDVDREHEEVRKRIEELVKRARETIERIRDKRTLDEVLKKVEEELRRALKRLDEINERVKRDIRRLLEEDKRLVEEAARRLKKLLEDLDKSRAEKDKVKKVKEDVKRLLDELRKHSEKVIREVEKLLRESNEKVKRVKEKLEELLRRLRERSR

SEQ ID NO: 17518 - protein, 185 aa, Artificial Sequence; identical to SEQ ID NO: 17517
  Synthetic sequence.

SEQ ID NO: 17519 - protein, 179 aa, Artificial Sequence
  Synthetic sequence.
DEIETIKKEIDDMLREIKREVERSKEEIDRALKRIREEVKKSEEEIDKALEELRRNGVPEEILRKIEELLRRLKDEHRKLLERIEEVLRRLKRRHDKLLEDAERLLRELKEELDRNKDKSEEIIKRLLEKIRREARKVKELIRTSNEEVRKRLKDLEELIRKSHEDVRRTLETLERETR

SEQ ID NO: 17520 - protein, 179 aa, Artificial Sequence; identical to SEQ ID NO: 17519
  Synthetic sequence.

SEQ ID NO: 17521 - protein, 175 aa, Artificial Sequence
  Synthetic sequence.
DKERELDKEVRDMIDTLRDSNRRINERSERVLRELDESVKKNEEDIRRAIEELKAEVRRDDLPRGLVREAVERLKKLLERDRRLVTEVKERSKKSNEDDKRLSEEVVKELRRLVREKGVDEKVLKEIRDLARKIKEDNDRSLEDNDRLAKEIKERNKRVHDETRKMLEDIKRELT

SEQ ID NO: 17522 - protein, 175 aa, Artificial Sequence; identical to SEQ ID NO: 17521
  Synthetic sequence.

SEQ ID NO: 17523 - protein, 178 aa, Artificial Sequence
  Synthetic sequence.
DEDKEIDERVKTVKEEIRRRSKKDKEEVDRVLKESDETLKRILEEVKKVLKEIEERVPDLDEVRKKVEDVERKVATELEKNLRRVDKAVKEVRELNKELERELDEIRKEVRDLLKRIRREEELRRIVERVRERVTELREKLKEIHKRTREVADELRKNNRRWEEDVRRLVKELREREE

SEQ ID NO: 17524 - protein, 178 aa, Artificial Sequence; identical to SEQ ID NO: 17523
  Synthetic sequence.

SEQ ID NO: 17525 - protein, 178 aa, Artificial Sequence
  Synthetic sequence.
DEEERIRTKVEKVKRELEEKSERDKRALEKVEDESRRTSEEDERELERVIEEIIREVDKLDEVREKLERVLRKVRKLNRDSEERLKRIKEEVEEANREIRRRLEEVERRVKDLLDRVRREEELRRIEREVDRAVKELDRLLRELHRRTREVVKELRDLDRRIHEDTRRVVREAREEVR

SEQ ID NO: 17526 - protein, 178 aa, Artificial Sequence; identical to SEQ ID NO: 17525
  Synthetic sequence.

SEQ ID NO: 17527 - protein, 178 aa, Artificial Sequence
  Synthetic sequence.
SEREEIEERVERVERESEDTSRRDEEALERVLRESEDTSRKDREALRKALEDIERELPNLEEVKRKVERVVEEVEKLNRDSERKVKEIAEEVRRLNEESRRELKEMVRRVRELLKRVRREDVLRRIMEDVKRVADKLRELDKKIHEETRRAVDDLRRLDKEIHDRTRKLVKELREEAK

SEQ ID NO: 17528 - protein, 178 aa, Artificial Sequence; identical to SEQ ID NO: 17527
  Synthetic sequence.

SEQ ID NO: 17529 - protein, 174 aa, Artificial Sequence
  Synthetic sequence.
SEIEEITKDLRRLVEEIERLNKRVEDENERTAKELRDRVREAEKKNRKTVDDIRKLIEDGVRREEIREVIERDREEVEKVVRDLRDLLRKDRKRVREAVETSERLLEDIKRRLEEVDVSDEVRREVDELIKKSRETLKRIERRSEEVAEELERRLRDIKRRSEDMVRELEERAK

SEQ ID NO: 17530 - protein, 174 aa, Artificial Sequence; identical to SEQ ID NO: 17529
  Synthetic sequence.

SEQ ID NO: 17531 - protein, 174 aa, Artificial Sequence
  Synthetic sequence.
DEKEKVTKKIEELLKAIEDKIREVEKRSRDSAKEIEDRNREVEKRNKDTVRRIRELIERGVREEEIKKLIEEDKERVRKMVEETKKLVKRSTDEVRRVVDEARKLIERIKEEVERMPVDEEVRKRLEDAVERIKKELKRIKDENDEVVKKSRDSLRRIKEDSERVVRELEERAK

SEQ ID NO: 17532 - protein, 174 aa, Artificial Sequence; identical to SEQ ID NO: 17531
  Synthetic sequence.

SEQ ID NO: 17533 - protein, 174 aa, Artificial Sequence
  Synthetic sequence.
KRKEDIERRIEKLVRDDRRLVREAEKRSKESVDRLRDLVDKARKESDESARTIDKLIKDGVERRDIERMIRESSKRVKDVIERLKKLLEESTRTVEELVRRSKRTLDEIREEVERLDVEERVRKRLEDVVRESKKRLDEIKKRNEDVVRELEERLRRIEERNRRVAEELKRKAK

SEQ ID NO: 17534 - protein, 174 aa, Artificial Sequence; identical to SEQ ID NO: 17533
  Synthetic sequence.

SEQ ID NO: 17535 - protein, 175 aa, Artificial Sequence
  Synthetic sequence.
SEIEDIERELRESNKRHEDTLRKIKRDLEDSNRRHRETIRDIEARLEEVIKKLREDGVSEEVLKEIKRMLEEIVRDIRRSHEEHKKLLDEIKREAEKSHEEHRKLLEEIRREAEKNKVREEELRELVKRVHERAERVNRDLKRKVKEVHDRVREVNKELRRKVEELKRRAEERRR

SEQ ID NO: 17536 - protein, 175 aa, Artificial Sequence; identical to SEQ ID NO: 17535
  Synthetic sequence.

SEQ ID NO: 17537 - protein, 175 aa, Artificial Sequence
  Synthetic sequence.
SEIEDIKRKLDDVIREHARTLKEIKDELKKSNERARERIEDIDRKLRDVERRLRESGVDDDVLRDLEDKARKIKRKLEKIHEEHRRMLEEIEKEARKSLKELKEIVEDIKRKADDNRVRVEELEDLVRRLKKRVEEVNKRLREKVKRLHDEVDRVLRELEEEVKKLKEDVERAAK

SEQ ID NO: 17538 - protein, 175 aa, Artificial Sequence; identical to SEQ ID NO: 17537
  Synthetic sequence.

SEQ ID NO: 17539 - protein, 175 aa, Artificial Sequence
  Synthetic sequence.
SEREKIEEDIKKALKEAREVVERIKKKLDDSNREHKRTLDEIKKKLDEVIDEVRKSGVSEKMLREIEEVVKKIEEDARRSHEEHKRVLDKIVEDAKRILDRLRELVTRLLEELKKNKRREEEIREDLERIVTEVKKVLDELDKLVKDLHDEVRKVNEELDRKVKKLRKEAEEKTR

SEQ ID NO: 17540 - protein, 175 aa, Artificial Sequence; identical to SEQ ID NO: 17539
  Synthetic sequence.

SEQ ID NO: 17541 - protein, 175 aa, Artificial Sequence
  Synthetic sequence.
SEIEEIKRRLEDSNRRAREVIKRIEDELRRSNEEHRRTLKEIKEELDRVLEELKRKGVDESVLDRIRELIERIAREAEKSHEEHRKLLEEIRKRAEDIHRRHKEILDDILRKAEDNRTREDELREVVKRVHDEVRRELKKLEELVKKVHEDAKRVNEELRRKVKEVKERAERDVR

SEQ ID NO: 17542 - protein, 175 aa, Artificial Sequence; identical to SEQ ID NO: 17541
  Synthetic sequence.

SEQ ID NO: 17543 - protein, 174 aa, Artificial Sequence
  Synthetic sequence.
RREEEVEKRLDDARRRLEKSNRDDERLTRTVEEELKRSNDEIRKRLETAMRELKKLVKDGVDKDDVERVLDRVRRELEELVKENKEIVREIRKRNEKSKRDNERLLRKVEEDIRRLDRSEEVERRLEKVEEDSRRELKRSEKRSDEVARDSERLLDEWRRRLEEVIRRVKEETR

SEQ ID NO: 17544 - protein, 174 aa, Artificial Sequence; identical to SEQ ID NO: 17543
  Synthetic sequence.

SEQ ID NO: 17545 - protein, 174 aa, Artificial Sequence
  Synthetic sequence.
SREETVRERLREVAERLKKSNREIEELLKKAAEELKESNTRDKKLSEDVSRRLEKLSRDGVDKDDVRREIERIKRKNDDTERRNKELLDKIREDMERMARRNKELLRRIEEEIRKMDASEEVEERLKRVIEESERRLDKWRRDLDRVIKESEDLLKKSREDSERVVREVEKKEK

SEQ ID NO: 17546 - protein, 174 aa, Artificial Sequence; identical to SEQ ID NO: 17545
  Synthetic sequence.

SEQ ID NO: 17547 - protein, 185 aa, Artificial Sequence
  Synthetic sequence.
SEIEEVERMLEDLERRVREADKRVREESKKLEDEIRREDKRVEEMIDEVRKKVDELDRDVRGRERLKEVVERLEEEAEEIVKRVRELSKRLEKKVRDHTREVRRLSEELERRARDIKRRVRERLRDKDEVRRIEEEVDRVIEENRETVKEIEERNRRVLEANRESLRELEERLKRILEEVRRRSK

SEQ ID NO: 17548 - protein, 185 aa, Artificial Sequence; identical to SEQ ID NO: 17547
  Synthetic sequence.

SEQ ID NO: 17549 - protein, 185 aa, Artificial Sequence
  Synthetic sequence.
SEIDEVRREVEELERRAEEVDREVERRSKELKERVDDVDRRSRELSKRLKDTADEVRKRVRGREDLERVVRDLEKKVEEVVETSKRLSDELRKEAEKHTEDVERLSRKLVEELREIVDRVRKRLRDKDKLETIRRRLEEVLKRNKETVDEIRRRNEDVIRRNEESLEKNERDLRRVLDEVRRSAT

SEQ ID NO: 17550 - protein, 185 aa, Artificial Sequence; identical to SEQ ID NO: 17549
  Synthetic sequence.

SEQ ID NO: 17551 - protein, 185 aa, Artificial Sequence
  Synthetic sequence.
SELEKVDELVKRLMKEVRDVDRRSEKLTEELERKVREMDRKSKKLSEDLERDARRVEKEVRGKERLEKVVRDLERKVREVVKESERLSRELERDAKRVVEESRRLSEELRRKAEELVRRAREELRDKDALRAIEKKLEDILRRNEETLRRNEDKIRRIIETNKRSLEENRRRLEEVLRRVKESAR

SEQ ID NO: 17552 - protein, 185 aa, Artificial Sequence; identical to SEQ ID NO: 17551
  Synthetic sequence.

SEQ ID NO: 17553 - protein, 185 aa, Artificial Sequence
  Synthetic sequence.
SITEKVERLIRELERKVKEIDDDLRRTSEEIMKRARKADEDSERLSERLRELVDRLDREVRGKEKVKKVVDDIKREAKRIIEKTDELHEETRRLVEENKRRIDELHKEIRETVKEIEKRIDDDGVPRESAERLKEELRRVLEENRETLERLREENERVLEENKRRVDENREKIKEVLRRVEERTR

SEQ ID NO: 17554 - protein, 185 aa, Artificial Sequence; identical to SEQ ID NO: 17553
  Synthetic sequence.

SEQ ID NO: 17555 - protein, 185 aa, Artificial Sequence
  Synthetic sequence.
SITERVEEDIKRLMEEAKRVDDKVRKLVEELMRDVKRVDKELAELVEELERRVKDLTRRVRGKERVKEVVKDIERKAREIIRRIRKLLDESRKKAEEIIKELRKLHEDIDRKVKEILRDIDRAGVSREEAERLKEELRRVLEENRRTVEEIERRIKRVLEENEETVRRLEKRIEEVLRDVREKTK

SEQ ID NO: 17556 - protein, 185 aa, Artificial Sequence; identical to SEQ ID NO: 17555
  Synthetic sequence.

SEQ ID NO: 17557 - protein, 174 aa, Artificial Sequence
  Synthetic sequence.
SKVEELKRRLKKVRDDDRRSVEKLRETLRRVLARDRDEIREAERELREALKRLEDAGADEKLLRDMKKVIDEMKEHLKRNNEELKRVVERVERDLERSHDELRRVIEEVEKRLADGDTREDVLRDVERVVREVLEKNKKILKEVKEVVEESLRNVRDLIRRAREIVKEIVDRVK

SEQ ID NO: 17558 - protein, 174 aa, Artificial Sequence; identical to SEQ ID NO: 17557
  Synthetic sequence.

SEQ ID NO: 17559 - protein, 174 aa, Artificial Sequence
  Synthetic sequence.
KEVEDLRRELEEAKKRDKDLIDKLKRRAEEVKEEDERSIRENKKALRKAEEDLRRKGADEKLKEDLKRIIEESERNNEDSHRRLEEMIEKVRRHLDRNNEDLERFIKDVDELLRRGDTRERVLEEVRKTLKRSMENVEELEKELEELVTRVRDHNRRDHEETRRLLEEIKRRVD

SEQ ID NO: 17560 - protein, 174 aa, Artificial Sequence; identical to SEQ ID NO: 17559
  Synthetic sequence.

SEQ ID NO: 17561 - protein, 174 aa, Artificial Sequence
  Synthetic sequence.
DEVERLKEKLEEVRRRDEEIIRKLEEDLERVKRDDDRLVRENEEELKRVEEKLERDGADESLLRELKDVIRRSRDHLTRNNEDLERVIRRVEEHLKRNNDTLKDVLRKVDELLRRGDTREEVLRRVEEAAKRSLDNVDKLEKDVADLVRRSMENVRDLHRRTRRLLEELKEKVK

SEQ ID NO: 17562 - protein, 174 aa, Artificial Sequence; identical to SEQ ID NO: 17561
  Synthetic sequence.

SEQ ID NO: 17563 - protein, 176 aa, Artificial Sequence
  Synthetic sequence.
SEKEKVLEDAERVLREIKKKNEKALREAEEVARRIAEEVKRIHDRSKEVVDDIKRLADAGEVDEKELEERLKRVIDTVRKLNEDLRKKLEDAIRRLEKLLKESKEELKRVAEELRKDLKDDKDVERRVREAKKENDKSVDEIREEVKRVKDELDRLSERNEEELEKVERDLRRRAK

SEQ ID NO: 17564 - protein, 176 aa, Artificial Sequence; identical to SEQ ID NO: 17563
  Synthetic sequence.

SEQ ID NO: 17565 - protein, 171 aa, Artificial Sequence
  Synthetic sequence.
DEEKKVLDKLRELATRLSRRVEEAHRESEKIAEEIRRRAEKVLRESRKTVEEIKRSPDDRKDVRRVVKEDEDRSREVVKDLERLLKELEDRSRKLEEELRRIMKKIEEEVRRAGVDERIKDDVRRMKKELEDLIEENRRRVEKVKEDIRRLIRELEARNEDVDRELRRKED

SEQ ID NO: 17566 - protein, 171 aa, Artificial Sequence; identical to SEQ ID NO: 17565
  Synthetic sequence.

SEQ ID NO: 17567 - protein, 171 aa, Artificial Sequence
  Synthetic sequence.
SRLEKVEKELEELAREDKERIKRVIDDIRRLVREDEERIKEMHKKTEDIVRAIEEEDRDREELKRLLERLEEESRRMADESRRTNEEIRRKVEKVVEESKKTNEEIRKRVEDAGADERIKKRVEKLKRDSKRLIDELRKELEEVVKRSEDLIKENRDTVKEVSDRIREKAR

SEQ ID NO: 17568 - protein, 171 aa, Artificial Sequence; identical to SEQ ID NO: 17567
  Synthetic sequence.

SEQ ID NO: 17569 - protein, 171 aa, Artificial Sequence
  Synthetic sequence.
DDEERVLKELKKLVEDDRKKIEDVIETIERLAREDVERIKRVIEELRRLVKELEDGDLDKEVVRRLLEEIKRAVKEAVRESEKTNDKIRRDVDRVVKDSKRTVKDIKRKVDEAGADEEIKEDVKRAADESEKLIRELRKAVKRVEEESRRLIEELEREVKEAEERLKRRTK

SEQ ID NO: 17570 - protein, 171 aa, Artificial Sequence; identical to SEQ ID NO: 17569
  Synthetic sequence.

SEQ ID NO: 17571 - protein, 181 aa, Artificial Sequence
  Synthetic sequence.
EEVERLLEELKELVRRIEERLKRAHDEMEDLVRRIKEEIKKLHEDTKRVVEEIRKLIERDNIDKLLERLIEELKRIHEKINRDIKRAIEELKRLSDRIEEEIRKLIKELEDVLRRITETAGRDERVKEAEDRVRDAVRRLKRLLEEHKKASEKVVRELERLLEENRKTVKEVVDRLREESR

SEQ ID NO: 17572 - protein, 181 aa, Artificial Sequence; identical to SEQ ID NO: 17571
  Synthetic sequence.

SEQ ID NO: 17573 - protein, 181 aa, Artificial Sequence
  Synthetic sequence.
REVEELIKELRRLAEEIRDRIRKLHKEMEDLARDIERRIEELDRELERVATEIAKLIERDNIDRLLDELLERLDRLSKKIEEDVKRLIDESRRLSEEIAKRIKDLIEELKRLLEEVAKRKGRDEDIKRLEEEVRKVEEELKKLLKEHRDANKEVVDRLKRRIEEHKRKTKDLKEELERRMR

SEQ ID NO: 17574 - protein, 181 aa, Artificial Sequence; identical to SEQ ID NO: 17573
  Synthetic sequence.

SEQ ID NO: 17575 - protein, 181 aa, Artificial Sequence
  Synthetic sequence.
DEVEEVIERLRRLAERIEERLREMDRRLEELVERAKRTIERLHEELEKLVREAEELIRRDNNDKLVEELIRRSEDLSRKIEETIRRIIERLRKLSREIEEEIRRVIEELKRLLDKIRADRGDDKDVTRLEEELRRVVKKLEDLLREHKEKSDRAVEDLERLLTEHKKRNEDVIRRLKEASD

SEQ ID NO: 17576 - protein, 181 aa, Artificial Sequence; identical to SEQ ID NO: 17575
  Synthetic sequence.

SEQ ID NO: 17577 - protein, 174 aa, Artificial Sequence
  Synthetic sequence.
SEVEEIRKKAEDVMRRLEELDKRLDEVLKKVSRELEKSDKDLEDRIREVIRELEERGGKKRETLKKVIEDLRKLVEEHKELIERVKRELKRIVDEHHRLIEEAKKRLRDILDKITKDTKDEMERRLEEVVKEAERRSEEVLRRLEKVVKDIKKKSKEILDRLEELVREIRERVR

SEQ ID NO: 17578 - protein, 174 aa, Artificial Sequence; identical to SEQ ID NO: 17577
  Synthetic sequence.

SEQ ID NO: 17579 - protein, 177 aa, Artificial Sequence
  Synthetic sequence.
SESEEIDREAKKVEREVREMSRRNDEELRRVAKESEDSVRRVEDRVREVSEEVEARGVDDKVREELERISRRIKKLLDESRERLKKMVKESKELNEEIRRKLEEILREVRELLKRVRREKELTEILKRLKDLADELRKLLEDVHRRSKKAADEDRKLNEDILKELEDLARELRKKTK

SEQ ID NO: 17580 - protein, 177 aa, Artificial Sequence; identical to SEQ ID NO: 17579
  Synthetic sequence.

SEQ ID NO: 17581 - protein, 177 aa, Artificial Sequence
  Synthetic sequence.
DEEKKVRDEIRRAEEESRRSSKRNEDELRKVKEEIERRLEEVRRKAKEVEEKVRREGVPEEVEKRLKEILDEVRRLLEELRERLDRVLRRSEELNKRSEDKLRKVAKEVEELLRNVRREEELRRILERLKEMVERDKETNEEIHRRSKDVVDKLRRRIEDIKRRLDELAEKLKEDTR

SEQ ID NO: 17582 - protein, 177 aa, Artificial Sequence; identical to SEQ ID NO: 17581
  Synthetic sequence.

SEQ ID NO: 17583 - protein, 177 aa, Artificial Sequence
  Synthetic sequence.
DDERRIRETLKRADEEVEKALREVREHTKDVERENEKLSKENKERLEEVKKRVDDSGVDETVKDELRRIVETSKRLNDESRRKSEEIKKDTEKLLREIKEKVERVLERIERLLDKIRRKDVLRKIEKEIEEMVKDLRRLLKEVEDKDRTLAEELRRINEDIHRRSEEMKKELDDRTR

SEQ ID NO: 17584 - protein, 177 aa, Artificial Sequence; identical to SEQ ID NO: 17583
  Synthetic sequence.

SEQ ID NO: 17585 - protein, 182 aa, Artificial Sequence
  Synthetic sequence.
KEVEDVEEKIREIVERIRDEARKAEERNRDTVRRIEDVARKLHKRTKEIVDEIRDVLTKRREVEEELRKLLTKLREMNERARRRIEELLRRDKKVTKEVKDKLEKLLRELEEELKKIAKEVDSKEMLETIKRKVEKVKEDLRKKIEDIEKHTRDVEDKVRKELERNEKKSRDVKEEVERRLT

SEQ ID NO: 17586 - protein, 182 aa, Artificial Sequence; identical to SEQ ID NO: 17585
  Synthetic sequence.

SEQ ID NO: 17587 - protein, 182 aa, Artificial Sequence
  Synthetic sequence.
SELEKAEKENKDSADEIREVLKRLEEENRETAKRIEKHTRDAHRKTEDIVRRIEEVLRRRKEVREEIRELLKRLREVNEEVHRRNEKLVREDEERTKRAEEELRKLLEDDKRRVDEVEREVDAKEALKRIRDHVEEVRREVEELLRKIREHTKEVAEKVRRENEKNKKRSEDVRKKVEDDER

SEQ ID NO: 17588 - protein, 182 aa, Artificial Sequence; identical to SEQ ID NO: 17587
  Synthetic sequence.

SEQ ID NO: 17589 - protein, 182 aa, Artificial Sequence
  Synthetic sequence.
SEVERVLEENRKSAKEIEDELRKVLRENEKSAEDIEREIDKAEKENRETVKDLRRVLTERKEVREEIERLVREDEKKTKDLIEKLRKLLEDDRRRTEEVKRRIRKLVDEDRERVKEAKRRVDSKEKLETIERHVRKVEEDVERMLKEIERRTRDVMRKVDKLIKEIEKHTREVAKEVKEAED

SEQ ID NO: 17590 - protein, 182 aa, Artificial Sequence; identical to SEQ ID NO: 17589
  Synthetic sequence.

SEQ ID NO: 17591 - protein, 178 aa, Artificial Sequence
  Synthetic sequence.
SLVEDLERKLEESTRRDEESMKRVREILKELEDRDRKSVKEIEDELRKARKEVKDSRVSEEIRKELEKAVEEVERLLRESHEELKRVIDELEELLKESHKRNKKVVDDVKDVLDKLREIEEMAREVIKTLEKVSRELEETNRRVIDRIRKLAEEILRKNKEVLERLRKIVKEIKEKAK

SEQ ID NO: 17592 - protein, 178 aa, Artificial Sequence; identical to SEQ ID NO: 17591
  Synthetic sequence.

SEQ ID NO: 17593 - protein, 178 aa, Artificial Sequence
  Synthetic sequence.
SLVETLKKILDDSTRRNEELIRRLEEELKRIKETNERTVRELERELKRAEEEIERQNVSEEIRKEVKDVVDEVRKLLEESKERTKRTIDKVRKLLEESHRDNRRVVKEVEDLLRKLREDEEAAKRVIERLRRLSERNVRTLEEIIKTLRDLARRSKERDDEVLEELKEMIRRIEEKSK

SEQ ID NO: 17594 - protein, 178 aa, Artificial Sequence; identical to SEQ ID NO: 17593
  Synthetic sequence.

SEQ ID NO: 17595 - protein, 176 aa, Artificial Sequence
  Synthetic sequence.
DELEKVVRELEELAKEILKKLDEIIRDTERLVREAVKRLRELIERTRRLMDEVRKKVRDKDLLKEVKERLDRSHEEAERLVRKLKKDLEDSNRRAEELVRRVEEELKDLVRRLRGTDEKVMRELEDTVRRVREELRKLLEEHNRRVKKVLEDLDRLLDEHRKIVEDIKRDLDRREK

SEQ ID NO: 17596 - protein, 176 aa, Artificial Sequence; identical to SEQ ID NO: 17595
  Synthetic sequence.

SEQ ID NO: 17597 - protein, 176 aa, Artificial Sequence
  Synthetic sequence.
SEIEKVLEELRELVKKAVTDLRRIIEESKRLADEAAKALKDIIRRSEELADRLRKEIRGREVLEEAKKKLDTSNRDAERLVRELKERLDDSHRRLEELVKRLKDDLDRILEELKGTDEKLARELEDVVRKVKETLDRLLEEHKEIIERIKRTLDKLLKEHNEIVERIKRDLDRRRK

SEQ ID NO: 17598 - protein, 176 aa, Artificial Sequence; identical to SEQ ID NO: 17597
  Synthetic sequence.

SEQ ID NO: 17599 - protein, 176 aa, Artificial Sequence
  Synthetic sequence.
DEMEKVIRDDEKLLEDVLRRLAEIIRRTEKRAEEMVRELEKLIEDSKRKADDVRKRVRTDEVVKRVKEELDESNEKAEKLVRDLKRELEDSNRKAEELVRRIKKENKRTVEEVKGTDEEVVKRLDDIARDVNRTLDKLLKDHNEIVERIERTLDELLKEHNEIVKRIKEDLDRKRK

SEQ ID NO: 17600 - protein, 176 aa, Artificial Sequence; identical to SEQ ID NO: 17599
  Synthetic sequence.

SEQ ID NO: 17601 - protein, 176 aa, Artificial Sequence
  Synthetic sequence.
DDAETVIERDRKLADEVAKELKRLIEETRDLARRIREELRRLIEELKTLAKRAKDEVRGDEVVEKVKKELDEILKTIEDLVREVKRELDESNERAKELVRRIKKRNDDTVKEVQGTDRDVVRELREIARKINEDLDDLLRKHNEIVEKIKRDLDRLLEEARKILEEIKRELDETKK

SEQ ID NO: 17602 - protein, 176 aa, Artificial Sequence; identical to SEQ ID NO: 17601
  Synthetic sequence.

SEQ ID NO: 17603 - protein, 178 aa, Artificial Sequence
  Synthetic sequence.
DEEERLRDSVRRSRELIKEIRKRLEESIRRSERINERVREELRRSVRESERSAEEARRRGDLREELLKELEEVNKALEDMLRKNEKKSEDVNEDLRRRIKELEEELERVNDTVRKLIERNRDTETVLEEHKERVKRILDRARDLLRKHRELVEDSRRHLEKLLRDHRKVVKEIEDKIR

SEQ ID NO: 17604 - protein, 178 aa, Artificial Sequence; identical to SEQ ID NO: 17603
  Synthetic sequence.

SEQ ID NO: 17605 - protein, 178 aa, Artificial Sequence
  Synthetic sequence.
SEEERLRESLERSRKRLEEVKRELERKLEEWEEIVEESRRRAEKSLRESKERIDDLKRRGELREKLEEDLKEVNKEIREMIKRSKDEVERKIREVERRAKRLAEKLEELNKKMKDLADNNRDTEEVLRRHEKVVRRIDEELEELLEELERVIREDTERNKKLLDEHREVVKEIEERVR

SEQ ID NO: 17606 - protein, 178 aa, Artificial Sequence; identical to SEQ ID NO: 17605
  Synthetic sequence.

SEQ ID NO: 17607 - protein, 178 aa, Artificial Sequence
  Synthetic sequence.
SSEKRLRDSVRESRDRARKIEEDHRRLVEEWERLVKRSEEEVRKSVEESREEVEKAKKEGRLREELRKELEDVNEKLKKDIKRSKEEVKKVIDRSRESVKTLLDRLEKMNRDLEELLRNNSDTDKVLEDHKRLVEKILKEAEDNLRRSRKMIREDEERNRDLLRRHREVVKEVKRKVD

SEQ ID NO: 17608 - protein, 178 aa, Artificial Sequence; identical to SEQ ID NO: 17607
  Synthetic sequence.

SEQ ID NO: 17609 - protein, 178 aa, Artificial Sequence
  Synthetic sequence.
DKEERLRESLEKSDRDIRRIKEELERLLREWEKRVRDSEKELRDVLRKVTEEAKELKKQGKLREKLLKELDDVRKRVEKVMRKSKEDVKRVIEEVKRRADELKRRLEKVNRDVEEALKRNVDTDDLLRRHKEVVEKILREIEELLRELREAIRRDKKRNDELLKRLAEVAEKIREDVR

SEQ ID NO: 17610 - protein, 178 aa, Artificial Sequence; identical to SEQ ID NO: 17609
  Synthetic sequence.

SEQ ID NO: 17611 - protein, 178 aa, Artificial Sequence
  Synthetic sequence.
SEKETLERSIRESERILEEVLRELKKVLDEWRRRVEESEKRHRDLIEEVRRRAKKLREDGKLREDLLRELERILRESRESVDKSKKEVEEVIKRVEDKAREIAERLKRMNDEVREAADKNVDTDDLLRRHKELVEEIKELLERLLRELEEVIKRDKDKNDENLTRSKRLIEEIEERVR

SEQ ID NO: 17612 - protein, 178 aa, Artificial Sequence; identical to SEQ ID NO: 17611
  Synthetic sequence.

SEQ ID NO: 17613 - protein, 178 aa, Artificial Sequence
  Synthetic sequence.
DSEERLKESVKRSEDDLKRLRDEHRKLVEEWRRRIDESERRHRKLIEDVRRRLTEFRKRGDLREELEKRITEAERRSKESVEESRREAEEVIRRSERSVDKLAEELREVNKRLEEAARRNVDTDRLVEEHKKMVKEIRDRVKANLERSRRMIKRDKEKNDDNLRRSKELIDKLEEDVR

SEQ ID NO: 17614 - protein, 178 aa, Artificial Sequence; identical to SEQ ID NO: 17613
  Synthetic sequence.

SEQ ID NO: 17615 - protein, 178 aa, Artificial Sequence
  Synthetic sequence.
SKEERLRESSRRSEKAVREVEKRHKESVERSKEEIRRLAEELRKSIEDSERRIKEIRERGKARDELLEELRRVNDEVRDRLRRLKERLEEVNKESKDSVDDLKRKLREVNERAKELITRNVDTDRLLEEHRKLVERILEELEKNLERHRRVVKEILDRVKELLDEHRRRVEEIERKIE

SEQ ID NO: 17616 - protein, 178 aa, Artificial Sequence; identical to SEQ ID NO: 17615
  Synthetic sequence.

SEQ ID NO: 17617 - protein, 178 aa, Artificial Sequence
  Synthetic sequence.
SKEETLKRSSEESKKELKRVDEELEKIIREWEEDVKRSEKELEEVIERAKREAEKLRTRGELREELKRELERVLRDVRRRVEDSKRDVKRELDKLKKDLDAIRRELEKLNKEVEEAMKRNVDTDTLLERHKRLVEEVREKLERLLRRLRKVIKEDRERNKRLIKRLKEVIDEIRERVR

SEQ ID NO: 17618 - protein, 178 aa, Artificial Sequence; identical to SEQ ID NO: 17617
  Synthetic sequence.

SEQ ID NO: 17619 - protein, 178 aa, Artificial Sequence
  Synthetic sequence.
SERERLEDSSRKSKERLERIARTLEKLLRDWRREVEKSEKRHRELVEKVRRDLDDLRRRGKVREELERKLEELIKESEKSVKRSKDEVEKVIREMEEELKRLVEELERVNTEVREAAERNVDTEKLLRDHKRLVDDLDRRAKELLEELKRVIDEDKKRNEKNLTDSRRLVEELKEEVR

SEQ ID NO: 17620 - protein, 178 aa, Artificial Sequence; identical to SEQ ID NO: 17619
  Synthetic sequence.

SEQ ID NO: 17621 - protein, 178 aa, Artificial Sequence
  Synthetic sequence.
SSKERLEESSERSERSIERIDREHERSSEESERRLKKMVDDLRRSSEKSKDDLEKLKREGKVREDLERELREVNKELERLARELAEKLRKVNKDSKESVRELEERLRDANRRLEELLRRNVDTDELVERHKRVVEEIEERAERNLRRHKKVVEDILREARKVLEDHKELVERLKERVE

SEQ ID NO: 17622 - protein, 178 aa, Artificial Sequence; identical to SEQ ID NO: 17621
  Synthetic sequence.

SEQ ID NO: 17623 - protein, 178 aa, Artificial Sequence
  Synthetic sequence.
DAERRLKKSSEDSKRAIDELRKEHEDSSRESKERLDKIKRDHEELVRRARERAEELRRRGKLREELVKELEKAIEESERNVEKLARDLERANEESRRSVEELVKELEEANRRLEELLARNVDAEKLVTDHKRVVETILDKARKNLDRHRRAVEDLLRKARENLKKTEELVRKLDEDVR

SEQ ID NO: 17624 - protein, 178 aa, Artificial Sequence; identical to SEQ ID NO: 17623
  Synthetic sequence.

SEQ ID NO: 17625 - protein, 178 aa, Artificial Sequence
  Synthetic sequence.
DAERRLREILRRVTERLKEVKERHKRSSEKSKKSADDVRREHEKLAEELRRKVEELKRRGELREELEKEVEDLLRESEESVRRLEEELKEINERSKRSVDKLERELEEVRRTVEDLIKRNVDTDTVIEELKRRIRELEKRLEENLRRHEELVRRIEEELKRNLKRSRDLLKEIEDKVR

SEQ ID NO: 17626 - protein, 178 aa, Artificial Sequence; identical to SEQ ID NO: 17625
  Synthetic sequence.

SEQ ID NO: 17627 - protein, 182 aa, Artificial Sequence
  Synthetic sequence.
SEAEEVLRRLEELAKRDREENKKVLDDLEKLVREDEERNKEVLKDLEKFIDELDKELRSEGREVVEELEKKLREVVRRVRKKAEDSHRRLEEIVERVKRLLDESSKKVREIVERVKKEVKDLDKDVVRELERLLREWERDNERSREEIDRVIEEARKRNEDSERELDRLIKEVKDRLDEKAR

SEQ ID NO: 17628 - protein, 182 aa, Artificial Sequence; identical to SEQ ID NO: 17627
  Synthetic sequence.

SEQ ID NO: 17629 - protein, 182 aa, Artificial Sequence
  Synthetic sequence.
SDAEDVLRKLKELIDRDTKENDEVLRKHKRLTDEDRRKNEEVVRELRKIITRLDEKLRAEGKELVDEVAKEVDKVVKDVERLLDESHEENKEVNRDLKRLLDESSKKVEKIIREVEEEARRLDKEVLDRIRDLLRRWRERNEESRRRAEKSIRDSDETNKRSREEIKRIIRKLREILKERKR

SEQ ID NO: 17630 - protein, 182 aa, Artificial Sequence; identical to SEQ ID NO: 17629
  Synthetic sequence.

SEQ ID NO: 17631 - protein, 182 aa, Artificial Sequence
  Synthetic sequence.
SDVEKVLRELEELIDRDRRDVEKVIEELRKLIKEDEEENREVLKRAEKMLREIREKLRNSGKEFLDELKRELEKVVEEVERLVKRSHDKLRKIERDVEEVAKRSTEDVKRVVDDVERKAKDIDEKFLRDIRETLKRWKERNEELTRRLREIIREVEERNEESKRRLDELIREAEEDMRRRRT

SEQ ID NO: 17632 - protein, 182 aa, Artificial Sequence; identical to SEQ ID NO: 17631
  Synthetic sequence.

SEQ ID NO: 17633 - protein, 182 aa, Artificial Sequence
  Synthetic sequence.
SEAERVLEDLKRLIDEDRKKLREILEDHKRLTDEDRERNRRVLEELDKIIKELDERLRSEGRELLKKVREELDRVVRRVEDMVRRSHETNKEVNERLKRLLRESTEDVKRIVREVRERARKLDKDVLDKIEKSLRDWERDNERMVKEADRSVKRSDETNEKSREDLERLIEEARRRLKERER

SEQ ID NO: 17634 - protein, 182 aa, Artificial Sequence; identical to SEQ ID NO: 17633
  Synthetic sequence.

SEQ ID NO: 17635 - protein, 182 aa, Artificial Sequence
  Synthetic sequence.
SEVERVLEELEELARRDEEKNKRVEDRLRKLIEDDRRDLRRILERLREIAERLKEEAESEGKEVLDEVRKKVEDVIREVEKLLRESTKRLEDVKREVEELLKRSREEVEEIRERVERKVKDIDEEFVRRIRDLLRRWKEEVDRSEDRIRRELEKWERENEEAEKRIRKIIEDLRREIKKKAD

SEQ ID NO: 17636 - protein, 182 aa, Artificial Sequence; identical to SEQ ID NO: 17635
  Synthetic sequence.

SEQ ID NO: 17637 - protein, 182 aa, Artificial Sequence
  Synthetic sequence.
SKLERVLEELERLIREDEDENKKILDRLKKLIDEDKKENDEIMETLKEIARKLTEELRSEGEELLEEVKKRADKAVEDVKRLLEESRRKVEKIVREVRKLLEDSNRKLEEIIKRVEEELKEADEEVLRRIRELIKEVRRRNDESRERIERLLKEWRERVDASERTIREIIKEIKERVRRARK

SEQ ID NO: 17638 - protein, 182 aa, Artificial Sequence; identical to SEQ ID NO: 17637
  Synthetic sequence.

SEQ ID NO: 17639 - protein, 182 aa, Artificial Sequence
  Synthetic sequence.
SKAEDVLRKLKELIDRDRDENRKVLDELRRLIERDREKNRRIMEKLKKIVRELEEALKVDGKELVKKVEEELRRVVEEVKKLLKESTDELDKIVRDVEELLKRSEEKVEDIERKVREEARELREDVLKRIEDELERWKEEVERSKREIEKLIKEARDENDKSRKTIEKIIREAEKILRDRDR

SEQ ID NO: 17640 - protein, 182 aa, Artificial Sequence; identical to SEQ ID NO: 17639
  Synthetic sequence.

SEQ ID NO: 17641 - protein, 182 aa, Artificial Sequence
  Synthetic sequence.
SEAERVLEELKELIERDEEENRRILEEHKRLTEEDLRENREVMKRLEDIIRELEEKLRTEGKEELDEVKKEAEEVAKEVKRLLEESTEKNKEVNERLKRLLDESNKKLREIVKKVREDARRLSEKVLTDIERLIREAEKRNRDSKREAEKSVKKSDELNERSRRRIEKIIEELRRLVDTRRT

SEQ ID NO: 17642 - protein, 182 aa, Artificial Sequence; identical to SEQ ID NO: 17641
  Synthetic sequence.

SEQ ID NO: 17643 - protein, 182 aa, Artificial Sequence
  Synthetic sequence.
SDVEKFLDELRELIRRSKERVDRMLRKLEELIRRSSEDVERLLKELKELIDDIRRLLDENREKREDIRRLVEELRKRVEDIIRKMEESNKRLRDEVEKIIRELEKLNEEVARVIKKAEDDIRGDELRERIKRLLEEHHKRLREAVEELRKLVEDATEEHERLSERAKRLVEEVKKRVDERER

SEQ ID NO: 17644 - protein, 182 aa, Artificial Sequence; identical to SEQ ID NO: 17643
  Synthetic sequence.

SEQ ID NO: 17645 - protein, 182 aa, Artificial Sequence
  Synthetic sequence.
DEVEKVLRDLEELIRRSETDIRRLLEELKKLIDDTRREVKKVLDDLRRRIKEVLDRIRRNPEKREEIERLVRELKRKVEEIEKRLERLNEEVERKIREIIRRIRETNKTLRKKVRELEKRLRGDEARERLKDTVTKASRRHEKVERDLEKLLEEHHRAIEKLRKELRDLVRKAKEDIDRARK

SEQ ID NO: 17646 - protein, 182 aa, Artificial Sequence; identical to SEQ ID NO: 17645
  Synthetic sequence.

SEQ ID NO: 17647 - protein, 182 aa, Artificial Sequence
  Synthetic sequence.
DEAEKVRREHRELVEDSLRKAEEALKRLDELIKRTEKRVKDVEEELKRLIKRVLDEVRKNREKREDIRRLVKELRDKVREIEDEMRKMNEEVRREVKKVEDDLRRTNRELHEKVKDVERKLKGDEVKRRLRTSDKKVSEKHKELLDRLRELLRRHHESLKRLEERIRKLVTDATRRIEEEEK

SEQ ID NO: 17648 - protein, 182 aa, Artificial Sequence; identical to SEQ ID NO: 17647
  Synthetic sequence.

SEQ ID NO: 17649 - protein, 182 aa, Artificial Sequence
  Synthetic sequence.
DEVEELLKEHRELVKESKKTVEKMLRELEELIKRTRDEVEKVERTHEELVRRVDEVLKRRREVAEDIERLLREIHKFVEDVKEKIKKLNEDVAKVLREITEDIKRTNKELHDVVERVTRRIEGDELKERLKESDKEASDLHEKAREDLERLLKKHHDDLRKIMERLERSDKEAKKRLEEEKT

SEQ ID NO: 17650 - protein, 182 aa, Artificial Sequence; identical to SEQ ID NO: 17649
  Synthetic sequence.

SEQ ID NO: 17651 - protein, 182 aa, Artificial Sequence
  Synthetic sequence.
DEVEKLLKELEDLRRKTREDLERVKKELEELVKRSKDRLREAEDELRRLVEDIERVIREDREAREDIRRLVEELKKKVDDIRRTLEESNEELRRKVERIIRELERANRDVREKVKEVERRIKGDELKKRIRELVKEHTDELRKVKRELEALVEKATEDHERVLRRLEELVERIKREVDKAEK

SEQ ID NO: 17652 - protein, 182 aa, Artificial Sequence; identical to SEQ ID NO: 17651
  Synthetic sequence.

SEQ ID NO: 17653 - protein, 182 aa, Artificial Sequence
  Synthetic sequence.
SDAEDLLREHRELVERSKREVERVLDELRRLIEKSLREVEKVLKELEKLIREILDRVRKNSEKEEEIERLERELEKIVEEIERRIETSNRELKRIVKEIIDEIRRTNKELHDKVRDVERKLRGDRVREELRRSDEKVSRDHEELVKEAERLVDEATKEHRKLKRRIRELVRRAKEEIEKLRK

SEQ ID NO: 17654 - protein, 182 aa, Artificial Sequence; identical to SEQ ID NO: 17653
  Synthetic sequence.

SEQ ID NO: 17655 - protein, 182 aa, Artificial Sequence
  Synthetic sequence.
SKVEDILRRHRELVKKSLDEIRDLLRKLKRLIEESLRRVEEVLRDHERLVREIEDRVRKNREKREELRKLLEDLHRKLEEVEREIRESNKKLAEEVRKIEETIRKTNKELHDTLRDAERKIEGDELKRRLRESDKRVSERHKRATEEIKKLLDRATEEHKKLVKRLRDSDKRVADELDKAEK

SEQ ID NO: 17656 - protein, 182 aa, Artificial Sequence; identical to SEQ ID NO: 17655
  Synthetic sequence.

SEQ ID NO: 17657 - protein, 182 aa, Artificial Sequence
  Synthetic sequence.
DDVDRVRKEHEKLVRDSLDTARKLLEELEDLIRRDKEDVERVLEELKRLIEEIDDRVRRNREKREELRELLKELEKRVRDIVKKNEESVDELRKKVEDIIRRLAETNKRLHDRLRDVERKLRGDELIERLRRSDKRASEEHKRLMDEAKRLVEKAEKDVTELNKDIKRLVKEVEDRLREAER

SEQ ID NO: 17658 - protein, 182 aa, Artificial Sequence; identical to SEQ ID NO: 17657
  Synthetic sequence.

SEQ ID NO: 17659 - protein, 178 aa, Artificial Sequence
  Synthetic sequence.
DEVKKVLDESRELVDRIRRKAKEVDDRDRKLIRDVLEELKKLLEENRKLVEDIRRLLEAGVSEDELRRLLEESRELIKRVKERLDDALRRLEESSKTWKEELDRLLEENEELIRRAEEAGVDKETLRRLHEETERILRDLKRHNDELNDEARKRLKEVKERLDESHDRVRRELEAKER

SEQ ID NO: 17660 - protein, 178 aa, Artificial Sequence; identical to SEQ ID NO: 17659
  Synthetic sequence.

SEQ ID NO: 17661 - protein, 178 aa, Artificial Sequence
  Synthetic sequence.
KDVEEILRKLKELIDEARRRLEKTLRDHEDIVRRAKRRLEELLKRHRDIMDEVRRKVRTKELLDTVREDSKRVVKEAREILEELKRISEKVVEEHKRLSEELKRRLDKILEELERRGVPEEARRRLEEEVRKVRKEIEDVNRRLEKSHKEAEETLRRVEEELKKSHDELERILREIER

SEQ ID NO: 17662 - protein, 178 aa, Artificial Sequence; identical to SEQ ID NO: 17661
  Synthetic sequence.

SEQ ID NO: 17663 - protein, 178 aa, Artificial Sequence
  Synthetic sequence.
DDVEEILRTLRELIKKIKKDLKKVLDDHERIARRAKEELERILRRHREIVERVDRKVRTEEVATRVAETSKRVVDDARRILKRIAEISREVVEDLKRILKEAAEALRELLRRLEEAGIPDEARKKIEDIVREVEDDLRRVAKAAEDSNRKLEKDLREVAERLRKSHEEAEKALRDREK

SEQ ID NO: 17664 - protein, 178 aa, Artificial Sequence; identical to SEQ ID NO: 17663
  Synthetic sequence.

SEQ ID NO: 17665 - protein, 178 aa, Artificial Sequence
  Synthetic sequence.
DDVRRLEEELRRLMEEAERRLRKTLEDHKRIVEEAKRRLEEILREHKRILEEIDKRVRTEEVLDEVLRESKRVVDDARRILKELKETSERVEERHRRLSKELKKLLDEILERLARRGAPEELKKRVEDLVREIRRRLDKVNEDLERSNRELEKVLRDVLRELKKSHDDLERSLRETRR

SEQ ID NO: 17666 - protein, 178 aa, Artificial Sequence; identical to SEQ ID NO: 17665
  Synthetic sequence.

SEQ ID NO: 17667 - protein, 178 aa, Artificial Sequence
  Synthetic sequence.
DEAEKILDELRRLIDEIRRRLRKTLEEHKRILERIRRELEKMLEEHRRIVDEMRRKLRTEELIKEAEDRSREILRRVKEIVDRVREESRDVVRRHEELSRELKKLLDEILERLKKTGLPEEVTRRLEKLVRDVDRDIKRVNKELEKSNRELEKDLRAVEKRLEDSNRDARKKLEDTRR

SEQ ID NO: 17668 - protein, 178 aa, Artificial Sequence; identical to SEQ ID NO: 17667
  Synthetic sequence.

SEQ ID NO: 17669 - protein, 178 aa, Artificial Sequence
  Synthetic sequence.
DDAERILEELKRLMEEVEKRLKDTLDTHREIARRILERARESLKRHEDIAREIERDVRTEELLKRVLEDSERVVRDHERLSREVAKDSKRVLKEHEELSRRVARRLEDILRKLEERGVPEDVKRKIRELVERAKKRLKEINDELKKSDEDLDRKLEDLNRRLEESNEELKRRLDETRR

SEQ ID NO: 17670 - protein, 178 aa, Artificial Sequence; identical to SEQ ID NO: 17669
  Synthetic sequence.

SEQ ID NO: 17671 - protein, 178 aa, Artificial Sequence
  Synthetic sequence.
SDAEKLLEDIRKLTEDVERDLRRSLEELKDLIRRLKKEIEDLLERHKRIVDKVVREVRTEEVLREVKKESDKVLKELEELVDRIKKRLDELLKRHRELSEEIKRRLRELLKRLRDRGVPEEVKERVERLVREVEKRLDEVDKELEEEVDKARKELEKLLEDIDRSDKEARKRLEDKRR

SEQ ID NO: 17672 - protein, 178 aa, Artificial Sequence; identical to SEQ ID NO: 17671
  Synthetic sequence.

SEQ ID NO: 17673 - protein, 174 aa, Artificial Sequence
  Synthetic sequence.
SKEDEIRRLIEDLERRNKEVEETLRELVRETRERIERIKRRLEELIKKSKDEVDDARRKGKVKEELEKKVREIVDESRRLLERLEERVREAVEESERLVERDKEDSRRIKKEIEDIPGSEELLERLERLIDKSRKNVEDIVKRHEDLSRELTERAKAILERHKELTDELREDVR

SEQ ID NO: 17674 - protein, 174 aa, Artificial Sequence; identical to SEQ ID NO: 17673
  Synthetic sequence.

SEQ ID NO: 17675 - protein, 174 aa, Artificial Sequence
  Synthetic sequence.
SEEERIERLIDELRRDNDEVRKRLDKLVKDTERENEEAERRLRRLIEESRREVEKLKAEGKVKEELERDVERIVKESEDLLRESHKEVEEMVRKSRELVEDDKRRSDEVVERVERIKADEELARELEKLIEDSRRNVKRIKEEHEELSRRNRKLLEDILERHRRLTEELRKKVK

SEQ ID NO: 17676 - protein, 174 aa, Artificial Sequence; identical to SEQ ID NO: 17675
  Synthetic sequence.

SEQ ID NO: 17677 - protein, 174 aa, Artificial Sequence
  Synthetic sequence.
SKEREIEELIKELEEEVERLKEELRRIIKKLRDDNKRAEEELERLIRESKEDLDRARKEGKVKEEIEKKLRRIIEESERLVEEDKKKSEEIVKRIEELVKKLEKKVRDVAERVRRIPAAEELRKELEDVRRKLKEEIDRILEEAKRVVDDSRRNAEEITRRHKEATKRLREEVE

SEQ ID NO: 17678 - protein, 174 aa, Artificial Sequence; identical to SEQ ID NO: 17677
  Synthetic sequence.

SEQ ID NO: 17679 - protein, 186 aa, Artificial Sequence
  Synthetic sequence.
SIAERLKELIDRMREDNERAAKELRELIRKAKEESKEVEERLRRRLKELRDRVEELVRRNSEGDKKVREIRKKLEEIIEEIERLLRENEKLVREIEKRIKELIDRDRKRSKEIEDRIRDLIRKLKDLKEMLDRILEELKKLIKESRENLRRILEDLKRLLDESRRHAERITRRLEELIKELKEKAD

SEQ ID NO: 17680 - protein, 186 aa, Artificial Sequence; identical to SEQ ID NO: 17679
  Synthetic sequence.

SEQ ID NO: 17681 - protein, 186 aa, Artificial Sequence
  Synthetic sequence.
KARERLKRLIEEAKRRNEEMEKELDRRLDELRRESKTLEEDLRRSLEELEERIRRLVKRNSEGSEKIERLKRLVEEIKRRVERAIEENKELVRRIIERIKRLIKENRKLSEDIERRIDDLIRKLKDLREMVEEILRELRKLVEDSLEVLERILDDLRRLIEESRKHLEEVKRRLEELKKRLEDEAR

SEQ ID NO: 17682 - protein, 186 aa, Artificial Sequence; identical to SEQ ID NO: 17681
  Synthetic sequence.

SEQ ID NO: 17683 - protein, 178 aa, Artificial Sequence
  Synthetic sequence.
KEVEKILEEIERLIREIDREVKRVKTENEKTVRDIRKRVEEIKEEHKDLTRKLEKLARDGVPEERLREVLKRIEDRTREVIEELRELLRRDEKKVRDMIRKLKDLVKKIEDRVRKVELSDEARKRAEDLLRDAKRRVDEVVEELKKTVEELKEEVRKVEEELKELVKRSEDKVRETER

SEQ ID NO: 17684 - protein, 178 aa, Artificial Sequence; identical to SEQ ID NO: 17683
  Synthetic sequence.

SEQ ID NO: 17685 - protein, 182 aa, Artificial Sequence
  Synthetic sequence.
SEVDKVLKEHEDLVREDKKRLEEILRELKDRLRRDEEELRRIMEELEELLRRLKDVVDKRREDRETLRRLLEELRKKVEEVKRRNDRSVRELEKVVRKVVKENEDSLREVHKRLRDVEKDLRKKEMIDRLRRSDEELKKEADRANEEAKRIVEKIRDTLKKANDKLDEIVERIEDELRRAET

SEQ ID NO: 17686 - protein, 182 aa, Artificial Sequence; identical to SEQ ID NO: 17685
  Synthetic sequence.

SEQ ID NO: 17687 - protein, 182 aa, Artificial Sequence
  Synthetic sequence.
KEAEDVEEEHKRLVEDDRRKLEEIKKTLERLVEEDRRRLEEVVRELKRLLDEITDVLTKRREVEKDLEKLLEELERLVKKVVDENKKSVETLTRTVEKVSRDNKRTLKEVHDRLRDVERKIKDDEVRKRLRKSDKELRDEAREVNKELEAIVKRARDEVKKVNDDLRKIVDEVRETVKEARR

SEQ ID NO: 17688 - protein, 182 aa, Artificial Sequence; identical to SEQ ID NO: 17687
  Synthetic sequence.

SEQ ID NO: 17689 - protein, 182 aa, Artificial Sequence
  Synthetic sequence.
DEVREVKKRLRDLIRDDERELRRVLEELKELVKDDVDKLRRLIEKLRKLLEELRRVATKRREVREELRKLLKELRDEVRKASEENRESVERLERRVREISERNKKSLKELRDVVEDVTRKLRDEKAREELKRIVEEVEEKSRRANKKLKDIVDEMRERVKRANEELDDIVKKITEDLERMRK

SEQ ID NO: 17690 - protein, 182 aa, Artificial Sequence; identical to SEQ ID NO: 17689
  Synthetic sequence.

SEQ ID NO: 17691 - protein, 182 aa, Artificial Sequence
  Synthetic sequence.
REVDEVRKEHERLVKEDEDKLRKIIEDLKKLLREDEKRLREALKRHRELVEEARDVVRKRKEDRERLRKILEDLHRMVRKVSKDNKKSVEDLEREVRRVSTENKKSLEDIHRMLKDVAEKLRSDKVKKELEESDRRVEEKSRRANETLKRIVEEIRKKAEEINRRLKESDDRAAEDIKRVEK

SEQ ID NO: 17692 - protein, 182 aa, Artificial Sequence; identical to SEQ ID NO: 17691
  Synthetic sequence.

SEQ ID NO: 17693 - protein, 182 aa, Artificial Sequence
  Synthetic sequence.
DEARRVKEELDKLRREDEELLRRLMEKLKDLIRRDTEELKRIIDELRELVERLEDELRRRREDRERLRELLRRLEDRVRRVSDKNRKSLEDLERVVEEVSRENEKTVRRLEKKVKEVEKDLKDEKVREELRRIVDRVKKEVDRANRELEDIRREVEEISKRANEELERIVTEAADRLRKVAE

SEQ ID NO: 17694 - protein, 182 aa, Artificial Sequence; identical to SEQ ID NO: 17693
  Synthetic sequence.

SEQ ID NO: 17695 - protein, 182 aa, Artificial Sequence
  Synthetic sequence.
SEAEKVIREHERLLEEDRRRLEEALRTLERLAERDEERLKEAEERHRDLLRKLEETVKKRREVREKLRKILEEIHRTVKKVSEDNEKSLRELKEKVDRISRDNEETLERAHRRLRRVEERLEKDEVKRRLRKSDEDVKRRAEEINKEAKEIVDDVKKKSDEANKRLKDSDKRVAERLKEAED

SEQ ID NO: 17696 - protein, 182 aa, Artificial Sequence; identical to SEQ ID NO: 17695
  Synthetic sequence.

SEQ ID NO: 17697 - protein, 182 aa, Artificial Sequence
  Synthetic sequence.
SEVEKVIEDHDRLLKRDEELLRKIAEDLKDLVRRDEERLRRATEKLKRLLETLEDVLRKRREVREDLRRLLKELKEAVKRISTENKKSLDKLREDVERVSRANEKSLRDAHRKLKDVEDKIKDKEVKDKLRRSDERVEKRSRDANRELEEIVRRARKKSEEANRRLEEIVERAEKRLKEAED

SEQ ID NO: 17698 - protein, 182 aa, Artificial Sequence; identical to SEQ ID NO: 17697
  Synthetic sequence.

SEQ ID NO: 17699 - protein, 181 aa, Artificial Sequence
  Synthetic sequence.
SEVDKVVEESKTSMRRLERRHREATKESKKSIEEIEETVERVKRESEKSVKKLDDLVKNGSDKSALERALEENRRLIEEIKRTLDRLLETNKRLIEEISRESKELLEENKELIERIEKDVKDEEVRRRLRKIHKELEERLRRMNKRLRELHRELEEKVKEVKKELEDIHRKARERVEKAKE

SEQ ID NO: 17700 - protein, 181 aa, Artificial Sequence; identical to SEQ ID NO: 17699
  Synthetic sequence.

SEQ ID NO: 17701 - protein, 181 aa, Artificial Sequence
  Synthetic sequence.
EELKEVRERSKESIKRIKEEHERVEEELKDIKRDIDRRHKEVVDESRESVKRVEDLSRADVDEEELRKLLERNKELIDRASEESKRMLEDLERVVREASEKSKRLLEENKKLIDDIERRVKDEEVRRELREIHDELRKRVEEANKRLEDILREIDKRLKELNEELKRIHDRARERLEEERR

SEQ ID NO: 17702 - protein, 181 aa, Artificial Sequence; identical to SEQ ID NO: 17701
  Synthetic sequence.

SEQ ID NO: 17703 - protein, 181 aa, Artificial Sequence
  Synthetic sequence.
DEIREVIKESKKSVEDVKRRHEEAKRESERSLKEIRELAEEVKERLRDLLRRIRKLVKDGVDEKTLEELLRRIEELLKRIKDRLDEMLERNRELIKKISDDSERLLRDNERLIRDIERKVKDEEVRRRLRKIHKEAEERLRRANDELRKLHEEIKKTVEKIKRELDKIVEEIERDVRRDRK

SEQ ID NO: 17704 - protein, 181 aa, Artificial Sequence; identical to SEQ ID NO: 17703
  Synthetic sequence.

SEQ ID NO: 17705 - protein, 181 aa, Artificial Sequence
  Synthetic sequence.
SRVEEILRDSKRSMDEARKEHERVLRELRDRLRRLDERHRRLLEELKRLLREVRELTRAKVSERELREALKTIRELLRKISEESKRLLEEIEEVLKRISDTSKRLLEENKKLIDDARREVKNEEVLRRLDDIHRRIKRELKEVNDRLEEIVREIRKRLKEVNERLKEIVDAVEEVVRRAEK

SEQ ID NO: 17706 - protein, 181 aa, Artificial Sequence; identical to SEQ ID NO: 17705
  Synthetic sequence.

SEQ ID NO: 17707 - protein, 181 aa, Artificial Sequence
  Synthetic sequence.
KRLEDVARESKKSIDEIRKRHKEATDESNKSIEEARRIHEEVLRTLKELLDRVRKLIESGVSERALDEALRTIKELLERISRTSEELLRRNRELIERISKESKELLDTNRKLIEDIEREVDEEEVRRDLRRIHERLREEAEEVNERLERNHEELEREARKVNEELRKIVEDARREVERAKD

SEQ ID NO: 17708 - protein, 181 aa, Artificial Sequence; identical to SEQ ID NO: 17707
  Synthetic sequence.

SEQ ID NO: 17709 - protein, 181 aa, Artificial Sequence
  Synthetic sequence.
DDVEEIKRRLEELLERLKEDHKRMLEESRKSVEDAEKIVEEVKKESEDSIREIKKLLKDGVDEDTLRELLDRNRRLIERIKEDLDRLLKENRELIKKISERSEKLLREIRKVVKEAKDRVKDEKVKRELDEIVKRIEDEARKVNEELKRIHDDAERKVRKVKEDLERIHRELKKRVEDDRT

SEQ ID NO: 17710 - protein, 181 aa, Artificial Sequence; identical to SEQ ID NO: 17709
  Synthetic sequence.

SEQ ID NO: 17711 - protein, 181 aa, Artificial Sequence
  Synthetic sequence.
KEDERVEEELRKLLKELEDRHKKASEDSRDSIRRIRERARTVLEELKRVLEDIDRLIKADVREEELKRALEELEKLVREIKKELDDLLDKNRKLIEKISKESRELLEKIERVLEDIRRRVKDEEVKRRLDKIVDDVRERLKEMNDRLRRLHEELKRELERIKEELDKILEEVKRRLEEARR

SEQ ID NO: 17712 - protein, 181 aa, Artificial Sequence; identical to SEQ ID NO: 17711
  Synthetic sequence.

SEQ ID NO: 17713 - protein, 178 aa, Artificial Sequence
  Synthetic sequence.
ELEERLTRSNDELRKELKRMNEELRRKLEEIRKELERLNEKLREIIERIKEDLDRRARDKDKVKRVTDELRELLKRAHDISRELLKTLEKLIREIHKLSKELLEESDRLLDEARKKVKGRELAEEFLRRHKELVERIREIHERLRERLEELLRRIEELHKRLEDELREVLKRIEDEIR

SEQ ID NO: 17714 - protein, 178 aa, Artificial Sequence; identical to SEQ ID NO: 17713
  Synthetic sequence.

SEQ ID NO: 17715 - protein, 178 aa, Artificial Sequence
  Synthetic sequence.
KKEEDLDESNKRARDELKEMNDRLRKIVKEIEDELRRLNEEARRSNEELRRRVEERLKDKETADRVLKESEDLLRTIHKLSRDLLKELEDLLREINKRSRELLEESDRLIDRIRKEVKGDELAKKVIKEHEDLVREVLKRHEDLLRRARELLKKIKEIHDRLLDEHRKLVEDIEREAT

SEQ ID NO: 17716 - protein, 178 aa, Artificial Sequence; identical to SEQ ID NO: 17715
  Synthetic sequence.

SEQ ID NO: 17717 - protein, 178 aa, Artificial Sequence
  Synthetic sequence.
DRERELEKSNRELERELREALKRVKEIIDRIRKTLEDMNRRLKRSNEEAERRLREKARDKDKVDKIVTESKKLVEDIHRTSRELVRELEKLLREMERILRELKRRSEKLIKEIRDKVRGDELAERVIREHRRLAEEIRRLIEKLKREIEELLERARRTHEDLLRKHKELVKKVDEEIR

SEQ ID NO: 17718 - protein, 178 aa, Artificial Sequence; identical to SEQ ID NO: 17717
  Synthetic sequence.

SEQ ID NO: 17719 - protein, 178 aa, Artificial Sequence
  Synthetic sequence.
DDEEEVKRSNDELRKEIKEAEERLEKSNRELEEDLRRMNRELEESNKRLRELLEREARDEEKVRRVIRESERLVEEIHKRSKELEERSRELIKRIRDELRKLIERSDRLLKDVKDKVRGKELAEDMLRRHRDLVREIRELIDKLTRDHDRLVKEAREIHKRLTERHRKLVEDIKRETD

SEQ ID NO: 17720 - protein, 178 aa, Artificial Sequence; identical to SEQ ID NO: 17719
  Synthetic sequence.

SEQ ID NO: 17721 - protein, 178 aa, Artificial Sequence
  Synthetic sequence.
SKEEELEKSNRKLKEDLERMNEDLKRILREVEDVLRRIEEELEKLVRELEEILKRRVKDEDKVREMVKRAKDLLDEVREVLKRLRDRLEELIRRIHERSKDLLRESKRLIDEIRRKVRGDELAEEVIDRHRDLVRRIKDEHRKLTDELRKLLEDIERLAEEAKRKLEKLIEDVEREAN

SEQ ID NO: 17722 - protein, 178 aa, Artificial Sequence; identical to SEQ ID NO: 17721
  Synthetic sequence.

SEQ ID NO: 17723 - protein, 175 aa, Artificial Sequence
  Synthetic sequence.
SSEERVKKVVEELEDLIRKIREEHKDSIRENRKVVEDIRERVKELITELKKELEDKLKDDKDIVREVEKILKEVKEALDRVAEENEEVDRRSEESLRRIEEKVRRAIRTVEELVRRNVDTEDLLRRLRKLIEDVFREARENLKRHKKMSKEAKEKLEELLKRLRDLIKEAREKIK

SEQ ID NO: 17724 - protein, 175 aa, Artificial Sequence; identical to SEQ ID NO: 17723
  Synthetic sequence.

SEQ ID NO: 17725 - protein, 182 aa, Artificial Sequence
  Synthetic sequence.
SEADEVLRTHEELVRELEERAKEILRRHRKLSEESERKAREVLKTLRDLIRELKKLADEGSRRREDLSRRAERIKEEITRVVEELERENRRIDEELKKLVKELEDRMKEINDRLRELLKRDKDEEIARRIEESEDKSRRIIDEVRERVRKSIEENKRVVEEVRERVERLIKELDKIVEDIRR

SEQ ID NO: 17726 - protein, 182 aa, Artificial Sequence; identical to SEQ ID NO: 17725
  Synthetic sequence.

SEQ ID NO: 17727 - protein, 181 aa, Artificial Sequence
  Synthetic sequence.
DELEKVIEELKRRIEEVKKELTELNKELKDVSKEIEDVIRDLNRELKKLSDRIKELADRDNNDDLLRKLHKRLEDLHRETKERITEMLERLERLHRDTKRRIEEVLREIEKRVDEIKKKTTDEEIRRRLDEVLRKAEEDLRRAEESNDEHLRKSKEDVERARKSNDKHLDDNRKTLEEATR

SEQ ID NO: 17728 - protein, 181 aa, Artificial Sequence; identical to SEQ ID NO: 17727
  Synthetic sequence.

SEQ ID NO: 17729 - protein, 186 aa, Artificial Sequence
  Synthetic sequence.
SDVEDLLRRLRKLTKDIEERVKELNKKLEDVSRDIKRRVEEVLKKLEDVLRKARDEVRKLGDDGGAEELLKDILRRIAELLRELDETLKRVDKKIEDIVEESKELLRKVNEEVKKVVDEIRERNKDLDRAEKELRKILEDHKEISDRVRRSNEKLLRDHRRTSETVKRRLEKVLEDIRKELEDAKR

SEQ ID NO: 17730 - protein, 186 aa, Artificial Sequence; identical to SEQ ID NO: 17729
  Synthetic sequence.

SEQ ID NO: 17731 - protein, 180 aa, Artificial Sequence
  Synthetic sequence.
DVEERVKTIVDDIERTLDEVRRRLEESHKRLEDALKEVDDRLKKLLKETEEVLKRIEDERGKREELDDVRRRAEKSARDLKRLLDEIRKESRRILEELRKLLDDIRKEVREVLERLARVKEKEKVEELLRRLREILERVTRRLEEVLKRHRDLVEEVKKELERVLEDHKRLSEDAERRAR

SEQ ID NO: 17732 - protein, 180 aa, Artificial Sequence; identical to SEQ ID NO: 17731
  Synthetic sequence.

SEQ ID NO: 17733 - protein, 180 aa, Artificial Sequence
  Synthetic sequence.
SVEEALEKSVKESEEVLKKAEKELRESHEDAKRVLKEVRDELERLMEETKKELRDVERKRGRRDELERIKKRVEDSLRKLEKLLKEVKERSEDLLRKLKTLLREAKKRNDEVREELARVRDKEKVDRILKKDKDLIDRVRRELKKMLDRHRKLVEDVKRELEEALKEHKDDSKRVRDKLK

SEQ ID NO: 17734 - protein, 180 aa, Artificial Sequence; identical to SEQ ID NO: 17733
  Synthetic sequence.

SEQ ID NO: 17735 - protein, 180 aa, Artificial Sequence
  Synthetic sequence.
DIEDRLERVVRDAKRVLADVEDKLRKLLEETERMLRRVKRELERSHEEAEEELRRVEEERGRTEDLERVKRESEEVVKRVKKILDEIREKAKDSMRKLKELLKRVEERVREVLEELARVDDKKLLEDILRKLRKIIEEVKRTLEEALKRHRDLTRKVVEELEDLLRKHRRIVEEVKKRLK

SEQ ID NO: 17736 - protein, 180 aa, Artificial Sequence; identical to SEQ ID NO: 17735
  Synthetic sequence.

SEQ ID NO: 17737 - protein, 180 aa, Artificial Sequence
  Synthetic sequence.
DIEDELRKSVKRSEEVLREVEERLKRLLEETKEVLTRARETNEKSHRELEDKLRKIEEERGEDRTLDEVRRESEELLKESEKTLRELLERAKKSVKELKELLDEVRKRNKEMEERLRRVTDESKLRELLKRDKKEIDDVKRELERLLEDHKRLTEEIRRRLKRLNEKHREIVKRVEKELK

SEQ ID NO: 17738 - protein, 180 aa, Artificial Sequence; identical to SEQ ID NO: 17737
  Synthetic sequence.

SEQ ID NO: 17739 - protein, 180 aa, Artificial Sequence
  Synthetic sequence.
DVEDRLRESEKRSEKTLKDVEERLRRSHEDLEKKLREVEKRLRDSHREAEKTLKRVKEEKGERETLREAEKTSRKVLEDLKRLLDEIREESKRIVKKLKDILDEARKRNEEVREELARVDDKEVVRKILEDDKRLIEEVKKELERVLEEHRRLVEKVKRELEEVLKRHKEIVDDVRRRLE

SEQ ID NO: 17740 - protein, 180 aa, Artificial Sequence; identical to SEQ ID NO: 17739
  Synthetic sequence.

SEQ ID NO: 17741 - protein, 180 aa, Artificial Sequence
  Synthetic sequence.
SIEDELRKIADEARKVLDKVRKDVERSHREAEKKLREIDKRLKDSARDSKRVLDEVREERGEREELEKARKENEEMLEKLRDLVRKVKKESEEMVRRIRKILEEVKREVEKVLEELARVKEEEKLERILRKLKKIIKDVEDELRKLLEEHRELVKKVEKDLRDLLERDRELIEEVERRLR

SEQ ID NO: 17742 - protein, 180 aa, Artificial Sequence; identical to SEQ ID NO: 17741
  Synthetic sequence.

SEQ ID NO: 17743 - protein, 180 aa, Artificial Sequence
  Synthetic sequence.
DIEDRLRTSVKKSRDVLEEVERKLRDSHRRAKEVLDKAREDLRKSKEDSKRVLDDVRRKRGDREKLDKARRDNERVEERAREILDRVRRDSERLLKRLKDLLDEVRKRNEKVREELARVKEKEKLEDVLRRDEELIDRVRRRLERILEEHEELVKRVEEELRRVLEEDRKLIKRVKEELE

SEQ ID NO: 17744 - protein, 180 aa, Artificial Sequence; identical to SEQ ID NO: 17743
  Synthetic sequence.

SEQ ID NO: 17745 - protein, 180 aa, Artificial Sequence
  Synthetic sequence.
DIEDALRDSERESEEVLKRAREELEKSHKEVKKRLDEVEKTNKDSVDESKKVLDDVRRKRGELEKLKEATERNKRVLDTSRTILKRLLEESEEMVKRARRILDEARRRNEEVAEKLKRVTDKELLKKILKEDKELIKRVEEILRRILEEHRELVRRMKKELDELNKRDKELIDRVREELT

SEQ ID NO: 17746 - protein, 180 aa, Artificial Sequence; identical to SEQ ID NO: 17745
  Synthetic sequence.

SEQ ID NO: 17747 - protein, 180 aa, Artificial Sequence
  Synthetic sequence.
DLEEEAKKSVRESERALDEVRKRLDRVRKEVERELRKVEEDLRRSHRKLEDILRRVAEKRGPAEALERIEEDSRRVLEELKKLLDDLRRRLTELAKRLEELLRRLEEDNRRVLEEAKRVKDEEAARRILERDKALIEKAREDLKRILDEAREILKEAAKRLEDILRKHKKIVEDVARELE

SEQ ID NO: 17748 - protein, 180 aa, Artificial Sequence; identical to SEQ ID NO: 17747
  Synthetic sequence.

SEQ ID NO: 17749 - protein, 188 aa, Artificial Sequence
  Synthetic sequence.
KIEEEVEKLIRDARRIIEEMRESTERLIERNEEVLETVRREVEKLLRDLERILEKIKRELEGDERVKELLRRVEKLLREVKKRVEELERENREELRKLEERSRKLLEDVKRLADELRRRVEKMSKDNVPEEVLRRILEEIRKIVEDVRRELDTLNRELEELTKESRRRAEELLRRLKEIVKKVERDAE

SEQ ID NO: 17750 - protein, 188 aa, Artificial Sequence; identical to SEQ ID NO: 17749
  Synthetic sequence.

SEQ ID NO: 17751 - protein, 181 aa, Artificial Sequence
  Synthetic sequence.
REVEEILKEVETLIRENKKKLEEWLRTHEKLNEDLERKAREILTRHRRENEDLKRVADDGKDKRDIKRKIEKLERETRKLIDELKKEVEEVIRRSKEAVKRNNDEDREMVEKLKEDLKRVDKDEVKRRIEELIKKSKRVNDEANRRVDKLVKDTRDKIREIEERIRKLIEESKKLLEDKRR

SEQ ID NO: 17752 - protein, 181 aa, Artificial Sequence; identical to SEQ ID NO: 17751
  Synthetic sequence.

SEQ ID NO: 17753 - protein, 181 aa, Artificial Sequence
  Synthetic sequence.
REVEEILRRVRELIERNRKEVEDWMRRHRRVNEELKRKAREILERIKEMLKTLKEVLERGRDKREIAERVKKVEKEVEELLRRLKEEVERLAKESEDVVRKNNKKDDEVVKELRELLKRVKDDEAAKRIEKLIKESRERNEEVNRKIKKLIEDTRRVVEDVRRKVEELVKRLRTELDRARK

SEQ ID NO: 17754 - protein, 181 aa, Artificial Sequence; identical to SEQ ID NO: 17753
  Synthetic sequence.

SEQ ID NO: 17755 - protein, 181 aa, Artificial Sequence
  Synthetic sequence.
SEAEEIAKRAKEAIERNRKLAEEWAKRARDAAERLKELYKRIAERHRKANEELRRAAERGEDLDKIREDAERAIEETERLIEKANRETRKAIEELKKAAKENNDEDRKAAEEAKKLAEKVKDDEARKRIRELIERSKKANKEANDRARKLAEDAKRLNEEANERAKRLAEESREAIKEAER

SEQ ID NO: 17756 - protein, 181 aa, Artificial Sequence; identical to SEQ ID NO: 17755
  Synthetic sequence.

SEQ ID NO: 17757 - protein, 182 aa, Artificial Sequence
  Synthetic sequence.
REVEEVAKELRELIKRTEDLIRRALERNRKLVKETRDLIEKVLRDLRDLLRRLEEEARRRGKDEDVLRTLRRLLEELKKKVDEVLKELRRSHEELKKHSDKVLKELKESHDRLKEKVDEVRRRGVDDKTLRDLLREHKELVEEAKRRLEESNDEHRREVEDAERRIEEIVRDAKRVVDEIER

SEQ ID NO: 17758 - protein, 182 aa, Artificial Sequence; identical to SEQ ID NO: 17757
  Synthetic sequence.

SEQ ID NO: 17759 - protein, 182 aa, Artificial Sequence
  Synthetic sequence.
SEVEKVVTELRRLIERLEEVIRRALDTNRKLLEDTEKEAERMMRKLEELIKDLERDLREKGRNEEVEERLDRLLETIKRVVEEVKERLERSHERLKRHSEEVLRTLERILEEIERRVREVERRGVDKETLRKLLKELREVLDKAREDLERSNRDHRRAVEEIKERLERLLKKLEDVVRKAKE

SEQ ID NO: 17760 - protein, 182 aa, Artificial Sequence; identical to SEQ ID NO: 17759
  Synthetic sequence.

SEQ ID NO: 17761 - protein, 182 aa, Artificial Sequence
  Synthetic sequence.
KEAEEAAKKLKDLIKEDRERARRALEENKRLIDELRKAAKEALDRNRELLERLRDEARKRGNDEEAAETLDRLLKELRDHSKKAAEELEKLLEDINRHSEKAARENEESLKRIREEAKKAKDGNADKDTAEDLLRRATRDSEEAKKKLKKSNEEAAKAVEEAKERLKRSVDEATKAVEEAKR

SEQ ID NO: 17762 - protein, 182 aa, Artificial Sequence; identical to SEQ ID NO: 17761
  Synthetic sequence.

SEQ ID NO: 17763 - protein, 178 aa, Artificial Sequence
  Synthetic sequence.
SEVEKALEESKESLKTIKKIAKDVLTESEESLRRTKKLIEEVLEASKRSIEELKRLSEADTREKDLDKLLDDNRRLVEKIKKELDDSHRDNRRLVKEIKETLERLLRENKKLVEEIRKAGVDEDELRRLHEDVKRLVEEIAKRLDELHDRHRETVKRAKEELDKLHDRARKEVEDDKR

SEQ ID NO: 17764 - protein, 178 aa, Artificial Sequence; identical to SEQ ID NO: 17763
  Synthetic sequence.

SEQ ID NO: 17765 - protein, 178 aa, Artificial Sequence
  Synthetic sequence.
SEVEKVLKDSEKSIEDAERIARDVLRKSEESIDRIRRIAEEVLKESEKSIRDAKKLAEDGVSEEALKRVLDTNKELVDRIKKALEDALRRNEELVRRIKATLDDLLRKNKELVDEAKKAGVDERELDRLHEKLRRVVEEIEKELRESNRKLEEVLRDIKRKLDDLHRKAREILERIRK

SEQ ID NO: 17766 - protein, 178 aa, Artificial Sequence; identical to SEQ ID NO: 17765
  Synthetic sequence.

SEQ ID NO: 17767 - protein, 178 aa, Artificial Sequence
  Synthetic sequence.
SEVEEVLKRIRDVIKTMEDRAREVLKESEKSIKEIRDTIREVLKRSEDSIRRIDEELKKGVDEKDLDKLLRDNRELVRKIKEELDELLKENEKLVRDIERELEELLRRIEELVKEIKKRGVDKDRLDELLKRAEEVLRKIKEDLRRSNEKLREEVKEAKKRLDDLHRELEDVLREAKR

SEQ ID NO: 17768 - protein, 178 aa, Artificial Sequence; identical to SEQ ID NO: 17767
  Synthetic sequence.

SEQ ID NO: 17769 - protein, 178 aa, Artificial Sequence
  Synthetic sequence.
KETEEAEKLAREAARRSEKLAEEAEKRAKEAIDESKELADRARDTARRADEDLERLAREGADEEALERARERARRLVEKAKEDLKRSHEKAKKLVEEAKKRLDESNKDAERLVREAKKAGAEREKLDDLLRRHNEKVKRAKERLDRLLEEHEKRIRDAERDLERLERELKKKAEDKRR

SEQ ID NO: 17770 - protein, 178 aa, Artificial Sequence; identical to SEQ ID NO: 17769
  Synthetic sequence.

SEQ ID NO: 17771 - protein, 178 aa, Artificial Sequence
  Synthetic sequence.
SETEEALERLRKMIEDSRRLAKKIREDLREMIERSRRLAEKVRRDDEKSSEDLRRVTEEGRDSEVLRKLLEENERLVREIKADLDRSNEEAERLVRRVKRELDKSNEELKRLVERIKERGVDKDRLDRLLEEHNRIVKEIKEDLDRLLREHNEIVKRIKDDLDRLHEENRRLLEESER

SEQ ID NO: 17772 - protein, 178 aa, Artificial Sequence; identical to SEQ ID NO: 17771
  Synthetic sequence.

SEQ ID NO: 17773 - protein, 177 aa, Artificial Sequence
  Synthetic sequence.
SKEDLVRELKKKLEEVVKRSREESERSLRKLEKVIRDFRRESERLKKESRDVVKKAREDGLPEDVLRDLERLLREDEERNREANREIEKLLREIEKRNREVNRENEDTLRRIEDKLRKDGADEEVLKEIDDLIRRDEERLRRVLRESEELIKEIKKRAEEMLTRSKKLTRDIEEKTR

SEQ ID NO: 17774 - protein, 177 aa, Artificial Sequence; identical to SEQ ID NO: 17773
  Synthetic sequence.

SEQ ID NO: 17775 - protein, 177 aa, Artificial Sequence
  Synthetic sequence.
RDREELRRLEEELRRVFEESRRRSERSKKELDKIVKEAEKASKRSLDKLKRVFDELRRRGLPEEVLDELKKLLDEIERVNRDVLKKIRELLREIEELNREVIDRNKKTLDKITEDLRRRGADEDVLRDARELIERDREELERVLRDSDRLVREIKKRIEEMLKRSEDLIEEIERRAR

SEQ ID NO: 17776 - protein, 177 aa, Artificial Sequence; identical to SEQ ID NO: 17775
  Synthetic sequence.

SEQ ID NO: 17777 - protein, 182 aa, Artificial Sequence
  Synthetic sequence.
SEVERVLKEIEDLIEEIERRAKTVLEEIDKLTKEIEEVVKRMLDRDRELIKTAEDLLRKNKESREELKKMLEDSRELNTRLKKRIRELHRESKELVDKIRKELDDLLKRIEKRVKEIKDRLRDDRVRKALEDLLRKVEEVVRRVREELKKLERKDREVVRKVEEDSERSLRELEKVADEARK

SEQ ID NO: 17778 - protein, 182 aa, Artificial Sequence; identical to SEQ ID NO: 17777
  Synthetic sequence.

SEQ ID NO: 17779 - protein, 182 aa, Artificial Sequence
  Synthetic sequence.
SEVEKVLRELKELTRRIREEAERLLREDERLLREAERIARELLETNKRLIEEIERRLRERKESKEELDKLLKESEDLNREIKKTIDDMVRKSEKLNREITETLDRLHKESKKVVDDIKKRSRDERVKKDLEEVRKRDREVVEEVRRRSEKSKEDVRRLVEKIRKDSEDSLKELKEVVEEARR

SEQ ID NO: 17780 - protein, 182 aa, Artificial Sequence; identical to SEQ ID NO: 17779
  Synthetic sequence.

SEQ ID NO: 17781 - protein, 182 aa, Artificial Sequence
  Synthetic sequence.
DEVEKMLEELKRLTDKIREDAERLLKRSEELTEEIKRLIDELLKEIEELIKEARDIVRRNPESREELDRVLEEIKRLVEKILRDIEDMLRKNEELVRRIKETIKRLHDESKKRVKEVEDRLRDERVRRELEKVEREDRKVVRDAEEELKKSRKKSEDVVKEAKERLEELLRRVKRVVDEVRR

SEQ ID NO: 17782 - protein, 182 aa, Artificial Sequence; identical to SEQ ID NO: 17781
  Synthetic sequence.

SEQ ID NO: 17783 - protein, 182 aa, Artificial Sequence
  Synthetic sequence.
SEVERVLKEIEELTRRLREEAEELLERSERLTEKIRRRAEELLKRNEDLIEKIERDLRRNREKREELEKMLKTSEDLNREIRDELKKLLEENEKLLRDIKRRIREMHKRSEDLVREIERRLTDDRVKKALDELRRRDREVVKRLEEELEKSKKKSEDVVREVEEKSERSKRKLERVADEARR

SEQ ID NO: 17784 - protein, 182 aa, Artificial Sequence; identical to SEQ ID NO: 17783
  Synthetic sequence.

SEQ ID NO: 17785 - protein, 179 aa, Artificial Sequence
  Synthetic sequence.
SEAEKLLKEDEDLIRKARDEIRKVLEDDERLIEEVERKSREMLKRIKEIIDDMRKRIRGDELLEEARERIERLIKTLEDLNRKSEKENRDSLRRLERLLEELDRLNAKSLDELRKRIGELKEVVEEVRKSRKKSEDVLREVERELKKSFEKSKRVNDDSKKKLDELKREADEVIKRLKD

SEQ ID NO: 17786 - protein, 179 aa, Artificial Sequence; identical to SEQ ID NO: 17785
  Synthetic sequence.

SEQ ID NO: 17787 - protein, 179 aa, Artificial Sequence
  Synthetic sequence.
SRAEELLKRDEELIDTVRRRIEKMLREIKEIIDRVKRKSEKMLEDDERLIREVEKRVRDEDLLREVAERNKKTIKEIRDLNDRSRKEIKDLIRRLKKLLDEAREENEKSIRELRKEAGQLEEVLRELEKSRKKSEEVLERVKRELEKLERRAEEVNKESEDRLRESEKESKKVIDELRR

SEQ ID NO: 17788 - protein, 179 aa, Artificial Sequence; identical to SEQ ID NO: 17787
  Synthetic sequence.

SEQ ID NO: 17789 - protein, 179 aa, Artificial Sequence
  Synthetic sequence.
RRAEELLRTIKEIIKRIDDELKRVLDDDDRLIDELRKESERLLEEIERIIRRIEREVRGEELLKRVTDIIRELERRLEELNKRSRDLNKRSIEKLRELLERVKREIEDLIRKLEKEIGEREEVLRELRKLEEEAKAVIDKARRELERSERKSEELNRESKRRLEELSRRAKRVIDELRK

SEQ ID NO: 17790 - protein, 179 aa, Artificial Sequence; identical to SEQ ID NO: 17789
  Synthetic sequence.

SEQ ID NO: 17791 - protein, 179 aa, Artificial Sequence
  Synthetic sequence.
DEVRRLLKEIEDIIRRIEEDIRRMLEKDRKLIEEVERKSKEMLDRDKRLIEELEKRLRGEEFLEEAERRNRKTIEDIRRLNRESEKENEKSIRDLEELLKRVEEEIRRLVKKLTDRIGELEEAVRELDRLRREAEEVLDRVRKKLDKSRKDSERVNEESERRLERSAEESKRVLDELRR

SEQ ID NO: 17792 - protein, 179 aa, Artificial Sequence; identical to SEQ ID NO: 17791
  Synthetic sequence.

SEQ ID NO: 17793 - protein, 187 aa, Artificial Sequence
  Synthetic sequence.
DVREELKKVVDKAEKVSRKSRDDLDKVRKRVEEVNRDNERRLREIAKKVKEVLRDIDRKRRDESLKRLIDTIEKLLRDLERTNEKLDDESRKLLEDLARKVEELNDRARKELERLRERVKKVEEDNKPKEVVKRLLEDVDRLIREVEKESKRLLDEIEEMIEELKRRAEENLKTIEDIIKDVTEKAT

SEQ ID NO: 17794 - protein, 187 aa, Artificial Sequence; identical to SEQ ID NO: 17793
  Synthetic sequence.

SEQ ID NO: 17795 - protein, 179 aa, Artificial Sequence
  Synthetic sequence.
REVEEVLKTVRKLIEELERSSRKSLKEVKELLEKLEEDARRSLKRVKELLKELEDRSRTVDSKDIKRVVEEIEEDIRRSNKELEDLLREIRRKIEESNKENRKRAEDIIRELAKALKDVDEEAKKRIEDLIRELEELLRESSDRHRKLDEELKKLLKDVTDAHRRLMEELRKLLEDIET

SEQ ID NO: 17796 - protein, 179 aa, Artificial Sequence; identical to SEQ ID NO: 17795
  Synthetic sequence.

SEQ ID NO: 17797 - protein, 179 aa, Artificial Sequence
  Synthetic sequence.
DEVETILRDIKRLLREIEELARKSSKKFKELLERLEETARRSLTRIERLLEEVEDISRTVDRKEIEDKVREIKKEVDEMNKRLEDELKKIKDDLERSNEELRRLIEEIKDRVAKRLKDVDEDAAREIEKLKRELERLLEEASRTHEELTRRLEKLLEDATREHERLKRELEKLLEDIKK

SEQ ID NO: 17798 - protein, 179 aa, Artificial Sequence; identical to SEQ ID NO: 17797
  Synthetic sequence.

SEQ ID NO: 17799 - protein, 179 aa, Artificial Sequence
  Synthetic sequence.
REVEEILRKIRELLEELRKRVEESRRRIEELLKKLEEEVRESEKDVRRLLRELEEISRTRRREEIARRMEEIKEKARKSNEELKKLMEEIKERVKRVNDELRKLAEDIKEKVRKDLKDVDEEAAKEIEKLVKELEELLKRASDKHRKLSKDLEDLLREVTERHRRLEKELEDLLREIER

SEQ ID NO: 17800 - protein, 179 aa, Artificial Sequence; identical to SEQ ID NO: 17799
  Synthetic sequence.

SEQ ID NO: 17801 - protein, 179 aa, Artificial Sequence
  Synthetic sequence.
SEVEKLLEEARRLLKELEDSSRRSVEEAKRLLEELKRRVEESVRRIRELLKDLERLSSRVDREEIEKEVRRIEEDVRRSNDELRKLVEDILRKLRKVNEENADLVRRIITRLRDALKDVDERAKEALRELEKRLRDLLRDSSRLHEDLARDLKRLLDEVTEEHDKLRRELRKLLEDIKT

SEQ ID NO: 17802 - protein, 179 aa, Artificial Sequence; identical to SEQ ID NO: 17801
  Synthetic sequence.

SEQ ID NO: 17803 - protein, 179 aa, Artificial Sequence
  Synthetic sequence.
SEVEKVEEDVKRLLKEIEDSSRRSLEKAKRLLEELRRSSEESLKRIRDLLEELRELSRTVDSKDIADRARKIAKEVDDSNKRNRELVKRIIEELERVNRENEEKLKKIKEDLRRSLKDVDEEAKKRIEELKRELEELLKKSSEEHKKLVKELKELLKKSTEDHEKLKRDLRKLLEEIRT

SEQ ID NO: 17804 - protein, 179 aa, Artificial Sequence; identical to SEQ ID NO: 17803
  Synthetic sequence.

SEQ ID NO: 17805 - protein, 178 aa, Artificial Sequence
  Synthetic sequence.
DSEDLMRRVKEELDKLVKDSRKRSEDLKRENEELLRRSEEALEKSVRDADRLFEEIKRTKDKKEELLRELKKLLDELREHSKRVLERNREILERNKKRNKEANDRNKEILDRIREEIKRKGADRDVLKTLKDLIRELKRHSEEVEREDKETTDRLRRHSEKALRTNEEIIRRIEERAR

SEQ ID NO: 17806 - protein, 178 aa, Artificial Sequence; identical to SEQ ID NO: 17805
  Synthetic sequence.

SEQ ID NO: 17807 - protein, 182 aa, Artificial Sequence
  Synthetic sequence.
SVDEALRDIERKVEELMRESDERLRRVKKEVEDNVRRSEEELKRIADEMKELLDRARERGVDEEILRRVEEELRRLAEEIKKINRDAEERLRRLIKEVREINEDVRRKLEELREELRRDGGKVEDLVREVLKKLKELIDRWRDLSRRLKERLDTLIKEHHELSKRLLERLKRLIDEARKKLN

SEQ ID NO: 17808 - protein, 182 aa, Artificial Sequence; identical to SEQ ID NO: 17807
  Synthetic sequence.

SEQ ID NO: 17809 - protein, 182 aa, Artificial Sequence
  Synthetic sequence.
SEVEELKREADDVNRRAEELARETLKKIEKVNREVKRRLEEALREIEELLRRAEEIVRRNEDKDRAIEEVRRRLDELRRKVEKVNEDNRKLLEELTEEVKRVNDENKKLLDDLADKVEKKLTTEEARKRLEEVVRHNKKLDDEHRKALDELRKHNEDLDRRSKEELDKLRKRLEDLLRKVKE

SEQ ID NO: 17810 - protein, 182 aa, Artificial Sequence; identical to SEQ ID NO: 17809
  Synthetic sequence.

SEQ ID NO: 17811 - protein, 182 aa, Artificial Sequence
  Synthetic sequence.
REVEELLKEIEEVLKKSERLSRESLKKIREVLERIERLARENVKRMKEVIDRVRELAERNEDRERLIEDVKRLIKEVSDSNRELDERSKKLLKELRDENERLSEESKKELERIRKKVEDKLTTEDARRALEELRKRVEEVNKKSRDDLERLTREAEELNRKNEEDLRRLEKEVKDLLDEIRR

SEQ ID NO: 17812 - protein, 182 aa, Artificial Sequence; identical to SEQ ID NO: 17811
  Synthetic sequence.

SEQ ID NO: 17813 - protein, 181 aa, Artificial Sequence
  Synthetic sequence.
SSRETVKRLTEEARKLLEDWKDRNRDVERKVEEIIERIRRTNEKSERDARRKLEEVDKRRRDEEVEKVREELERLLEESHRKVEEVVKEVEELVRESTEKVRRIVEKVKRLLEELTRLMEAGERDTEELKREIERILEELRRLMKEDKEELERILERLRRLAEEDKKENEEILDRVDKKAK

SEQ ID NO: 17814 - protein, 181 aa, Artificial Sequence; identical to SEQ ID NO: 17813
  Synthetic sequence.

SEQ ID NO: 17815 - protein, 181 aa, Artificial Sequence
  Synthetic sequence.
STEETITDLKREAEEILRRWREENKRVSDEAAESVKESDKTNKKSKDDLKRVLDEVDTKERSERVKTVIRKAEDLARRSHEKNREVNERLKKLLEESTRTVDTIIRELRRILDDIKRKVDAGERDAKELEDEVREALKRIRKLIEEDRRKLKRILDEHRRLTEEDRERNERVLRELREDTR

SEQ ID NO: 17816 - protein, 181 aa, Artificial Sequence; identical to SEQ ID NO: 17815
  Synthetic sequence.

SEQ ID NO: 17817 - protein, 181 aa, Artificial Sequence
  Synthetic sequence.
SVDESLEEIRKEVERLLRKWKEDNKEMRKRIRELLEDWRKKVEDSKKRAKDLIDEVKKRRDDERVEKVRKELEDLLKESEEKVREVERRVKKLLDESTKKVKEIEKEIRDIIRELDKRLKAGKRDTRELEKEAEDALRRLKKLIEEDRRELEKILKELEDLMREDTKENEKILREAEERSR

SEQ ID NO: 17818 - protein, 181 aa, Artificial Sequence; identical to SEQ ID NO: 17817
  Synthetic sequence.

SEQ ID NO: 17819 - protein, 181 aa, Artificial Sequence
  Synthetic sequence.
SVEDEIRRLTEEIERTLRRWREEVKRSEDRAEESIKRSDEKNKESKERLDKVLDEARRRRDDEEVKKVIKEVEELAEESNRRNKEVNDRLKKLLEDSKRKVEEIVRRVKKAMEDLKRLLDAGERDLRELLKEVEDVLEELKELIKRDTEENKRILDEHKRLTEEDEKRNREVLERLKRKTD

SEQ ID NO: 17820 - protein, 181 aa, Artificial Sequence; identical to SEQ ID NO: 17819
  Synthetic sequence.

SEQ ID NO: 17821 - protein, 181 aa, Artificial Sequence
  Synthetic sequence.
ESEETLKEVKKEIEKLIKRAEEINRESAERLKRILEEWKKEVDRSEKRLREVLDEVRRRRNTEEVEKVIREVEELVKRSRDKVRKIEKEVRDLLKESTDELKRIVEEIEEAVRDIERKLRAGKRDRRELLEELKRVLDRLKKLIDDDRRKNEKVLRDLEKLMREDADENREVLKRLEDKAR

SEQ ID NO: 17822 - protein, 181 aa, Artificial Sequence; identical to SEQ ID NO: 17821
  Synthetic sequence.

SEQ ID NO: 17823 - protein, 179 aa, Artificial Sequence
  Synthetic sequence.
SDEERVIKEVEDLIRRIREDNKRLLDEAEKIIRRVAEDNKKLVEDHRRMLRKIDEEAKRGRDEKFLKDLVERSERVVEESRRHVERNEREIREMLERLREHVERNERELREILERVVRKVGKETEDVKRLEEKVRKLLEESKRKLKRLAEEVRKLIKDSRDKIRELERENKEIIKKVKD

SEQ ID NO: 17824 - protein, 179 aa, Artificial Sequence; identical to SEQ ID NO: 17823
  Synthetic sequence.

SEQ ID NO: 17825 - protein, 179 aa, Artificial Sequence
  Synthetic sequence.
DREKEVVDTLRRLIEDARRDNKDLVETHRRLLEDLERDNRELVRTHEERLEEIERRARRGDDDTFLKKLEDESRDVVRDSERHLEENKRKSTKIVKDTKDHVDRNRKKIKKILDEAVREVGKEAEDVRRLEKEVEELLRESDRRVEDLERKNREILKRSEDLIRRLKEENRRIIEKVRK

SEQ ID NO: 17826 - protein, 179 aa, Artificial Sequence; identical to SEQ ID NO: 17825
  Synthetic sequence.

SEQ ID NO: 17827 - protein, 179 aa, Artificial Sequence
  Synthetic sequence.
DDERRVVEELERMIRELEKKIREIVKRHEEALKRLKEDNDELSKRHKKMVEEIKRRADEGRDDTFLKKLVEDSERVVEESKRHVDRNKEKSERIVRTTAELIKRLKEEIKKVLEDAVRKVGKDTEEVRRLKREVEELLKRAEELLKRLEDRNRKILRESEEDIKRLERENREIITRVRT

SEQ ID NO: 17828 - protein, 179 aa, Artificial Sequence; identical to SEQ ID NO: 17827
  Synthetic sequence.

SEQ ID NO: 17829 - protein, 175 aa, Artificial Sequence
  Synthetic sequence.
KELDEIIRRVEELIKDDERRNREVLKRSDESTKESHDKARRILEESEKTTEDIKRKVEKDGNTEKVERDIRRNNEELRKVLRELEKEHRENNKRLDEMLDRSRKNNDDIRKEIREKVKDEDKIRRLERESRELLRDSEDKVRKSKRKDEENLKRIEEEARRSEKRDEELLREAAK

SEQ ID NO: 17830 - protein, 175 aa, Artificial Sequence; identical to SEQ ID NO: 17829
  Synthetic sequence.

SEQ ID NO: 17831 - protein, 175 aa, Artificial Sequence
  Synthetic sequence.
RELDEIIKTLEKLIEDSHREAREIVKEVKKRLDDDKRRNEEVLKESRETTERIRKEIEERGRTEEIEEKIRRNNRRLEKLLDESEKNNRRIIDTIERLLRKLEELHKKIIDEIRKKVKSEEKIRRLEERARRNVEEMRKLAEELEKESRRILKESAEAVKRSKDEDRKLLEEAKK

SEQ ID NO: 17832 - protein, 175 aa, Artificial Sequence; identical to SEQ ID NO: 17831
  Synthetic sequence.

SEQ ID NO: 17833 - protein, 175 aa, Artificial Sequence
  Synthetic sequence.
SETDKVIEESEKTNRDIKRHSEEVVKDSKRTNTEIERTVEKMIRELEEILERIKRLADNGVPKEDLKRLVDELKERIDRILKELEELLRTDKKRISDALRRDEELAKKDKDEIDKKLDDKDKAKKLKDETDRILETSERLLKALRDETDAIKRKVEELVRRVKEELDRILKKTED

SEQ ID NO: 17834 - protein, 175 aa, Artificial Sequence; identical to SEQ ID NO: 17833
  Synthetic sequence.

SEQ ID NO: 17835 - protein, 175 aa, Artificial Sequence
  Synthetic sequence.
SETDRVVEESERTNKEIERHSEEMVRDSERTNKEIEEHSREVIERLREILERIERLVRKGVPKDELKKLVEDLRRRAKEALDRDRELLRRDKEKIDEVLKRDTELAERDKREIDKKVRDEEKMRRLKEETDRILDKSRRELKRLKDETDKLLEDSERLLREVEKTLRRILEEARK

SEQ ID NO: 17836 - protein, 175 aa, Artificial Sequence; identical to SEQ ID NO: 17835
  Synthetic sequence.

SEQ ID NO: 17837 - protein, 175 aa, Artificial Sequence
  Synthetic sequence.
SETEEVVKTLKRLLEEIKKHSDDAVRKSEETNKRIREEVERVIKRLKELIEEISELVKSGVEKERLKELVDRVKTALDRALDELRKLLEDDERKIKTVLDEDKKLVEEVKKRADEKASDEEKLKRLKDALDRILEESKRLADELKKRTKDILDEAKDALRKIKEELDKLVEDAER

SEQ ID NO: 17838 - protein, 175 aa, Artificial Sequence; identical to SEQ ID NO: 17837
  Synthetic sequence.

SEQ ID NO: 17839 - protein, 175 aa, Artificial Sequence
  Synthetic sequence.
SETDKVVREVEELIRRLEEHSRRVVEKSERTNEEIERHSRDVIRRSKEINDRIEELARNGVPEDDLRRLVKKNKEDNDRALEEDKRLLDTDKEEIDRALKRDEEIVRRIKEEIDKKVTDKDKMKRLKEELDKLLDDSRRLMKRLKDETDKILDKSRDLLAKTKRESDRILEEAER

SEQ ID NO: 17840 - protein, 175 aa, Artificial Sequence; identical to SEQ ID NO: 17839
  Synthetic sequence.

SEQ ID NO: 17841 - protein, 175 aa, Artificial Sequence
  Synthetic sequence.
SETDKVVDDSRKTNEDIKRHSEEVIRRLEELIREVEEHSRRVEDEVRRILDEIRKLAEDGVDERDLRRLVKKLEEEIDRVLEEDERLIREIKKEADRVLETDKRLAEEDKKRIDDKATDKDKATELKKDTDRILKESEDALRRIKKELDDLLRTSKRLAEELKKELREILERAKR

SEQ ID NO: 17842 - protein, 175 aa, Artificial Sequence; identical to SEQ ID NO: 17841
  Synthetic sequence.

SEQ ID NO: 17843 - protein, 175 aa, Artificial Sequence
  Synthetic sequence.
SETDEVVERLEKILKDIREHSERAIKKLEDILREIERHSRKVIRDSERINTEIKKLAEAGVPEKDLTKLVEDNKKRNDDVLDEDRKLVEELRERAERILRTDKRLVDDLKRKADEKLTDKDKLTTLKKKLDDLLDTSRRLVEKVEEDLRRILEASKRMLEETKKRSKEILDRIRK

SEQ ID NO: 17844 - protein, 175 aa, Artificial Sequence; identical to SEQ ID NO: 17843
  Synthetic sequence.

SEQ ID NO: 17845 - protein, 175 aa, Artificial Sequence
  Synthetic sequence.
SESEEVVREVDKILKEIRKHSKDVIEKLKKLIDDIRRRVRKVIRDSEEINKRIEDLAREGVPEEDLERLVEENKRRNDEVLKRLKELAERVKEEADRALERDKRLVEELKKRIDDKVTSEEDMRRLKERLDKILDDSREMLKRLKDELDEVLEEVERLLRETKKRSDEILKRIKD

SEQ ID NO: 17846 - protein, 175 aa, Artificial Sequence; identical to SEQ ID NO: 17845
  Synthetic sequence.

SEQ ID NO: 17847 - protein, 176 aa, Artificial Sequence
  Synthetic sequence.
SEIEDVIRRAEELIKEDKKRVEDVVREIEKLIRDDARKVRRAIEELKRLLREIEERVREEKEKRDVLERLVRTIKEEIDRLLKDNEDSIRRITKRLRDILRENRESLERIRRELDRRLTVKEEAERLRRELEDLHRDVKRLIDELEKDLRRLLEESKRRADRVKEELRRLREEVRK

SEQ ID NO: 17848 - protein, 176 aa, Artificial Sequence; identical to SEQ ID NO: 17847
  Synthetic sequence.

SEQ ID NO: 17849 - protein, 176 aa, Artificial Sequence
  Synthetic sequence.
SEADKAAEDAKRLIDKDREDVERAVKRAEDLIEKDREDVDRAIKESEELNKRAEDEARRRKDAREKVKRLADEDKKRNEEALRRNRKSIEDIRRDLEKALRDNEKTIEDIRREIEKLASDEEKARRLKEEADKVAKESKELADRLKERADRLHKRARELAERTKEDTDRLVEEAKR

SEQ ID NO: 17850 - protein, 176 aa, Artificial Sequence; identical to SEQ ID NO: 17849
  Synthetic sequence.

SEQ ID NO: 17851 - protein, 176 aa, Artificial Sequence
  Synthetic sequence.
SEIDEVVKEIEKILEDDKRRVDEAIEELEKLIREIREEVRRVIKESEDLNKEIRDRVRKNKEKREDLDRLVEEDRKKNREILETLKELIERIRREIERLLRENEETLRDIERKIREKMTDKDKAERLRRELKKIMEDSRRLADEIKKRLDRLLEEVKEEIERTKRETDRLLEEVRR

SEQ ID NO: 17852 - protein, 176 aa, Artificial Sequence; identical to SEQ ID NO: 17851
  Synthetic sequence.

SEQ ID NO: 17853 - protein, 176 aa, Artificial Sequence
  Synthetic sequence.
SELDRVVEEIDRLIREDEKEVRDMIRESEKLNRENEETNRKLLEDWDKLSKDIRDRVDKNKEKEEEAEKLLRDSERLAEDVLRRDKETVERDREKNKKVKERNERTIKEIRDRIEKKMEDDKKARELKEKLDELKKRSEKLLEDTKRETDKLHERSRRELEKLRRKDEELVKRVKD

SEQ ID NO: 17854 - protein, 176 aa, Artificial Sequence; identical to SEQ ID NO: 17853
  Synthetic sequence.

SEQ ID NO: 17855 - protein, 176 aa, Artificial Sequence
  Synthetic sequence.
SEIEEVVERIERLIKRIKEEVERALKESEDLIRDIERRVRELLEEWDRLSERIREVVERNPEKREDLKRLVEESRREAKRVLDELRRLVEEDRRRNEELLRRLEELIREIEDRIEKLAEDKDELRRLKEELRKLLEDVKKLLEESKKKTDDLLKRAEDELRKLKEKDDDLLRKVKD

SEQ ID NO: 17856 - protein, 176 aa, Artificial Sequence; identical to SEQ ID NO: 17855
  Synthetic sequence.

SEQ ID NO: 17857 - protein, 176 aa, Artificial Sequence
  Synthetic sequence.
EELDRVVEELDRLIRDNKRRNDEALKESDRLIRENERRNRKAARDWEELSKEIEDRVRKNKEKEEEVERLVRRSEKELEKIERADEETVRRDRELNKKVRDDDRRTIEDIEKKARELLEDKDKLTTLRKKLDDLHKESRRELERSKKKTDDLHRKSREEVRKLREDDERKLREIKK

SEQ ID NO: 17858 - protein, 176 aa, Artificial Sequence; identical to SEQ ID NO: 17857
  Synthetic sequence.

SEQ ID NO: 17859 - protein, 176 aa, Artificial Sequence
  Synthetic sequence.
SEADEAAKKIEKLIEDNERKNRKALKEWDELTRENEKRNRDAIKESEDLIKEAADEVRRRKDAREKAKKLAEDDKRRNEKALEDDERTLRESKKRAEEALREDRETLRRIEEEIKKLASDEEKARRLREEAEELHRRSEEAARRAEKKDREAHKRSREAIKRTKDDTEELLKEAER

SEQ ID NO: 17860 - protein, 176 aa, Artificial Sequence; identical to SEQ ID NO: 17859
  Synthetic sequence.

SEQ ID NO: 17861 - protein, 176 aa, Artificial Sequence
  Synthetic sequence.
DEIDKVVRKIEKLIDDNRRENEEMLRESEKLLKENEKKNEKAIRESEELIRRIEKRVRENKEKEEELKELVDRDRERNKEVEKEDRETVKRDRDLNEDALRRDRETLERIKREIEKRAEDKDKARRLEEELKELHKRSKEELEKSKEKTDRLHDKSRRLIEETERRTEELLERVRR

SEQ ID NO: 17862 - protein, 176 aa, Artificial Sequence; identical to SEQ ID NO: 17861
  Synthetic sequence.

SEQ ID NO: 17863 - protein, 183 aa, Artificial Sequence
  Synthetic sequence.
SVEDEVERLERDAEEISRRSETELRRLKKEVEDLNRESKKLLDELREEMEKILKKVREDSDEEELERLIREARKLLKDLADKIRRVDEESKRILDELARRIKKVNDDLKELVERLSRRAREIKDKDEVKRLVEEIERLLKRAEELSRELVRRIEKLIRELAEESRRLVDEIREVLKRLKDRAD

SEQ ID NO: 17864 - protein, 183 aa, Artificial Sequence; identical to SEQ ID NO: 17863
  Synthetic sequence.

SEQ ID NO: 17865 - protein, 176 aa, Artificial Sequence
  Synthetic sequence.
SEIETVLEKLKRLLEEDRELVKRVEDKIRRIIEEDEKTVRDIKKRLDDILREIRDVLEKRKEVREELKELLERVEEVIKDVLRKNEETLERLERELKRALKRNDDTLKRLREEAARLLEVEEELKKVEDELDRVRKETERIIKELREELEELHKRARDLLKEVRDELRKLLEEAKK

SEQ ID NO: 17866 - protein, 176 aa, Artificial Sequence; identical to SEQ ID NO: 17865
  Synthetic sequence.

SEQ ID NO: 17867 - protein, 176 aa, Artificial Sequence
  Synthetic sequence.
SEIEDVVRRIDELLREDKRRVDEVLERNRKLIEDDERLSREIARELDEIIKRLREVVKSNKEDRDTIRRLAEEAREVIERVDRENEKTKRELEKHSREALRENEDTIRRITEELKTRIKVREEVRKLKERLDKILEDTRRLLEESKRRLDRLHERHRETSEDMKRRIDKLLEEVRK

SEQ ID NO: 17868 - protein, 176 aa, Artificial Sequence; identical to SEQ ID NO: 17867
  Synthetic sequence.

SEQ ID NO: 17869 - protein, 176 aa, Artificial Sequence
  Synthetic sequence.
KEAEDVVREVEELIDRDRKLVERVLRENERLLKEDRDTVKKVLEELEEILKDIERVVRERKEVKEEVDRLIKELRDLIEKVLRDNKESIDRIREHSKRALETNERTNKELEETLRRLLDIEELLRRLKEEIERLLERSRRLVKESEERLDRIREETKRELDRVEEKLRRLLEEVKR

SEQ ID NO: 17870 - protein, 176 aa, Artificial Sequence; identical to SEQ ID NO: 17869
  Synthetic sequence.

SEQ ID NO: 17871 - protein, 176 aa, Artificial Sequence
  Synthetic sequence.
SEIEKVVEEIKKLLKELKETSERILRRNEKIIKEIEETSREVLKELERILEEIEDVVRKRKEVREEVEELIKELEERIRRADKRLEELIKELRDHSEKANKKIEDIVRRIEERLRRLLRDKDRLKRLRDELERILRDHERLSRESKDKLDKLLERHKELSDEVRKKLKELRDRADT

SEQ ID NO: 17872 - protein, 176 aa, Artificial Sequence; identical to SEQ ID NO: 17871
  Synthetic sequence.

SEQ ID NO: 17873 - protein, 176 aa, Artificial Sequence
  Synthetic sequence.
REIEEVEKEIERIIERIERTSRRVKEENDRLLEEIKRRSEEVKKRNDDIIREIRRVVEEDKKNREEVKRLIEELRKHSRDADEELRELIKKLKRHSDEANKTLEELIKELRKRLEERARDERRLKELKRKLDKLREDHERLSRRSDEELRRLEEEHKRLSEDSKRELDKLLDEVRK

SEQ ID NO: 17874 - protein, 176 aa, Artificial Sequence; identical to SEQ ID NO: 17873
  Synthetic sequence.

SEQ ID NO: 17875 - protein, 176 aa, Artificial Sequence
  Synthetic sequence.
DEIERVLEEAKKLIRDLEEHSRRVEEENKRLLKEIRETSERVKRELDRILEEIRKTVERRKEVREELDELIKTIRKRIKEADDELRRLIEELEEHSRRALETDKKILDEIEKRLRDLFKDDEKLRRLEEELKRLLDESKRLLEESEDELRKLEEEHRKLSEEVKRRLDELKKEVET

SEQ ID NO: 17876 - protein, 176 aa, Artificial Sequence; identical to SEQ ID NO: 17875
  Synthetic sequence.

SEQ ID NO: 17877 - protein, 176 aa, Artificial Sequence
  Synthetic sequence.
REIEEIVERVKEIIDRIRRHSKEVEKENEKIIERIRRRSEEVLRTNEKALRDIERRVRERKEVREELRKLIEDLRRHSDRADEELERLIETLKRHSKEALDRDRELIKRLEDDLRRAAKDKDELKRLKEELERLLRESKKLVDESKRRLEELLREHRELSKRSRDKLDELLRRVEK

SEQ ID NO: 17878 - protein, 176 aa, Artificial Sequence; identical to SEQ ID NO: 17877
  Synthetic sequence.

SEQ ID NO: 17879 - protein, 176 aa, Artificial Sequence
  Synthetic sequence.
SEIEEVVRRIREIIEEIRRLSEAALERNKRIIDEIRRTSKRVKEEIERIIRDIRRVVEERKEVREEVERLIRELKKTIEDANEELKRLIKELRDHSEKVNEEVRRALEELKERLDRLLRVREDVRKLKEDLKELLKEHKRLSEESKKRLERLLEEHERISEELKRRLEKLLKEAED

SEQ ID NO: 17880 - protein, 176 aa, Artificial Sequence; identical to SEQ ID NO: 17879
  Synthetic sequence.

SEQ ID NO: 17881 - protein, 176 aa, Artificial Sequence
  Synthetic sequence.
SEIEEVVKKVKKIIDEIRERSREALERNEKILEELKRHSEEVTRRAEKIIEEIKRVLEKRKEVRKRLRELARKLEELLKRALRRDEEIVAKLRRHSEKVNRELEEDIKRLKEELKTRMKDKDELTKLEKELEDLREEHRKLSKDSKDRLKKLLDESRELIERLKEKLKRLLEEAER

SEQ ID NO: 17882 - protein, 176 aa, Artificial Sequence; identical to SEQ ID NO: 17881
  Synthetic sequence.

SEQ ID NO: 17883 - protein, 181 aa, Artificial Sequence
  Synthetic sequence.
SEVEEMLKRLDDILKKHRELVKEMKEELDRVIETHRRLVEEVRRRLEKSNDEIDKLVKADVREDELRKLLTDNERLNREINRTSKDVVRKLEDLLRRAEEESRRVVKEVRKVIDDIRRRTRDERVEKALKEVRERLERSHKKAKEDLDRVREEARKSHEDVKRLSEEDRKKSEDLADEVRR

SEQ ID NO: 17884 - protein, 181 aa, Artificial Sequence; identical to SEQ ID NO: 17883
  Synthetic sequence.

SEQ ID NO: 17885 - protein, 181 aa, Artificial Sequence
  Synthetic sequence.
REVEEALERLRKLIEDDRELVKRAKEKLDKLLKDDRKLVEDVLRELKRSNDEVKKLVDSGVSEEELKRLLDENRRLNEKINRENEESIKRVEELLEEIERRNRETLERIKRLLDDVRKKTTDKRAEEELRRVKEEVDRVLEESKRRLDEVRRRLERIEEESRTKSEEDRKRSEDLVREAER

SEQ ID NO: 17886 - protein, 181 aa, Artificial Sequence; identical to SEQ ID NO: 17885
  Synthetic sequence.

SEQ ID NO: 17887 - protein, 181 aa, Artificial Sequence
  Synthetic sequence.
SEVERLVEDAERVIDEHRKLVTEMERRLERVNREDEKLVRKVLEELKKSNEEIKKLREDSVSEEELEKMLRKNEELNKEANERNKDSTRKNKELNKRINEDSKRVVKKLRDLLKEVEDRTTDERAKKLLDEIRKKLDDSNREVEKRSRDDERHTERVVRESKRLSEEDKKRSDELADETRK

SEQ ID NO: 17888 - protein, 181 aa, Artificial Sequence; identical to SEQ ID NO: 17887
  Synthetic sequence.

SEQ ID NO: 17889 - protein, 181 aa, Artificial Sequence
  Synthetic sequence.
SRVEEVKKELDDLIRRHKELVEKVRKELKDLLDKHERLVEEAKKEIEKLIETLKRLAENGVSEKDAEEILKEIEKLLKRIEEDSKRVLDEIKKLLDDIRKESKKVLDDIRRVIDRARKETTDRRAEDELRKVRKEVERSNKEVEEILDDVRRKVEESDKRVKEILKKLREDVKKLLDEVRK

SEQ ID NO: 17890 - protein, 181 aa, Artificial Sequence; identical to SEQ ID NO: 17889
  Synthetic sequence.

SEQ ID NO: 17891 - protein, 181 aa, Artificial Sequence
  Synthetic sequence.
SEVEKLVADADKLIKDHRKLVEEAKKRLDEVNERHRRLVEEVERRLDKSNKELEDLVRSGVDEDDARRVLEDNERLNKEANDRSKEMLDRNRDLNRRINETSERILKKIEDLLEDVRRRTDDRRADEELRRISERVKRSNEDVRKKSEDDKRHTDESDRDVKRLSKEDRERSETLMDRVRE

SEQ ID NO: 17892 - protein, 181 aa, Artificial Sequence; identical to SEQ ID NO: 17891
  Synthetic sequence.

SEQ ID NO: 17893 - protein, 181 aa, Artificial Sequence
  Synthetic sequence.
SRVEDVERELEEEIDKHRKEVEDAKRRLDELIRRHKEEVKKLKKKLDDLIEELERLARNGVDEKTIEEVVKRIREELEAIEERSRRVLKKIEDVIDELRKRSEEVVRRLEKLLKDVEREVDDERAKRSLDRVREKIEKSDRTAKDLLKKVEEEVRKSNERVKELLKRVKDAVDDLLRRRRK

SEQ ID NO: 17894 - protein, 181 aa, Artificial Sequence; identical to SEQ ID NO: 17893
  Synthetic sequence.

SEQ ID NO: 17895 - protein, 181 aa, Artificial Sequence
  Synthetic sequence.
DEVEEVVKRAEDVIRTHKELVKKAKEDLDKIIEDIERELKKMLEDLERSNRRVEELVRGGVDERELDKLLEENRRLNEEINDRLEKLVKEVRKVLEKIKKDSDDVVRKLEKLLKDVERRSTDERVKKILDDIRRELEESNKKVEEDLRKAEEDLEELLRRARELSKEDEKKSRKLVEDARR

SEQ ID NO: 17896 - protein, 181 aa, Artificial Sequence; identical to SEQ ID NO: 17895
  Synthetic sequence.

SEQ ID NO: 17897 - protein, 181 aa, Artificial Sequence
  Synthetic sequence.
DEVDEVVKRLEDIIRKHETLVKKAKEDLDRVNEEDTKLIRDVLRRLKESNEEMERLVRSGVSEDDARRLLDENRKLNEEANRRNKKSLEDNSRLNEKLNRDSKRVLDEIRELLKDIERRSTDERVKEELRRVEEDVKKSDEDARRLSKEDRDHTRENFKRSEELSRRDEETSRRLMEEVKR

SEQ ID NO: 17898 - protein, 181 aa, Artificial Sequence; identical to SEQ ID NO: 17897
  Synthetic sequence.

SEQ ID NO: 17899 - protein, 187 aa, Artificial Sequence
  Synthetic sequence.
KDVEDLVRKAEELLKRHREDVTRLLERLKKVNKDHERLVKELKRRLEELLREVRELVERDGGESERAKEILRRLVEKAKKLLKEVEERSRKVNRDSEKLLKEIRERSKEVEDRVRKLLKEIEERVRGKDEVERRLRRLEEELKKSHEEVERRLDEVRRHSKRSHDELRKVLRKLEEDLRRLAEEVKT

SEQ ID NO: 17900 - protein, 187 aa, Artificial Sequence; identical to SEQ ID NO: 17899
  Synthetic sequence.

SEQ ID NO: 17901 - protein, 187 aa, Artificial Sequence
  Synthetic sequence.
SDLEELVKRAEKLLEEHKELVKRLEDRLRELDKRHKEIVERLRKELERLLREIRRIVEEKGGESEEAKELLKKLREEVRKILEEIERTSEKMERDSERLNEEIRKRSKEMLDRAAELLKEIESRIRGVDEAKRKLDELEERLRRSNKELEEKSEENERRTRESNEELERRLEDVRRKLERLREEVER

SEQ ID NO: 17902 - protein, 187 aa, Artificial Sequence; identical to SEQ ID NO: 17901
  Synthetic sequence.

SEQ ID NO: 17903 - protein, 187 aa, Artificial Sequence
  Synthetic sequence.
KDVEDLLRRLEEIIKDHRREVEELLRELTKLDEEHKEEVRRLTEELERLLDEARRLVEEKGGESEEARKIVKDMEERVKKVLDDIRRESERVVRESERLNKEIEKRNDEVRRRAEKVLKDITDRIRGVDEAERELERVEREVRKSSDKLRRDSKRNKERTRKSNEELERRLEEVERELRRLVAEVEK

SEQ ID NO: 17904 - protein, 187 aa, Artificial Sequence; identical to SEQ ID NO: 17903
  Synthetic sequence.

SEQ ID NO: 17905 - protein, 177 aa, Artificial Sequence
  Synthetic sequence.
KKVEDLEERLERLLRDAERRVRELLDEARRLLETHRELSKRLLERLEKVNRDIREKAKEKKEEVLTELLKESERLLEEVKKINKEAEDRIRELLKRVDDILKDLKKRIEDLLDEVRKRGLDERLLRRVEKEVEDLLRTVKDLLRRIEEEVRKSLEESKKLLKEVEDHSRKLLEEIRK

SEQ ID NO: 17906 - protein, 177 aa, Artificial Sequence; identical to SEQ ID NO: 17905
  Synthetic sequence.

SEQ ID NO: 17907 - protein, 177 aa, Artificial Sequence
  Synthetic sequence.
DEDEEVLRRLKELLKTHRKLSEDLLREAEAINEDHRRLSEELLRRLEKLNEEIRRKAKEKDRRVMEKVRKESRDLLEEVKRINEEAKRRSEEVAKKVRKINKEAKDRIDTLLEDLKRRGVDEELLRRVEEEVKKSNEESKKKIKELEEHSRRSNEESERRLREVEEHSRRLLEEIRK

SEQ ID NO: 17908 - protein, 177 aa, Artificial Sequence; identical to SEQ ID NO: 17907
  Synthetic sequence.

SEQ ID NO: 17909 - protein, 176 aa, Artificial Sequence
  Synthetic sequence.
SEVEDIVRKVDEIIRRLERHNEELRKRVEEVLDRLRRHNEKLDRDVKEIIKEIERVIRGNTDDARELTKRLKEALDRHRKASEDNIRDIRDALRKVEEVSRKNVDDLRDALREVREKLGKKDLLREIEEKVRRLVRKSEELLRRIAEDVKKVIEDSKDSHKKIEDELRELEERLRK

SEQ ID NO: 17910 - protein, 176 aa, Artificial Sequence; identical to SEQ ID NO: 17909
  Synthetic sequence.

SEQ ID NO: 17911 - protein, 176 aa, Artificial Sequence
  Synthetic sequence.
SEVEDIVRKVDEFLERLKEHNRKLDKEAKELLDRLKRHNEKLDEEAKRLIEEIKRVADENSMDKDRLLAELRKVLEEHRRVSEDNVRRIRKLLDDHRRRSEENMRRIDAVLDKVRKELEDKDLLREIAEKAERVKEESKRSHDEIADEIRKVEEESERSHREIAEELERLSRRLKK

SEQ ID NO: 17912 - protein, 176 aa, Artificial Sequence; identical to SEQ ID NO: 17911
  Synthetic sequence.

SEQ ID NO: 17913 - protein, 176 aa, Artificial Sequence
  Synthetic sequence.
KDVEDIVREVERLIKELREHNKELVDRAREVLKELKDHNEKLVEDVKRLIEDITRKIRANTDDKEKLLRDLERVLREVKRVSEENIRRIRKVLEKVAEDAKRNVEELRKVLKEVREKLKKKDLLRDIERKVEKLERDSRRLLREIEEEIRKVIERSKELLERIEKELRDLMRELRK

SEQ ID NO: 17914 - protein, 176 aa, Artificial Sequence; identical to SEQ ID NO: 17913
  Synthetic sequence.

SEQ ID NO: 17915 - protein, 176 aa, Artificial Sequence
  Synthetic sequence.
KEVEDIVEDVKRVLDELRRHNEKLVREVDRLIRELDKHNKELDDRATEIIKRIEEVVRRKSRDKRELVRELEEVLERHREMSERNVRRLERILKEVAREADKNVKDIRRALERVKRELEKKELLERIDEEVKRVEETSRRLLREIAEKVKTLKEKSKRSHEEIRRRLEELADEIRK

SEQ ID NO: 17916 - protein, 176 aa, Artificial Sequence; identical to SEQ ID NO: 17915
  Synthetic sequence.

SEQ ID NO: 17917 - protein, 176 aa, Artificial Sequence
  Synthetic sequence.
SEVEEIVRRVEKLIEDLKRHNEKLVDEVKKVIDTLRKHNEDLVRRVEEVIKRIEEVIRENRVDKRELLKRLEELLKRVAEEAKRNVKRLREALKEVAERSKENVKRLEDVLEKVKRELEDKDLLRDIAEKVKTLKEDSRRLLEEIADRVRRLEEDSRRLLEEIRKEVERLKEELKK

SEQ ID NO: 17918 - protein, 176 aa, Artificial Sequence; identical to SEQ ID NO: 17917
  Synthetic sequence.

SEQ ID NO: 17919 - protein, 176 aa, Artificial Sequence
  Synthetic sequence.
SEAEEAAREAKEAIDRLEEHNKKLDEDAKRAIEEARKHNKELDERAKRALEEIEKAARDNREDKEELKKKADRALEEHRKAAKRNIDEARRALDEHRKASEDNAREAREALKRVRRDLRDTDAARRIAEEVKKLEKKSEDSHRKIAEDVKKAEEDSERSHRDIARRAEEVKKKADD

SEQ ID NO: 17920 - protein, 176 aa, Artificial Sequence; identical to SEQ ID NO: 17919
  Synthetic sequence.

SEQ ID NO: 17921 - protein, 176 aa, Artificial Sequence
  Synthetic sequence.
SEVEKIVREVEKLLEELREDNRDLVRRADKDLERMERHNRKLVKDVEDVLRRIEEVRRANTEDKRELEKEVRRVLKEVADMAKRNEEEIKKVLDKVTRHSEDNVRKIREILEDVRRKLEDKDLLREIERKIREVEEKSRELLREIKKKLEDVARESRRLLEEIARKIEKLSDELRK

SEQ ID NO: 17922 - protein, 176 aa, Artificial Sequence; identical to SEQ ID NO: 17921
  Synthetic sequence.

SEQ ID NO: 17923 - protein, 176 aa, Artificial Sequence
  Synthetic sequence.
SRAERIVEEVEKVITDLERDNRELVRDVRRLLERLERHNKELDDRITEIIKEILRLAERNERDKRELEKELEKVLDEHRRVLEENIKEIRDVLREVAEHSERNMRKLRDALRKVERDLEKEELLREIKRKVEELEKRSKELLEEIARRVKEVEEKSRDSHRKIRERLKELVRKVRE

SEQ ID NO: 17924 - protein, 176 aa, Artificial Sequence; identical to SEQ ID NO: 17923
  Synthetic sequence.

SEQ ID NO: 17925 - protein, 178 aa, Artificial Sequence
  Synthetic sequence.
REMEEVLKEAKELLKESNKKAREIDRKIKELLDDSHRKVKETVDRVKRRIEELDRKVKEVKEERLKEELKEEAERVRRDVERLVEELRRENDEILEEHRRLIKELEDENEEVLDRLRKKLRVEEVLREVEKELEDNKRELRESHKEIARELERNKEDIDRLVEEIKRRIEELKKRIDK

SEQ ID NO: 17926 - protein, 178 aa, Artificial Sequence; identical to SEQ ID NO: 17925
  Synthetic sequence.

SEQ ID NO: 17927 - protein, 178 aa, Artificial Sequence
  Synthetic sequence.
DEMEKVLKEAEDELRRVEKEVREVDKEAEELLERSHRKVRDIVRRVTEELKRLKDKVEKIREERVKKRLKEEIDEVLTRAKKLIDELRKENDDVLRRHRELVKRIKEKLERIREDLERKLRVREMLEKLRREVERVKKEVDDSHREIAKKVERNKKEIDKLVREVEREVEELKKRIDK

SEQ ID NO: 17928 - protein, 178 aa, Artificial Sequence; identical to SEQ ID NO: 17927
  Synthetic sequence.

SEQ ID NO: 17929 - protein, 178 aa, Artificial Sequence
  Synthetic sequence.
SEVEEVLEDAKRLLKEVEKRVREIDRRAEDLLRRSHEKVRRIDKDVKRLLREVEKKVEEVKEDELKKRLEEELEEILRKHKELAEELKKENEDALKEHEDLIRRLREELEDVLRRLRERLRKEEVLKKVEDDVRRLDEEVRRSHEDIRKKVEDNKKRIDESHEEIRRLAERVKKEIRK

SEQ ID NO: 17930 - protein, 178 aa, Artificial Sequence; identical to SEQ ID NO: 17929
  Synthetic sequence.

SEQ ID NO: 17931 - protein, 178 aa, Artificial Sequence
  Synthetic sequence.
SEDEKVVKEAKRLLDENRRENKEIDERAEKALEDSHRKVRKIDKEAKELLEKLRRDVEEVKEEELKKELRKELERVLRRHKKLVDDLKRENDEVLKRHRDLVEESKRKLEEILKELEERLRSRELLDKVRREVERLKEESKKSHDRIREELRRNKEEIEKSHDEIRRRVEKLDDEIRR

SEQ ID NO: 17932 - protein, 178 aa, Artificial Sequence; identical to SEQ ID NO: 17931
  Synthetic sequence.

SEQ ID NO: 17933 - protein, 178 aa, Artificial Sequence
  Synthetic sequence.
SEVEEVEREVRKLLKESNDKVREIDKEAKKRLKDVEDKAREIDERITKLLKDIEDEVRKVKERELKEDLKRKIEDVLRDHERLVRELERELEKILEDHKRLIEELKRENDRVLEELRKKLRKEEVLRKVEKEVEDNKKELDESHKEVKREVEEVRERIDESHKRIRERADRVKKKIEK

SEQ ID NO: 17934 - protein, 178 aa, Artificial Sequence; identical to SEQ ID NO: 17933
  Synthetic sequence.

SEQ ID NO: 17935 - protein, 178 aa, Artificial Sequence
  Synthetic sequence.
KELEDVLEDVKRLLKESNDEVKEIDDRARRLLEESHRKSEEVDRRAEKRLREIEDKVRKSDKEEVKEELKKEIKKVRDEHEELSRRNTEENKRVLDEHRKLVEELKKKNDDVLRELRKRLRKEEMLREVEERARKNKEDIEKSHDEIRKEVEDNIRRDRESHKRIEEEARRVMAEIEK

SEQ ID NO: 17936 - protein, 178 aa, Artificial Sequence; identical to SEQ ID NO: 17935
  Synthetic sequence.

SEQ ID NO: 17937 - protein, 178 aa, Artificial Sequence
  Synthetic sequence.
SEVERVLKEADKLLKDNDEKNERVDREVEKLIRDSHEKSKKVDERAKRALDKLDDEVRKVKDEELKRELKERIKKVLEEHKRLSDENRDENRKVLERHKELVDRSKKELEEVLKELRKKLRKEEMLREVEKKVETLKKKSDDSHKEIEEKIRRNIEEDDKSHERIREEAEKLKKKIDD

SEQ ID NO: 17938 - protein, 178 aa, Artificial Sequence; identical to SEQ ID NO: 17937
  Synthetic sequence.

SEQ ID NO: 17939 - protein, 184 aa, Artificial Sequence
  Synthetic sequence.
ELEELMKKIEDDSKKNDEDTERLVKEIRDRSKRNREESKKLHDEDRREAKRVLDEARRDVRDEEKLKRLEDKLEKILRENAEVHKTSEEKNRRINKRLDDLVREDKKKNEDILRKLRELARRVKREEDVRRAIEEVRRLLEKSHRDSRRVIEEVRRLLEKSHRDNRKVNEDSRRLLKKVREDAE

SEQ ID NO: 17940 - protein, 184 aa, Artificial Sequence; identical to SEQ ID NO: 17939
  Synthetic sequence.

SEQ ID NO: 17941 - protein, 184 aa, Artificial Sequence
  Synthetic sequence.
SLEDLVREIREESERNKKETRKLLRRIEEESKRNLDESERLHREDKKRLEDIAERLERRVRDEDKLRRLKEELERILKRNKDLVDEDREENERIITKLRKLVKEDEDKNRKIITDLEDVLRKVKDEDLVRKVITEVKRLLEESHKESREVIREIKELLEESHEKSKKVNEESKKLAEDVLRKAD

SEQ ID NO: 17942 - protein, 184 aa, Artificial Sequence; identical to SEQ ID NO: 17941
  Synthetic sequence.

SEQ ID NO: 17943 - protein, 184 aa, Artificial Sequence
  Synthetic sequence.
SLEELLKKIREESKRNLDETRKLHREDKEESRKNLEESRKLHEEDRREAERVKRRADREVRDEEKLRKLRELLKRILDKNKKVLDDDKRLNEKILKENEERVRDDKETNDRIIEEADEALERVKDEKLVREVVERLRELLRESHERSREVNKRSRDLLRRSHEKSRRLNEESRRLLEEVERRVK

SEQ ID NO: 17944 - protein, 184 aa, Artificial Sequence; identical to SEQ ID NO: 17943
  Synthetic sequence.

SEQ ID NO: 17945 - protein, 184 aa, Artificial Sequence
  Synthetic sequence.
SADELLKKLRDESEKNKDDTRKLLEELRRRAEKNKKDIEDLLREIEKKLREVLEDIKRKVRDEEKLRRLKEMLERILKRARELVEELKKENDKILKELEDMVEDDKRDNKRIIERVEELRKKVRDEEEVKRAVDEVRRLLEESHKKSREVIKRIKKLLEDSHKKVREIVTELDKLIKEVEKKVE

SEQ ID NO: 17946 - protein, 184 aa, Artificial Sequence; identical to SEQ ID NO: 17945
  Synthetic sequence.

SEQ ID NO: 17947 - protein, 184 aa, Artificial Sequence
  Synthetic sequence.
DLKELVDELRKKSDDNLKETERLVREIEKRLTDNKRESERLVREIEKELRDLRERIERTVRDERKLRDLERKLKKVDEELKEMHERSKRENEEIRRELKKLVEDDERRNREIKKRVEDLLRKVKDKDEVRKAIKEAEELLKRSHEESRRVIERVRKLIEESHRKNREAIKRIRRLIEEIRKEVD

SEQ ID NO: 17948 - protein, 184 aa, Artificial Sequence; identical to SEQ ID NO: 17947
  Synthetic sequence.

SEQ ID NO: 17949 - protein, 175 aa, Artificial Sequence
  Synthetic sequence.
SEIEKVREELKELLERDEREVKRVIDDLRRLIKDLRERVKEVNKRDDETVKEIKKVIEERGDTEDVKRLLTENKKRNDRMLERLEKILEDIRERVRRALETSEKTNREIDERVKRKIKVEEVAREVEERSRRVKRKLEELIREIKTELDRVREEIERLSKRDREKNERLREEARR

SEQ ID NO: 17950 - protein, 175 aa, Artificial Sequence; identical to SEQ ID NO: 17949
  Synthetic sequence.

SEQ ID NO: 17951 - protein, 175 aa, Artificial Sequence
  Synthetic sequence.
SEIEDVLRELKKLLTDDKREVERANRDDERTLRDIRRKVEEAIKKLEDLLRDVKRRVDEEGNTEEVEELLRRILKDVERVLRELEKLIRDNKRRNKEMLDRSRRTNEKIKEDADRKLKVKDVAEEVERESRKVEKELEDLSERDKERNDRILRTIEELIKRVEEEIRKVKEDVER

SEQ ID NO: 17952 - protein, 175 aa, Artificial Sequence; identical to SEQ ID NO: 17951
  Synthetic sequence.

SEQ ID NO: 17953 - protein, 175 aa, Artificial Sequence
  Synthetic sequence.
SEIEDVLRKLRKLLREDEKRVEDANRRDRDTVRKIEKRSEEAFKESKETNKRIEDKVRKTGPTDEVRKELEDDKKRVDDAHRKSEEDIRRNDKENEEFLEESRKTNEDIKEEVDRKIKVKEVVEEVRDDSRRVEEKLRRLSKEDKEENDKIRRRDRKLVEDLRRDSDRILRKVET

SEQ ID NO: 17954 - protein, 175 aa, Artificial Sequence; identical to SEQ ID NO: 17953
  Synthetic sequence.

SEQ ID NO: 17955 - protein, 175 aa, Artificial Sequence
  Synthetic sequence.
DEIERVVEEVRELLERDKRRSDEVIERLKRLLEKDEEDVDDVIRRSKETNERIRDKIEKEGPTEEVEKLLRDDKRRVDKLLEDSKRTNDDIVRRLDEAHEESEKTNRDIDEEIERKAKVKEVVDDLKRLSKKVYDDNKELIDRVRERSREVLRRLKELADELRKLSEKIKRDADK

SEQ ID NO: 17956 - protein, 175 aa, Artificial Sequence; identical to SEQ ID NO: 17955
  Synthetic sequence.

SEQ ID NO: 17957 - protein, 175 aa, Artificial Sequence
  Synthetic sequence.
DDIEEVVKEVEDLLRRDAEDVERAIKELRKLLEDDRDRVRKVNEESRRIIEEIRKAIERRGDQEDVKRAVKEVKDRNRKANDESRRTNTDIKRALDEALKRSRETNKDIEDKIREKAKVKEVVDKLREDSERVKKKAEDLVEEIRRASEEVKKEVDDLSREDEERLEKLKEDARR

SEQ ID NO: 17958 - protein, 175 aa, Artificial Sequence; identical to SEQ ID NO: 17957
  Synthetic sequence.

SEQ ID NO: 17959 - protein, 182 aa, Artificial Sequence
  Synthetic sequence.
SEAEELEDRIRKLLREVEETSRRILKRARELNKRIEEESRRIIKRIKELIDEIKELVRTRGDDRGVEELLKKVLKEIEEVNDEHRKRIEDVTRKSEKVNEDHRKTIEEMEERLRRLLEDLRRRGIDERLLRKLEREVRRLSEEVTRLDEETRRHSDDLRRRVERLDETTRRELEKLADEVRK

SEQ ID NO: 17960 - protein, 182 aa, Artificial Sequence; identical to SEQ ID NO: 17959
  Synthetic sequence.

SEQ ID NO: 17961 - protein, 182 aa, Artificial Sequence
  Synthetic sequence.
SEAEELIKRAEDLIREIKKRSDDLVREMERLNEEIKRVSDEIIKRIEEVLEEIKKLVKKVRDDRGVEERVREVKREIERLNDEHRKIIEKVLRESRDVNRRHEEEIRRVLKEIEDLLREAEERGIDRRLLEKLKRELKDLERRVREENERSKRHSEELVRRARKLNEKTDKDLKRLEEETRR

SEQ ID NO: 17962 - protein, 182 aa, Artificial Sequence; identical to SEQ ID NO: 17961
  Synthetic sequence.

SEQ ID NO: 17963 - protein, 175 aa, Artificial Sequence
  Synthetic sequence.
REIEEVRKEVERVRKRYKDEVRKIVEDARRVLEEHKRRVEKLLEELERILREAKRLTDEGDRREEVIERLKELLKRIKERIERLNKRLREVVERIARDLKRLVEESKRELDRIREEVRDEDMLREIEKAVRELNEESKELLERIEREVRKSEERSKEVIKEIAERARKVVEDTKT

SEQ ID NO: 17964 - protein, 175 aa, Artificial Sequence; identical to SEQ ID NO: 17963
  Synthetic sequence.

SEQ ID NO: 17965 - protein, 174 aa, Artificial Sequence
  Synthetic sequence.
SEAEKVLTDNRDTLRRLKEELKKVLDENRKTLEELDKRLEEVHKRHNEELDRIRKDGLSEEVLREVEKINEELRKELEDLSREVKKLHEDLEREIRELAKEAEDRHKDLERKVRDTKADERVKEELKRIDEDLKRVVDRIKEKAEDIDRKLKKRVKEIMDKARESLKTLEERVK

SEQ ID NO: 17966 - protein, 174 aa, Artificial Sequence; identical to SEQ ID NO: 17965
  Synthetic sequence.

SEQ ID NO: 17967 - protein, 174 aa, Artificial Sequence
  Synthetic sequence.
DEMREVLKRLRELVEELRRELEEVLRRNRETLKRLEEELRRVHKEHNDVLKEIRDKGLDEDRLREVTEINKRLKKLLDELRERAKKLHEDLKRLIDELDRRLRELLKRLKERLRDTRVDERMKDELKKILDEARRVVERIDREAKRIDDELREVVERISRDAKRSLDELDERTR

SEQ ID NO: 17968 - protein, 174 aa, Artificial Sequence; identical to SEQ ID NO: 17967
  Synthetic sequence.

SEQ ID NO: 17969 - protein, 174 aa, Artificial Sequence
  Synthetic sequence.
DEMREVLRELEDELRKIKERLKRVLDRSRELLEEWREELERVHRRNEETLRRIEKNGLSEEVLREADELNKELKREADELLDTYRRLLEESEKEAREIIKTVEELVKRLREELRDTKTDEEIKRRAEDILRELRRLVEELERRNEEINRRLAKRIKELMEKIRREDERLKKEVE

SEQ ID NO: 17970 - protein, 174 aa, Artificial Sequence; identical to SEQ ID NO: 17969
  Synthetic sequence.

SEQ ID NO: 17971 - protein, 178 aa, Artificial Sequence
  Synthetic sequence.
DKAKRVRTELERRLEKLKRDARKVIEEHEKSLRDLEEEVRRVREEHERSLKELKEELDRKPKREEEKKRLKDEMEESRRRLDKLTEDLKRELDKSRDRLRKIDKELDDSAKKLRDELEKKGVDEDVTRELERVLDELRREVDRVRRELEKIDRELRELVKRIEDELRKINKELKEKSD

SEQ ID NO: 17972 - protein, 178 aa, Artificial Sequence; identical to SEQ ID NO: 17971
  Synthetic sequence.

SEQ ID NO: 17973 - protein, 179 aa, Artificial Sequence
  Synthetic sequence.
DEVEELVKTVRKLVEDHNRKLEEVVRRLREIVKELEDRTRRALEEARRTVKRIEEEVRKRGKSDKLAEDIRRKLKELEKRLKRVKKELDDLHRDSKKKLDDVKRESEEDLRRIDEALKRVDIDERLLRELKDLLEKSKRRVDELVKEIEKRNRDHKEKVRKIVDEIRRLLRELEERVKK

SEQ ID NO: 17974 - protein, 179 aa, Artificial Sequence; identical to SEQ ID NO: 17973
  Synthetic sequence.

SEQ ID NO: 17975 - protein, 183 aa, Artificial Sequence
  Synthetic sequence.
KLEEILRRIRELLKRHHEKNKKILDDIREKSKKLKKKVDDILTRITEIIKDLEREVDGRPRDRRLEELKRELRDLLDKLRKRVERIAEEHRRLDEELETKVRKLNEELRKLTKDLEERVREGNDERVLEDLRRKADDIIRRADEESRKIKEEADDIFRRSDELLKRLEDEAKRIADEVRKKTK

SEQ ID NO: 17976 - protein, 183 aa, Artificial Sequence; identical to SEQ ID NO: 17975
  Synthetic sequence.

SEQ ID NO: 17977 - protein, 183 aa, Artificial Sequence
  Synthetic sequence.
DSDRIEETIKKLLKELSDKSKEVLDEIRKRLKDHHDRNRKVLEEIRRILKRLEEEVRRKPNDERLEELKKRLRELAERLRTEVEEINKRLDELRKELEEKVRRLNEKLKKLADDLRKELRKGNDKRALKEMLDRVRKIIKEYEDSLRRLKEEVDEIIERADRLSEELRRKAEKIIRDITDAVR

SEQ ID NO: 17978 - protein, 183 aa, Artificial Sequence; identical to SEQ ID NO: 17977
  Synthetic sequence.

SEQ ID NO: 17979 - protein, 183 aa, Artificial Sequence
  Synthetic sequence.
DSEELLREIRKRLEDLSRKSEEIKRRIDEISRDLERKVEEIKKRIEELVRRVRTEADKRPKTRELDRLKEELDRLRRELEKEAEKLMEDHRRLNEELREEVKKINEELKRKTDTLTERLRRGNDRKVLERIREEADEIDKDYDRLLKEIRKKIEDIARDTERRLRELKDRVDKIIKKVEEDER

SEQ ID NO: 17980 - protein, 183 aa, Artificial Sequence; identical to SEQ ID NO: 17979
  Synthetic sequence.

SEQ ID NO: 17981 - protein, 179 aa, Artificial Sequence
  Synthetic sequence.
REIETVTKKSRDLNREIDKKLKELTERVDKLIEEWKRKTDRVREEAKRAVKEIEDKNVREDEFEKLTRELEKRLEDVKEESRKDKERIEKRLKEAEDDLRRLDKEHREELKEVRERLPETEELRRVIEESKRSNDELKKKADELSKRVKEALDRLEEEDKRVLEEIKDILRELRERRRK

SEQ ID NO: 17982 - protein, 179 aa, Artificial Sequence; identical to SEQ ID NO: 17981
  Synthetic sequence.

SEQ ID NO: 17983 - protein, 179 aa, Artificial Sequence
  Synthetic sequence.
SEIEEVEKKSRELNRRVKERLDEVEEESRRLNEKWERDTRRVRERVEEEIKKIEERNVREDEARRMLEAIKEDLERAERESERTDEEHRRRLEEVRKEVEDMDRRHREELKRVAERLPRTEKLDEVLKRSEDSNRELKRRAEELLRDSERTNEELRRRDEEVKREVEEKLKELEKEIRR

SEQ ID NO: 17984 - protein, 179 aa, Artificial Sequence; identical to SEQ ID NO: 17983
  Synthetic sequence.

SEQ ID NO: 17985 - protein, 187 aa, Artificial Sequence
  Synthetic sequence.
SSKEILKEIDERVEELKRRNEKVDREIKEKVKRLEEENEKVDREIKEILKELEKEAEKRPRTEDLERKIREVRDTLRRLHEENKEVNDRMRETVRRLHEKNKRMDERAKEEIEKIKEDIKRLEDKGTTEEVLERLRREVRKRIEDYKRKLDKIARDVDETIERYKRKLEEIKRRVEDEARKIKEEIR

SEQ ID NO: 17986 - protein, 187 aa, Artificial Sequence; identical to SEQ ID NO: 17985
  Synthetic sequence.

SEQ ID NO: 17987 - protein, 179 aa, Artificial Sequence
  Synthetic sequence.
SRKEELKRRLDEALKKYEADLDELRRRHEEDVRRSKEENERLLKELEDAVRRAKEEVKKAGKDKKDLDRLEEELRKLVEDIKRESEKLERDIDRHHKEIKKHMDKSRDELKKVREEIDRRDDEDRRVEKEIREAIERLKRNLERIKRNIEKVREDSKRVNKELRDKIREIIERIDRRLK

SEQ ID NO: 17988 - protein, 179 aa, Artificial Sequence; identical to SEQ ID NO: 17987
  Synthetic sequence.

SEQ ID NO: 17989 - protein, 183 aa, Artificial Sequence
  Synthetic sequence.
SRKEKLLDDARKILKRAEEELKRLYDKHRRIIEEVKRDLERLKKEHEDVVRRVEDVLRKRVTEEERVRELKRKIEENHKELKERIDKLKEELDRINEELKKRLDKIKKEADELLRRLKEVADRNEKDDKELEEDIRRIEDRLRRLLEELEKLIEDSMRELKRVLDELEKHIREVDEELEEDLK

SEQ ID NO: 17990 - protein, 183 aa, Artificial Sequence; identical to SEQ ID NO: 17989
  Synthetic sequence.

SEQ ID NO: 17991 - protein, 184 aa, Artificial Sequence
  Synthetic sequence.
SEAERVKRELDEALKKAKKALEDNKRKLEEALRKHREDAKRWKEELEKALKEAEKAAKDLRRDADKEELDRLREDLERKAKKLKDEIEKINRELEELAKRHEDTNRKLEEDLRRLAKKLREEIEKDGADKEAERKLRELEKRAKEALERSKEHSDELEERARKANKEIEDKLKRLAEEAEKEAR

SEQ ID NO: 17992 - protein, 184 aa, Artificial Sequence; identical to SEQ ID NO: 17991
  Synthetic sequence.

SEQ ID NO: 17993 - protein, 179 aa, Artificial Sequence
  Synthetic sequence.
SEAEKIKKDLDKIREDLKRLDREAEERVRRLSEELDRKDRELRKRIDEILKRMRDEERSDDELRKEEKKVRDELEEMAEDLRRKNEEIREILKRIAERLKKRNDDVRKRLEDIARKKSVPDEDLKRLEDELRKVEEDNRRTLEELRRRVEEVSRRNKESLEDIRRKLEEAIRRLREKTR

SEQ ID NO: 17994 - protein, 179 aa, Artificial Sequence; identical to SEQ ID NO: 17993
  Synthetic sequence.

SEQ ID NO: 17995 - protein, 179 aa, Artificial Sequence
  Synthetic sequence.
DGAEEVDDRLKKADEELRRKDKESDEKTKRIAEELRKLLEESKKKTEDLVRRLDEEDQRDELVRRTLREIEEDHERIDRRLKEKEEEVKREHEKIARELEKKNKEIRDELKEIADRNSVPEKRLRELEKKVEDVSRTNKKTLEDNRKKIAEVVKRLDEEIKRNKDTVRRVVERVKKDTD

SEQ ID NO: 17996 - protein, 179 aa, Artificial Sequence; identical to SEQ ID NO: 17995
  Synthetic sequence.

SEQ ID NO: 17997 - protein, 180 aa, Artificial Sequence
  Synthetic sequence.
ERKERLKERLDEVKKEHERLVERWHRENREVLRENRETVERLERELERVLRELRDALREQNRDEKAEKILRDLERKVRELKERAKRLHDKLEEENREVNKKIKKDSDDLREELEDETRKIKERRDEELEKRIEEVERKLRDTNRKIEELLKRLKKRHEEVDRELERLLEKLEREAEETRR

SEQ ID NO: 17998 - protein, 180 aa, Artificial Sequence; identical to SEQ ID NO: 17997
  Synthetic sequence.

SEQ ID NO: 17999 - protein, 180 aa, Artificial Sequence
  Synthetic sequence.
SEEEELEKELEKVLRENEESVRRLHKRNRDVLKKNRETLEKLEEDLKRVLERLKRALDRKNTPDEARKIIKRLKEKLERLVEEARELHRRLEEKNRDLNRRLKEKHDRLRKEVEDLRRELKARREKEARDEVRRLKKKMDDVDKDVERLVRELEKEHEEVDKDLRRKLDEVRKELEDARR

SEQ ID NO: 18000 - protein, 180 aa, Artificial Sequence; identical to SEQ ID NO: 17999
  Synthetic sequence.

SEQ ID NO: 18001 - protein, 182 aa, Artificial Sequence
  Synthetic sequence.
SEEERLEKELDEVLEDHKRRVEEWKKKMDEVNKKHKESIDRLREELDRVLDEVRKAGLDEKKLRELEKKARDLKEKIKKRTEEIKESNKRIKDEIKKLSDDLEKEARDLKREIRDLKRRGEPREEALKRLEELVRKLKEKLERINRRIARIVDKNTKEIKDTNDTLRKEVRDLMKELKDRTR

SEQ ID NO: 18002 - protein, 182 aa, Artificial Sequence; identical to SEQ ID NO: 18001
  Synthetic sequence.

SEQ ID NO: 18003 - protein, 175 aa, Artificial Sequence
  Synthetic sequence.
REDEEVKKELRKILEDHKRRVEDWKRRLKKNLEEHRRRVEEWKRRLDELLEKVRRAGLPEEVLRELEKVVREIKERIDRLDEEYEDLLRKIEEEAEEMNRRLEELVRELERLIERKDLSEEEIKRVIERLARDARRINERLRELLERLSEISERINREIEKIIDEARERLEREER

SEQ ID NO: 18004 - protein, 175 aa, Artificial Sequence; identical to SEQ ID NO: 18003
  Synthetic sequence.

SEQ ID NO: 18005 - protein, 175 aa, Artificial Sequence
  Synthetic sequence.
SEKEEVKKRLKDNMRRAEELIRRDDREVEENRKRHDELVKEWDKRLREILKKAEDSGLPEEVKKELKEIVDRIREEMKRLNEEYKRLVEEHKKRNEKVLRDYRDLLRRIEELIERNDLSEKEIKEVLEELSRTSKRLIEDSKRSSERLSERSKRTNEEIERIVRAAKRTIEERER

SEQ ID NO: 18006 - protein, 175 aa, Artificial Sequence; identical to SEQ ID NO: 18005
  Synthetic sequence.

SEQ ID NO: 18007 - protein, 183 aa, Artificial Sequence
  Synthetic sequence.
SVAEELEERLKEIKRESEKSIRDLRRLLEEIERRLRDINRKLDEIVKRVAEKIKDAETKGAPKEELDKELDKDRRDLERRADESRRELRRLEEEMKKKEKESRDRLDELRRRMEDRLRKNKEVDKKVVDDVERKLREIIRRHEEELKKIKEDLDKIREDHERLLREWKKELDELITRVAESAR

SEQ ID NO: 18008 - protein, 183 aa, Artificial Sequence; identical to SEQ ID NO: 18007
  Synthetic sequence.

SEQ ID NO: 18009 - protein, 183 aa, Artificial Sequence
  Synthetic sequence.
SVSKKLDDELRKMEREIEKSNETIKKLIEDIRRRSKESRDRLKELLEEIKKRLKEAEERGEPKEELDKKLEKMVRDAKRELDESRKELDKLKKEIEKVLRDSRKKLKKIEDELRRELEENKEIDEKVVEDIERRVEKVLTDHERELERVERELDDIIRRHEEELEKIERELEKIKEDVDRSAK

SEQ ID NO: 18010 - protein, 183 aa, Artificial Sequence; identical to SEQ ID NO: 18009
  Synthetic sequence.

SEQ ID NO: 18011 - protein, 181 aa, Artificial Sequence
  Synthetic sequence.
DELDRLRELLEELKRRSETVIKEAEELLRKLERELRELIREWKEITERLARRMEDLSRKGVDERTVEKLAREVKEANKRLEDRLREVKKKITRDRERLEKRSEELERRAKEELDKLRKGGLQREDLKRIEEELREILKRHRDANKRIKDEVEELLKRVEEMLRRLHEEDRKLLEDLKRETD

SEQ ID NO: 18012 - protein, 181 aa, Artificial Sequence; identical to SEQ ID NO: 18011
  Synthetic sequence.

SEQ ID NO: 18013 - protein, 181 aa, Artificial Sequence
  Synthetic sequence.
RETEEVKKDVDRIRKASEDVARKMEKITRDVAKELRDLIEEWRRRSEELKKELEDLSRRGVSKEDLKRVAEKIEKINEDIKRRLEETSRKNEELNRRLKEESDKLAKEVEDRLRRLREGGLPEDELKRIEEELRKILKEHEDKNREIKKENDRLNKEVEEEAEKATREDKRLLEKADRDRQ

SEQ ID NO: 18014 - protein, 181 aa, Artificial Sequence; identical to SEQ ID NO: 18013
  Synthetic sequence.

SEQ ID NO: 18015 - protein, 174 aa, Artificial Sequence
  Synthetic sequence.
SEKEEIEKRLDKLLKEHEEENDKIRRTLKEINDRSKEEVERIEERLKDLLRRLRERIEPREELKKIEDEVREVIREAREELEKLNRKDREIEKTLKKLSDELRKKVDDLKKELRTDEDTKRARDRLEELRRESEELIKTARDLVRRSEKEHRDLIERLRRILEELREKLERKTT

SEQ ID NO: 18016 - protein, 174 aa, Artificial Sequence; identical to SEQ ID NO: 18015
  Synthetic sequence.

SEQ ID NO: 18017 - protein, 185 aa, Artificial Sequence
  Synthetic sequence.
SVKEEVRTLLRRLERVSRELIRRLKEMLKTLHEENKKLIDDSRKLIRKIKRDLERVAERRARDEELKDLLRKLEELVRRLKEENDRLTDESRKKLDELRKEIKKLSDELRRDIKELEDRLDEKLRDKDTVKKVKEDLKDILRRHEEANERIRDELRRNLRKHEDDSKKSKEELDRILKKARDDAR

SEQ ID NO: 18018 - protein, 185 aa, Artificial Sequence; identical to SEQ ID NO: 18017
  Synthetic sequence.

SEQ ID NO: 18019 - protein, 185 aa, Artificial Sequence
  Synthetic sequence.
DIEDELRKELEKHHTKSREVKRRLTELLKRHEDRVEEVERRLRKDLKELRDRIEELSKIREEEMVERARRELKKIKEDVKKETEDVERESEEIEKELRERLKRVEEESRRVEEELRKKIEKNKDLDEKVAREVEERLKRDHDDLRRVIEEIRKRLEDSHRELKKTIEDVKRRVEELIEEAERRMK

SEQ ID NO: 18020 - protein, 185 aa, Artificial Sequence; identical to SEQ ID NO: 18019
  Synthetic sequence.

SEQ ID NO: 18021 - protein, 185 aa, Artificial Sequence
  Synthetic sequence.
SIREKLREVLERHHRTSRKVEEDLRRKLEDHHRKTREVAERLKEKVDRLREEIKRASRIREEEVVREIEERLKRMKEEIKTLADKVRDTSRRVKEELDRLLEEVERRSEKVERELEKRLRENKDLDERVVRKIEKDLRDDHRRLKEIAKRIDDEARRDIKRLEEIIKKIEEEVDRLIEEVRRRDK

SEQ ID NO: 18022 - protein, 185 aa, Artificial Sequence; identical to SEQ ID NO: 18021
  Synthetic sequence.

SEQ ID NO: 18023 - protein, 178 aa, Artificial Sequence
  Synthetic sequence.
DKDREIERLAKEAKDRHDKTLEDDRRRLEEVRRKIEETIRRIKKKLDEAKKRLKELVRDKPVEEELEKDVERRLKELEDELRELLRELEERVRESEKRFKELTDELKALIDRLREDIKREGVTEEILKELEEIVRRVEEKNKRLHDENEKDTRRVEAVLEDIKRRIDEIVRRLEERIK

SEQ ID NO: 18024 - protein, 178 aa, Artificial Sequence; identical to SEQ ID NO: 18023
  Synthetic sequence.

SEQ ID NO: 18025 - protein, 178 aa, Artificial Sequence
  Synthetic sequence.
DEKDRIDKRMKEVLKKIEELIRRDERRLEKVRKDHEELVRRIEDELRRVLEELKKLVEEKEVDKKLEEDVRRVVEEIKRKIEKHHEELERLVRESEKRLKKLLEDAKKELDEIREEIKRDGVTEDIERKIRELEEKVERELKKIHDENEKLAEKARRDLERIEREIDKLVKDVEDAIR

SEQ ID NO: 18026 - protein, 178 aa, Artificial Sequence; identical to SEQ ID NO: 18025
  Synthetic sequence.

SEQ ID NO: 18027 - protein, 178 aa, Artificial Sequence
  Synthetic sequence.
SEKDKITKTLEDAKRDHRKLVEEDEKALEEVERRHEEIVRRIEEKLKEAKEELDRLVRDKPVPDDLKREVRKLLEDLKRRLKKHHDELRKLVKESRDRLKEHHDRLEEELRRIKDRIRKTGVDEKILREIEERIKEVKENLRRVHEENRELAKKVLKDLERILEEIKKIIKELRERVK

SEQ ID NO: 18028 - protein, 178 aa, Artificial Sequence; identical to SEQ ID NO: 18027
  Synthetic sequence.

SEQ ID NO: 18029 - protein, 178 aa, Artificial Sequence
  Synthetic sequence.
SKKDEIEETIRRARERIKTIVDRIREELKRIRDKHKKLVDEDKKTLEEVLRTLRELVRDKPVDDRLLREVEKLLEDSKEEIKKHHEELARRLREIEEKIKRLLEEAEKKVEDVRDEIRKTGVTDEILEKVKELVREVEEVLRRIEKEIEDLVRKVEEDLRRIHERNRELAKKADDDIK

SEQ ID NO: 18030 - protein, 178 aa, Artificial Sequence; identical to SEQ ID NO: 18029
  Synthetic sequence.

SEQ ID NO: 18031 - protein, 178 aa, Artificial Sequence
  Synthetic sequence.
SKEEEIEKTLKKIEEDHRELVRRIERALDDARRRHKELVDRDDKELRDAERELDRLVREKPVPEELKERVKRLVKESKEEIDRHHKELEKRLKEIKEEIDKHHRELKERLDRIRERIRKDGATEEILKEIRDLADEARRNLERILRDIERVVEKVERDLKRIHDKNKRDVERVRREVK

SEQ ID NO: 18032 - protein, 178 aa, Artificial Sequence; identical to SEQ ID NO: 18031
  Synthetic sequence.

SEQ ID NO: 18033 - protein, 178 aa, Artificial Sequence
  Synthetic sequence.
KEKDDIDRDLKRAEEEHKRLVDEIRETLKEIEREHRERVKRIKEKLDEAKRRLEKLKRDRPVEDKLEKDLERRLREIEKKLRKHHKEVKDILRAIEEEIRRHHRTVRERLRAIRERIKKDGVTEKILEDIKREVDRVRKNLKEIKEKIDKEREDVKRDLDRIRKEIEELVEKVDRDVK

SEQ ID NO: 18034 - protein, 178 aa, Artificial Sequence; identical to SEQ ID NO: 18033
  Synthetic sequence.

SEQ ID NO: 18035 - protein, 178 aa, Artificial Sequence
  Synthetic sequence.
DKARKIEEDIRRAEEEHKELVKRNEERIKEVAERHEETVRDIERKAEDIRRELKKLVDEKPVPEELKRDFEELIKELREELRRHHEKMKRLLDEMRKRHKEHHDRVRELSKRVKDDIDREGVTKEILDEVKKLVDEVRANLEKSHEDIERLVEKVREDLKRIEERLRKIAEDLRRRVK

SEQ ID NO: 18036 - protein, 178 aa, Artificial Sequence; identical to SEQ ID NO: 18035
  Synthetic sequence.

SEQ ID NO: 18037 - protein, 178 aa, Artificial Sequence
  Synthetic sequence.
EEEREIEDTIRRAEEEHRKRVEDNKRRLEEAEKEHRKRVEDNKRRAEEIRRKLKELVDRKEVDERLDKRADEVLRRLEKRHRDHHEDLKKKLDDLRREHEEHHRRVKELERRVKEEIRREGVTEEILKKVKELVDRVRRNLERSHEKIKRIEDKVRRDLERSHKELEDLMRRMEEEIR

SEQ ID NO: 18038 - protein, 178 aa, Artificial Sequence; identical to SEQ ID NO: 18037
  Synthetic sequence.

SEQ ID NO: 18039 - protein, 175 aa, Artificial Sequence
  Synthetic sequence.
EKKERIEERAKEVEREHREIVKRDEEELERVREEHEESVRRDRKALEDVERDVRRDGIEKEVLDEIKKRLERSREKLDKLSRDVEKELEESKRKLEKLSRESKKKLEDLRRELTRGEVPMEDMLRKVKEVADENRERLKELHEENERTARRLRKLNRELHEENKRLVEEIKKEAK

SEQ ID NO: 18040 - protein, 175 aa, Artificial Sequence; identical to SEQ ID NO: 18039
  Synthetic sequence.

SEQ ID NO: 18041 - protein, 175 aa, Artificial Sequence
  Synthetic sequence.
SKAEEIRKELDRVRREIEKRAEEDKRTLEEVRREHEKLVRENEETIKRVEEDVERAGIDEKKKREIKEALDDLRRKHEKLSRESEDAIRRSEKELRDLKEEIDRLLDRLRRILDEGRVPMEDALREIKEVADEVRKKLRELHEKNKKLMDDNRRKLDKSHKDVREVEREIRERIK

SEQ ID NO: 18042 - protein, 175 aa, Artificial Sequence; identical to SEQ ID NO: 18041
  Synthetic sequence.

SEQ ID NO: 18043 - protein, 175 aa, Artificial Sequence
  Synthetic sequence.
DKERRIEEELEKARRDHKEDVDRDRERLKEVREEHERLVRENKKRLEEIRKELEDRGIERELLEEARKLLEDLKRKHEELSRRSEELIKRSEEKLKRLSDESERLLRELREKLKRGEVPMEDLLREVKRVVEKNKEDLKRLHDENEKLAEENRRRLKKSHDEVEKVAEDLKRKAK

SEQ ID NO: 18044 - protein, 175 aa, Artificial Sequence; identical to SEQ ID NO: 18043
  Synthetic sequence.

SEQ ID NO: 18045 - protein, 175 aa, Artificial Sequence
  Synthetic sequence.
EKKERIEDDLRRVKEEIDDLLRKNEKRLREAEDEHRKRVEDDRRRLDEVRKEVDDEGIDERVKREIERLLRESEEELKKLSDESRRTMKKLRDKHREDEEDIKRLLEELKRELDRGEVPMEDALRKLKRVADEIRKRLDESHKEIKKVVDDNRKKLEELHRKNRELERKIREDAR

SEQ ID NO: 18046 - protein, 175 aa, Artificial Sequence; identical to SEQ ID NO: 18045
  Synthetic sequence.

SEQ ID NO: 18047 - protein, 171 aa, Artificial Sequence
  Synthetic sequence.
KDEERIKKKLKKLVDENRDLNRRIEETNRRVAEDLDRRLKEIEKRNRDMAEELRKSDRSRETVKEMLKRLEDEDRKLSKEIRDRLRDLEREDERLHEEDKRHLERVDEELKRSNIDDEIRKRAEDAERETRETNRRIRDHTRRVAERVEKVLDEIRRHTEEVKKEVDEKER

SEQ ID NO: 18048 - protein, 171 aa, Artificial Sequence; identical to SEQ ID NO: 18047
  Synthetic sequence.

SEQ ID NO: 18049 - protein, 171 aa, Artificial Sequence
  Synthetic sequence.
SDEERIKDKLEKLVKENEDKNRRILEENKRVADENRRLNEEIEKRLEEMVEELERRDDSEESVKKALDDLEKELRDLNREDREHLRKLSEDLRKMKEEDKKHAEDVRRDLERANIDEEIRKRVKEAEDKTEETNRRIEKHHREVKKESEESNKRITDRLEEVKERVTRKRK

SEQ ID NO: 18050 - protein, 171 aa, Artificial Sequence; identical to SEQ ID NO: 18049
  Synthetic sequence.

SEQ ID NO: 18051 - protein, 171 aa, Artificial Sequence
  Synthetic sequence.
KREEDIKRRLEKLAKENRERNEEIKRRLDELVDRNREENEKILRELEKMVRELERSDRDRSVVEKELRDLEERIRRMHERDKEDLRRIEETLRELKERDKRHLDEVEKRVEDDNLDEEARKRLEELKKETEDTNRRIDEAVERAKEETRRTNERIKEELKRVKKKVTDKRR

SEQ ID NO: 18052 - protein, 171 aa, Artificial Sequence; identical to SEQ ID NO: 18051
  Synthetic sequence.

SEQ ID NO: 18053 - protein, 178 aa, Artificial Sequence
  Synthetic sequence.
SEVETAKEDLKKKVEENEKRIKDVEDKLRKTVEDNRKRLEDVLEELRRSVETLRDLLRKGTREEELETMLRDHRRKDKEVEDENRKSIKEHREENRRVEEENKKSKEELRRRLEDLRRKGVVDEELEKRLREAEEKSDRLLRRLKEESRKAEEDSKRLLKELKEESRRAEEEVRRARD

SEQ ID NO: 18054 - protein, 178 aa, Artificial Sequence; identical to SEQ ID NO: 18053
  Synthetic sequence.

SEQ ID NO: 18055 - protein, 178 aa, Artificial Sequence
  Synthetic sequence.
DEKEEAKERLKELRRRLEETDKRVDEELEKLMREMEDTDRRVKEKVDRSRREADEVLRRGTDDETLKRLKEKHERDDKDIEDKNEELERRLERRLREIEKRNRELNERAKRELEDLERKGVVDEELKRRLRKVSEENKESNERLRRKVKRVVDENRRTNKELKETSKKVKEDIERKRK

SEQ ID NO: 18056 - protein, 178 aa, Artificial Sequence; identical to SEQ ID NO: 18055
  Synthetic sequence.

SEQ ID NO: 18057 - protein, 181 aa, Artificial Sequence
  Synthetic sequence.
SELEEVTDRLRKLAEKARRLDKEYEEKSRKLKEEVERIDEDLDRLLKELTDEVREIAERGTDEEVVKDLKRKLKKLKRDIEELHKRLHDRNRELERELEEIHRRLREELDKLRDDIRKAGLPEEALRRIEKEIREVEKENRDTLERLRRHDEEVNRTNKETLDRLDEKLKRVEREIDERRK

SEQ ID NO: 18058 - protein, 181 aa, Artificial Sequence; identical to SEQ ID NO: 18057
  Synthetic sequence.

SEQ ID NO: 18059 - protein, 182 aa, Artificial Sequence
  Synthetic sequence.
DEEEDLKEKVKKVETEHEETLKEIRRKLEDVKREHEKTVEEIRDHNRKVEERIRDVERRKDDKSRELEERSERLKRKLEKHNRELDELSKELEELIERLKRDIDRVTEEVRRKLRKLERDVDREGATERIRERLEELMRDARRLNRELDEKVRKLVEKARRDNTRVKKKSRELMKEIDDELR

SEQ ID NO: 18060 - protein, 182 aa, Artificial Sequence; identical to SEQ ID NO: 18059
  Synthetic sequence.

SEQ ID NO: 18061 - protein, 182 aa, Artificial Sequence
  Synthetic sequence.
DEEEELKERIERVKDENRRSVERLRRELKRVEDDHRETVKDLERRLREVKKEIEELVRRKDDRDERLKKILKELEEELRKLKEDIDRVSKELKERIEELKKRVDRIHKELKKKAEDLEREVRRDGATEELKKKLEELMKEVRDLDRELKREVEELEREIRRLNKEIRERIEDLVRKAREAIR

SEQ ID NO: 18062 - protein, 182 aa, Artificial Sequence; identical to SEQ ID NO: 18061
  Synthetic sequence.

SEQ ID NO: 18063 - protein, 182 aa, Artificial Sequence
  Synthetic sequence.
REEEELKKKLDDVRRENEESVKKIKEDIDRVRREHEKTVEEIRRHNKKVEEEIRAEVRRKDDRDSRLERILRELKRLLEEHNKELDELSERLERELRAVEEKIERIHDDLARKLEKLAEEIKKDGADDRIREEIEKLAEEIRRLDERLEEELREIVRKMRELNRRVAEKSKELTEDARRRLK

SEQ ID NO: 18064 - protein, 182 aa, Artificial Sequence; identical to SEQ ID NO: 18063
  Synthetic sequence.

SEQ ID NO: 18065 - protein, 178 aa, Artificial Sequence
  Synthetic sequence.
SEREEIRERLRRNLEELRKSIKKIEDDLRRLEKRHRDAVKEIEDRLRRLEEKLDEMAKRDSDEETVRKIKEEVRRKVEKIKEEIRKHHEEIEERLRRIRKELKEVEDEHRRRVEKLERDDLPREDVKRAVDEIHKHTKEKEDRLRKLLKDLEKNIEDAIRRLEKLLRDLEEEIKEAAK

SEQ ID NO: 18066 - protein, 178 aa, Artificial Sequence; identical to SEQ ID NO: 18065
  Synthetic sequence.

SEQ ID NO: 18067 - protein, 181 aa, Artificial Sequence
  Synthetic sequence.
EESERILEKIRRAAEEDKERIRKAIEELRKLAEEDERKLRKANKEARDSARELRRLLKEGLDREEVKEVRERHRRRSDEVHRENEEERRRVDEKLKRVHEENRKIEETLKRELEDVLRKTGEAEVVEEARRLIKKWREEVERLNEEIKKLVEDWDRRVKELNERHRDDDRKIEKEVEDEEK

SEQ ID NO: 18068 - protein, 181 aa, Artificial Sequence; identical to SEQ ID NO: 18067
  Synthetic sequence.

SEQ ID NO: 18069 - protein, 181 aa, Artificial Sequence
  Synthetic sequence.
SELEKALEEIKRLAEDDMRRIKKVIKELEKLARDDEKRLREVIERLETEVRKLEELLKRGLSDEEVRRILERIKRELKRVHEENERITRKVETDLRKVHEDNKRSLEELKKKLDDLVRKTGDTEVVDELRKRLKEVKERAEDLNRKLEELIRRWKERVERLNRELEKRMRDVEEKVRREEK

SEQ ID NO: 18070 - protein, 181 aa, Artificial Sequence; identical to SEQ ID NO: 18069
  Synthetic sequence.

SEQ ID NO: 18071 - protein, 181 aa, Artificial Sequence
  Synthetic sequence.
SDLEKILEELKRLAEEDKRKLEEVIKKLEEAARKDAEDLKKVNEEAKKSARELEELLKRGLDRKEVREAEERHERRSRDVHRRNREKKDRVTKELRKVHEDNKRSLEELKRKVDDAVRRTGDAEVVREIEELLKKIEEEVRRLNEELKRLADEWRREVRRLNEEHKDTDRRIKERVKRAEE

SEQ ID NO: 18072 - protein, 181 aa, Artificial Sequence; identical to SEQ ID NO: 18071
  Synthetic sequence.

SEQ ID NO: 18073 - protein, 181 aa, Artificial Sequence
  Synthetic sequence.
KDMERMLKEIEDLARKLREELKRVLDELRKTAKRDEEELKKVNKEAKESARELEEKLRRGLSREEVEKDVRDHRKKSEEVNRRNRERRKKTREDVERVKRETRRKEEALERRLKEVVDRKGDTEVVKELRKLLKKIKDDVRRLDKELDELLRRWEESVERLNREHKKTDEKVEEDVKRTTT

SEQ ID NO: 18074 - protein, 181 aa, Artificial Sequence; identical to SEQ ID NO: 18073
  Synthetic sequence.

SEQ ID NO: 18075 - protein, 182 aa, Artificial Sequence
  Synthetic sequence.
SEEEKVEKELRDLVREDDRRLREVEERVRKVVKEAEDDHRRVKEDIRRMVEEIRKKLDKDGKSDRIARELDELLKRLEERLREVEKRSKELNEKLKREIEKVHEENKKLLDEIRKRLEDATRRGTSSERLEDEVRKVEDRSRRMNERIDERLKRVEEESKKAIEELRRELERVKREVEERKR

SEQ ID NO: 18076 - protein, 182 aa, Artificial Sequence; identical to SEQ ID NO: 18075
  Synthetic sequence.

SEQ ID NO: 18077 - protein, 182 aa, Artificial Sequence
  Synthetic sequence.
SEVEEVKKELEKLAREDEKRLEDVKEEVKESARRDKRRLEEVEEDLDRLVKELEDKLRDDGKDDKLKKEVEDLLRKLEERLRRVHEENKKILEEHKRRSDKVHEENKETLKDIRRRLKEAEDRGTSTDELKRKLKRVEERSREVNRELRERDKKIEEDSRRINKRLKKKVDEVKEKVREDTR

SEQ ID NO: 18078 - protein, 182 aa, Artificial Sequence; identical to SEQ ID NO: 18077
  Synthetic sequence.

SEQ ID NO: 18079 - protein, 182 aa, Artificial Sequence
  Synthetic sequence.
DEEEDVRRKLEELARRLKRRLEEIEKRLRDSVKEDRRKLEEVKEKLRELIKKLEDEIRKKGTDRRLRDEVKKILDEIKEEITRVHEDNKRRLKEHKETSEKVKREIEDALRKIEDELRKAEERGTSTEKLKEDVERVKRDVRRVIRELEKTDERIERESRKVNEELKELVERVERSVKKADE

SEQ ID NO: 18080 - protein, 182 aa, Artificial Sequence; identical to SEQ ID NO: 18079
  Synthetic sequence.

SEQ ID NO: 18081 - protein, 182 aa, Artificial Sequence
  Synthetic sequence.
DEDREARKKVEALLKEVEDRVRESKKRTKDLLREIEKRLRDTTREIDELRRRIEDLSRRGEPKEDVLRELKKKLEELLRKDEKINRDLRRKLERLRREHEKILKRLEELLKELEDELREAGLPEEVLRELKELLDKIRETIERASKENEELLREIEKRIEDANRENTERLRRIEKRIDDDAR

SEQ ID NO: 18082 - protein, 182 aa, Artificial Sequence; identical to SEQ ID NO: 18081
  Synthetic sequence.

SEQ ID NO: 18083 - protein, 171 aa, Artificial Sequence
  Synthetic sequence.
SEKDELRKRVEDIKETAKKVVEELREASRKIHEDNKRVNDRLRKESKRIKDKADKLDIPEESLKRLKKEHEDTDRRIRETDKKLNDDHEDKNRKIEEELDRLIKEIKERDERKPVDERAREEVRRIEKTIRDTARRVRERVRDSERRFRKLVREWEKLVEDSERKIDELSK

SEQ ID NO: 18084 - protein, 171 aa, Artificial Sequence; identical to SEQ ID NO: 18083
  Synthetic sequence.

SEQ ID NO: 18085 - protein, 171 aa, Artificial Sequence
  Synthetic sequence.
SAKEEIKERVKRIEERLRRLLKELEEKVKRIHDENRKVNKELTDRSKEIKDRLKDLDIPEEALRDLDRRHDETNKRIREEDEKLNREIKERLERLKRKAEKLREEVEERDKRKPVSEEVREELKRIEERLDRTLREVRKTLEDIERRIRKAVEDWRRLVKESEERVKRLTD

SEQ ID NO: 18086 - protein, 171 aa, Artificial Sequence; identical to SEQ ID NO: 18085
  Synthetic sequence.

SEQ ID NO: 18087 - protein, 178 aa, Artificial Sequence
  Synthetic sequence.
SEEERVRKDLKELHEHLKREVDKARKDLEDMHRHSEELAREVRERHERSKRELDELERRGTDEKTIRDVERKNRDTNRRIREEMERHKKKLDEILERIRKSLEDHTKRVREVLKELAKENVKSEEIEERVRRNEDTLRRVLKELRERAKRNKDDIRRVLKELEDRSREIEKKLREAER

SEQ ID NO: 18088 - protein, 178 aa, Artificial Sequence; identical to SEQ ID NO: 18087
  Synthetic sequence.

SEQ ID NO: 18089 - protein, 178 aa, Artificial Sequence
  Synthetic sequence.
TEEERARETLDRLNKHSKELVDRVREKLKRLVEHSRELLRRVDRKHKESEKRVREVSRRGADSKTMREIEKDNDRTNKEIKERLDRHKKKLDEILEEIRDELRRHKEKLDRILERLAENNVKTDEIERRVERNKREIDKVLKELEERVRTNKDEIDKALEKLKRLSEEIKRKMREDET

SEQ ID NO: 18090 - protein, 178 aa, Artificial Sequence; identical to SEQ ID NO: 18089
  Synthetic sequence.

SEQ ID NO: 18091 - protein, 178 aa, Artificial Sequence
  Synthetic sequence.
KEKEELDETIRRLEEHSKKKVDKVRKELKEMDEHSRDEARRVRREHEKSEEKVRRASEEGRSKEVMKRLKEENRDINRRIRERVKEHKRRLDEIEERIRRTVEDHKRKVEEVARRVRERGVESEEARERLRKNEEEIKKVLEELERRVRENKERIDDVERELEDLSRKIEEKLDRDDT

SEQ ID NO: 18092 - protein, 178 aa, Artificial Sequence; identical to SEQ ID NO: 18091
  Synthetic sequence.

SEQ ID NO: 18093 - protein, 178 aa, Artificial Sequence
  Synthetic sequence.
KEEEEARRTLERIERRIRKALKEIDETLKRLNDHSAKRVKEVREKHEESRRKVDDVSRRGTDDDVARRLKRENDEINKRIEDTVRDHKRRLDKILKDIKKRLDDIKRDLDRVAKELRERNVQTEEIRERVKRIKEEMDRALKRLKDKVKENKERIDEVLKDLRRTSKEIKERLDRSTK

SEQ ID NO: 18094 - protein, 178 aa, Artificial Sequence; identical to SEQ ID NO: 18093
  Synthetic sequence.

SEQ ID NO: 18095 - protein, 174 aa, Artificial Sequence
  Synthetic sequence.
SKKEELERLLEEAKKKHEESERRLRESSKKLEEEIRRMKEHSKKSSEDAEDKLRRNRASEELLKEVKKMNEELKKKHEDLEREIEESNRRIEEKLKRNKDKSRKEEEDVRKILEDGDTGDELLERIKDLVRRSEEENKKLLDEHRKIVKTLKERLEKLNEEHERIVREVERRTR

SEQ ID NO: 18096 - protein, 174 aa, Artificial Sequence; identical to SEQ ID NO: 18095
  Synthetic sequence.

SEQ ID NO: 18097 - protein, 174 aa, Artificial Sequence
  Synthetic sequence.
SSEDELRRLLKEARDTHRESEKRLRDSSKRAEDMHEKSKEDVERSSRELEKELRRRRADEELKRKVKEKNDEIKKKLEDNEDKSRKENEKLRDKLRKNKEESDRLVKRLEDIARRGDTGERLLDEVRKEMKRSEEENRRLLREHEEVVKKSIKENKELLDKHKEIEDRLREEIR

SEQ ID NO: 18098 - protein, 174 aa, Artificial Sequence; identical to SEQ ID NO: 18097
  Synthetic sequence.

SEQ ID NO: 18099 - protein, 174 aa, Artificial Sequence
  Synthetic sequence.
SEKETLKRLLDEIKKRHKESEDRVRKLVEDAREELDRVADELRKSSEDLRRDLKRANADEELKKKVEKLNRELEKKLRDLRRRMKEEEEELRRKLEENKKESDERVKRLEKIAKDGDTGSKLLREVEKLMEESRKRNEDLLKELRDIIEDLREKLRELLREHREAAKRLRDEIR

SEQ ID NO: 18100 - protein, 174 aa, Artificial Sequence; identical to SEQ ID NO: 18099
  Synthetic sequence.

SEQ ID NO: 18101 - protein, 174 aa, Artificial Sequence
  Synthetic sequence.
DERETLEKLLKEVRDMHEESKKRLTDSSRKLREDLRRVKEELDKTLRDIEERAKEENISEELKRKLDDLKRRLKEKVKKIEDEVEEKNERIRKKVEENETKSAEIEKRLRDIVRRGDTGSRLLEEAKKLIEESKRENEELLKEHDKIVKELIKKLRDLLKEVEDRARDVTEEAK

SEQ ID NO: 18102 - protein, 174 aa, Artificial Sequence; identical to SEQ ID NO: 18101
  Synthetic sequence.

SEQ ID NO: 18103 - protein, 174 aa, Artificial Sequence
  Synthetic sequence.
SSRETLDELLRRAEEIHRRSEEELRRSSEEVRRKHEKSERDLEKLLRDAEELLRRENVSDELRDEMRRKVEEVKKKADRNREESEDSNRKVDEDVKRNKEKSRELVKELRKIADAGDTGDKLLDTVRKLVETSRDENRKLLEDHKKMVKESEDRNRELLRDLERVIEELSRRIR

SEQ ID NO: 18104 - protein, 174 aa, Artificial Sequence; identical to SEQ ID NO: 18103
  Synthetic sequence.

SEQ ID NO: 18105 - protein, 179 aa, Artificial Sequence
  Synthetic sequence.
SEVEEILDRLRREVERSKKKVEDILRELKKLAEDTKEKVERVLDRNRKTIEELKKARLPDEELERALRKDRDELRRIKEDLERRHEEIARRVKEVEDRLRKEHERLEKELREVERDLKISEDLVTKLRDLLRRHHETLRRLAKELRDLLKKHHEELRRLIERLEKSLEDLERELDKTRR

SEQ ID NO: 18106 - protein, 179 aa, Artificial Sequence; identical to SEQ ID NO: 18105
  Synthetic sequence.

SEQ ID NO: 18107 - protein, 179 aa, Artificial Sequence
  Synthetic sequence.
SEVEKILEDLKKLIKESKDEADRILTDHRRLVKETEEEARRALERNRKTVDDLRKANLREDELRDALRRDEKELEDIVRRLRKLHEDLHRKLKKVTDKLRELHEELKRRVEEVERDLKISEEALRELRRLLKEHHEILRKVEEELRRSDEEHHRRLEEVERRLRKSLRELEETVRETTR

SEQ ID NO: 18108 - protein, 179 aa, Artificial Sequence; identical to SEQ ID NO: 18107
  Synthetic sequence.

SEQ ID NO: 18109 - protein, 179 aa, Artificial Sequence
  Synthetic sequence.
SEAERILEKLDRLVKETDRRVKEVLEDNRRTVRRLEEEVKRILKENRETARELEEANLPKEDLERRLRRDEEELRKMVEELRERLKRDAEKLEKIKRELRELHERLKRDVEDVTRRVKLDEEVLRRLKKLLDEHNERLRRLERDLDRSLKEAKETLDELERRLEKSLRELKESVDRTRK

SEQ ID NO: 18110 - protein, 179 aa, Artificial Sequence; identical to SEQ ID NO: 18109
  Synthetic sequence.

SEQ ID NO: 18111 - protein, 177 aa, Artificial Sequence
  Synthetic sequence.
SSEERLKEEFKRAAEKVRKVEEELRELHERVEKSSRDSKRRIRELLKRAEEEVKRVEDRGTDRRKKEEIKRVVDELRKDVRRVEKENDEELKKHNEDLKRVTDEIRKILKEMKEELDKRGASDEVLRDLKRLIEELEDKARRVLDKSRRIIERLRRKDEEVLRKLEKEIRELKKKAN

SEQ ID NO: 18112 - protein, 177 aa, Artificial Sequence; identical to SEQ ID NO: 18111
  Synthetic sequence.

SEQ ID NO: 18113 - protein, 177 aa, Artificial Sequence
  Synthetic sequence.
DEERELRRLLEDVKRRVREVEEELRRLHEEIKRTSKRSKEELRKLHKELEDAVREMAKRGTSKEKLDELRKELKKHNDRLRKVEEENDRKLERHNRRLRKVERELRELVKKLEEDVRRRGASDKVLRDLEELVKELKRRLDEVLETSRREAEKLKRDDEKVLRESKKIMEDLRRRAE

SEQ ID NO: 18114 - protein, 177 aa, Artificial Sequence; identical to SEQ ID NO: 18113
  Synthetic sequence.

SEQ ID NO: 18115 - protein, 177 aa, Artificial Sequence
  Synthetic sequence.
SEEDELRKLLEELRRRSKEVNDRLRKLHDELRRRVEDLKRKLRELHKEAAKIVEEMKARGTPEEKLRELEKSLEDHNRDLKRVEDEIDDKLRRHNEILKEVHKRDRDSLRRIEEEVRRRGASDKVLEDLRRLVEENTRRLEEMLKRSEKIARDLLEDVKRFLDESKKKIDTLRRRAE

SEQ ID NO: 18116 - protein, 177 aa, Artificial Sequence; identical to SEQ ID NO: 18115
  Synthetic sequence.

SEQ ID NO: 18117 - protein, 177 aa, Artificial Sequence
  Synthetic sequence.
SLEDELRRLLTEAEKRSKDVNERLRDLHREVRELSEDVNRKLEELHRELEERVKELKREGRDEEELRKIEETLKRHNEELKRVHERDRDTLREHNEKVKKVHDDDRRSLEELRERLKREGASDEVLKKLKELVRRNEEELEKALKESKDIVEKNKRDLDEVEKKSREIVRELIERTK

SEQ ID NO: 18118 - protein, 177 aa, Artificial Sequence; identical to SEQ ID NO: 18117
  Synthetic sequence.

SEQ ID NO: 18119 - protein, 177 aa, Artificial Sequence
  Synthetic sequence.
SLEETLEKLLREAEDISRKANKRLEEAHERIKRTLEDLERKLEKLNKEVRDRVERVKERGTPEEKLKDIERRLREHEKRSKEVRERLREDLEDHNRDLKRVHDEDKKSLDRLREELERKGVSDKVLEKLKRLIEENKKRLERVLEKSDKILDDLRRKVEEVLKRLEKTVKDLEDEAR

SEQ ID NO: 18120 - protein, 177 aa, Artificial Sequence; identical to SEQ ID NO: 18119
  Synthetic sequence.

SEQ ID NO: 18121 - protein, 179 aa, Artificial Sequence
  Synthetic sequence.
SEDEELLRRLEETIRRATERVKRLLDTLRKLAEDVRKELERLLDTHRELAKRIEDELREGRSKEVSDKVREENKEHHKEVERRLREIEERIRRHHKKVDEILKEIEKRLKEIIEEILRTRGRTPEEVERVLREVTKRLRDLKREHRKLLEKVKRELEKVEEDHRDSSRKLEEIIKEAEK

SEQ ID NO: 18122 - protein, 179 aa, Artificial Sequence; identical to SEQ ID NO: 18121
  Synthetic sequence.

SEQ ID NO: 18123 - protein, 182 aa, Artificial Sequence
  Synthetic sequence.
SEAEKLAKDIREAAKRLREHAERDKEELKKAADKLRDEARRDAEKLKRAAEKLKDLARRTGNTEELEKEAREIHERNKRNLERLEKEAREIHEENKKNLERLDREAERIEKEVRDAVRREQLDEEAAKRIKELLDKARKDLEDAKREAEELNRRAREELEKAKKDAEDLNRRAKEELDKARK

SEQ ID NO: 18124 - protein, 182 aa, Artificial Sequence; identical to SEQ ID NO: 18123
  Synthetic sequence.

SEQ ID NO: 18125 - protein, 182 aa, Artificial Sequence
  Synthetic sequence.
DDKDKLLEELRKVIEELEKKLEDNNRELEKVLEKLKREAERDLERLREMIRRLEELLRRDGPTEELRKDVERIHRENRENLKRIKKEVDEIKEKSKRSLEELKKEVDKIEEDLERLAREKNLSEEVLDRLRRIIEELRERLKRAEKSNRDILERIDRELEKLKRRAEELNEELRRRLKERRD

SEQ ID NO: 18126 - protein, 182 aa, Artificial Sequence; identical to SEQ ID NO: 18125
  Synthetic sequence.

SEQ ID NO: 18127 - protein, 182 aa, Artificial Sequence
  Synthetic sequence.
SRTEEVLKELRTLMRELRRRLEEVIKELEKSAEELERIAREVAKRSRKVIEELKRKADKDGTSDRLLEEVDKLLEEHNEELERVKKKLTDDLREHRRRSKEVKERLEKKLREIEKRLKEVVDRDGPREELEDLLRRIRETLEDMKRRLDELDTELEKRLREVARTLDELHKELEETLRRLKK

SEQ ID NO: 18128 - protein, 182 aa, Artificial Sequence; identical to SEQ ID NO: 18127
  Synthetic sequence.

SEQ ID NO: 18129 - protein, 175 aa, Artificial Sequence
  Synthetic sequence.
DAEDELRELSKRNKDEVREVKERLKKLSEENRRDLERVKRKLEKDSEENREALERENKENKEVVDRVEKVHRDIEERVKKIKREVDKLHREVEEEVERIERDLERVHRELEEDVKREGVTEELKKRIEELIRRSRKLAEDLKKKLEDIHRETERLVRELAELVRDLHRRTKEKAR

SEQ ID NO: 18130 - protein, 175 aa, Artificial Sequence; identical to SEQ ID NO: 18129
  Synthetic sequence.

SEQ ID NO: 18131 - protein, 175 aa, Artificial Sequence
  Synthetic sequence.
SAEDRLRELSKRNREEVEEVEKRLRELMERIRRRLREVKEDLRRLSEENRKTLERKNKDQRELVKRVEEEHRKIEEEVERTERRVEKVLEDIEREMDRIKKKLEDDHRKLEDEVRRRGVTEEIEERIKRLIKESRDLARELEEKLRKLLEELEKLAKRLREKVKELHDDTERAAK

SEQ ID NO: 18132 - protein, 175 aa, Artificial Sequence; identical to SEQ ID NO: 18131
  Synthetic sequence.

SEQ ID NO: 18133 - protein, 175 aa, Artificial Sequence
  Synthetic sequence.
SEEDELRELSRRNEEEVKKAKRDLEKLSRENEEDLKRVKRKLEKKSEDNRRILERDNREAEEVVRRVEERHKELRKRMEEIEREIRKVHEELRREVEEIEKDLRRVHDEIKKEIEDKGVTEEVKKKIEDLIRRSRELVERLKRKVEELHKTTKRLVEELEKTIDRIIEETRERAR

SEQ ID NO: 18134 - protein, 175 aa, Artificial Sequence; identical to SEQ ID NO: 18133
  Synthetic sequence.

SEQ ID NO: 18135 - protein, 183 aa, Artificial Sequence
  Synthetic sequence.
SAEDELRRLLRENRERNKKADKDIKKLLDDNRRDLERLRRELERILREIEKRLKDVEKDVEGRRLEEIRKRLERLRREARRELERLERHNRELLEEHKRKNEENEKHNRELEKEAEELSRRGTTEDVVRELMKKVDDDHKESEKLVRESEEKLERDNERTRRIADKLRKELDDTREEIERDAK

SEQ ID NO: 18136 - protein, 183 aa, Artificial Sequence; identical to SEQ ID NO: 18135
  Synthetic sequence.

SEQ ID NO: 18137 - protein, 181 aa, Artificial Sequence
  Synthetic sequence.
DSEERAEDVARENKEILERVDEKARKLLDDNRKVVEELKKTNEESSRELKRVLDELNIDEDLLREIEKLNRTLKKKTEDLAKDNKKIDDDLRRELEELKRENKEKDKRLREELEDLKRKGSSEETVEELLKKMRAISRDSERKVKELLDKIRELSDRSRRRAEELNKEHKKIVDDIAERRR

SEQ ID NO: 18138 - protein, 181 aa, Artificial Sequence; identical to SEQ ID NO: 18137
  Synthetic sequence.

SEQ ID NO: 18139 - protein, 181 aa, Artificial Sequence
  Synthetic sequence.
SVEERLRELVKENRDVVRRAEEEFRRLVEENKRILEEIDRRARESSRKLKDVLDKLNIDEDALRRIEERNKDVERKLEELKKRNKDKDEKLAREIEKLKAENEKEDRDLEREVRDLKKKGSSEETMERLLRKAKEISRRSKERLKRLLDKVKKLSEDSERELKKLLDEHEKIVEDIEREAR

SEQ ID NO: 18140 - protein, 181 aa, Artificial Sequence; identical to SEQ ID NO: 18139
  Synthetic sequence.

SEQ ID NO: 18141 - protein, 181 aa, Artificial Sequence
  Synthetic sequence.
DDERRLREVSDRNRRILDRIKKEVERLLDEVRKILKEAEDRLRRSSERLEELLRKDNIDEDKVREIRRLNEEIRKKVEELRKEIRDLLEELRKRADKLTEENKDTDDKLRRRAEDLKRKGSDEREVKKTLDEMRRRSRESEEELKKLLKEIKEIVEELKRKLDTLLKEHKEIVEEIKRRTT

SEQ ID NO: 18142 - protein, 181 aa, Artificial Sequence; identical to SEQ ID NO: 18141
  Synthetic sequence.

SEQ ID NO: 18143 - protein, 181 aa, Artificial Sequence
  Synthetic sequence.
SDEERVRRLEEEVDKTLEKVERELRKVSEENKRTLDRLRAEMEKSSKELERVLEELNIDEELRKEIKRRNDELRKELEELLTRNRKKDEDLKRRAEKLKREIERLKEELKRELEDLKRKGSDERDVERTLRKIEETVKKLAEDLKRLLDEIKKISEESKRRAEELLRKHKKIVDDIDKRTR

SEQ ID NO: 18144 - protein, 181 aa, Artificial Sequence; identical to SEQ ID NO: 18143
  Synthetic sequence.

SEQ ID NO: 18145 - protein, 182 aa, Artificial Sequence
  Synthetic sequence.
SMKEELDRLLKELRERNKEIEDRAEELLRRSTDSLRKVKEKLDKLLEESTRILRKVEKENRVSEDTLRELREIHERLRKELEDAKRDLDRDHKELAEKLEEIIRRNRENLRRLEREVEEMKKRNDLSEKVLKDIKRVIDEDEERLKRVLDDYERRVRELEDKVKKILDRYKTEVDKLRERAR

SEQ ID NO: 18146 - protein, 182 aa, Artificial Sequence; identical to SEQ ID NO: 18145
  Synthetic sequence.

SEQ ID NO: 18147 - protein, 182 aa, Artificial Sequence
  Synthetic sequence.
SVEEEIRDLLRKLREIVDRVRRRLKEILEESTRRLEEVTRRIDESNEDLKRAVDDVKRRNTRDEEVKRELDRKLKKIHDEDKREKDKLEKIHRDLTDKLEKAKRKLEELVKRIEKEVEDVRRENKLDKEVLRKLEEEIEKLRKEAKKILDEYRKLVEDLADKIKKILDRNRKLIEELVREVK

SEQ ID NO: 18148 - protein, 182 aa, Artificial Sequence; identical to SEQ ID NO: 18147
  Synthetic sequence.

SEQ ID NO: 18149 - protein, 182 aa, Artificial Sequence
  Synthetic sequence.
SESEKTLKDLDEISKRYEKKVREMLERHKRLSEETKKRDDEALERLTRLVKELKDVARRGDISEDEIRRTLEELRELVKDVKRRNDETNRELEERSDRVNKDLERINRDLKRLVDEAAKRGISEDVKRRLDELLERHKRISEEVEKRNEDLLREHEEISRRSKKRIDDLLREAERILDEMRR

SEQ ID NO: 18150 - protein, 182 aa, Artificial Sequence; identical to SEQ ID NO: 18149
  Synthetic sequence.

SEQ ID NO: 18151 - protein, 182 aa, Artificial Sequence
  Synthetic sequence.
SESEKVLRDLEKISEDTARRLEDELRKHKEIVDRIKEEDDEMLDRLRKLVETLKRLAERGDISDKVIRDMLRELRKRVREVEERNKRLNEELKKRSDEVNKELEETNRKLERDVREAERRGTSEEVKRRLEELLKRHKEESDRARERNERLLKEVRDLSEESRERIERLLRELEERVREDER

SEQ ID NO: 18152 - protein, 182 aa, Artificial Sequence; identical to SEQ ID NO: 18151
  Synthetic sequence.

SEQ ID NO: 18153 - protein, 182 aa, Artificial Sequence
  Synthetic sequence.
SRSEKSLKELREISERTRKRLEDKLDRHEKESKKVEDKAREVLKELEDLVRTLEEVARRGDISEEMIDRELKKLRERVKEIKDDLKRLNDELRERSKRVNDRLKEENEKLKRKIDEVEREGIDEEVRRRLRELLERHKRISDEARKRNEDLLREHEKRSRDIEKRLDDLLKEAEDRLRERKR

SEQ ID NO: 18154 - protein, 182 aa, Artificial Sequence; identical to SEQ ID NO: 18153
  Synthetic sequence.

SEQ ID NO: 18155 - protein, 183 aa, Artificial Sequence
  Synthetic sequence.
SDEEELRRLIEEHEKILKEIEDRVRESSKRNKEILKRLEDEVRKLLETVKDRLEKARERVDERLVKRVEERLEEIKRRVEELLKENEETDERLKKRVKETLDRSREEVKRVEERLRDLKRKGSSSETAKRVLDELKERSERSMEDLKRLLKEHKERVDEMRRRAEELLKRLREVIRKVEEEIR

SEQ ID NO: 18156 - protein, 183 aa, Artificial Sequence; identical to SEQ ID NO: 18155
  Synthetic sequence.

SEQ ID NO: 18157 - protein, 183 aa, Artificial Sequence
  Synthetic sequence.
SRDEEVKRLKKEHEDILEEIRKRVDESSKRNEKILREIKERVKRSSDDLKRLLEELRERVREREVERVEDENRRMEERVDRTLEKNRDLDRRLKEEVDRTLEESKKTVEELEKKLRDLKRKGSSEEDVERVLREFEEVSRRSEETLRRLLEKHKELVERAARELETLLKEHRERVRKIEEEAK

SEQ ID NO: 18158 - protein, 183 aa, Artificial Sequence; identical to SEQ ID NO: 18157
  Synthetic sequence.

SEQ ID NO: 18159 - protein, 174 aa, Artificial Sequence
  Synthetic sequence.
SSKERLEKLLRELEEDLRRAHEEHKRLIKRLREILDEIRKRVEKLNRDLDRVLERAREEGKLDEDLRREVEDIKRRNKENLKRLEDEVRRTEREIEELNKKLEKEVRDIAEDLKRKPVDEELLKEVKEMIKRLRKKIKKSLDDVRRVIRELEEHARRDLRKLEKDLKDIEDKLR

SEQ ID NO: 18160 - protein, 174 aa, Artificial Sequence; identical to SEQ ID NO: 18159
  Synthetic sequence.

SEQ ID NO: 18161 - protein, 174 aa, Artificial Sequence
  Synthetic sequence.
DSEERLKELERRLRELLKRVSERSKKLNKEHEEINRKAEEEVERLNRELERDLEDAARKGLLDKDLKKKVDDIRRDNRRNLEDSKRRSEKVSRENRERNERLRDRVRKIEKRLRERPVTDELLREAEKMLKELEELVREDEKRLKDISKEVEEHYRKDLEDVKRAIKEIRDRLK

SEQ ID NO: 18162 - protein, 174 aa, Artificial Sequence; identical to SEQ ID NO: 18161
  Synthetic sequence.

SEQ ID NO: 18163 - protein, 174 aa, Artificial Sequence
  Synthetic sequence.
DSERRLEKLLRELKELLKRVEESLRRLNEEHKRINDEARERSKRLNEELEETLRKAREDGRLDEELRKKVEEIRKRNEDKNRESEKDSERVRKENEDNLKRLKEKVEEIERRLRAKPVTEELLKEIKDRLKELAEHVERDERRLKRISEEAEKRYREDVREVKEMIEEIERELR

SEQ ID NO: 18164 - protein, 174 aa, Artificial Sequence; identical to SEQ ID NO: 18163
  Synthetic sequence.

SEQ ID NO: 18165 - protein, 174 aa, Artificial Sequence
  Synthetic sequence.
ESEERLRDLIRKIRELLEEIERRLRDLNRRLREILKRIEEESEKLNRELKKILDEARERGLLDKDLEREVRKISKDNKKKNDDLRRDVERISRENRKNLEKLKKKVKDIEEELRRKPVTEELLKEVRERLRELEEHARRDLETLKRMIRKLEEEAKKDLRELEKMIKDIRDKLK

SEQ ID NO: 18166 - protein, 174 aa, Artificial Sequence; identical to SEQ ID NO: 18165
  Synthetic sequence.

SEQ ID NO: 18167 - protein, 179 aa, Artificial Sequence
  Synthetic sequence.
SLEEALRKLEEELERLNEEAKRRIDRLIEELRRLNEEARKKIERLIEETRELLKRLAEEGKVDEELEKEVRRIEKENKEALDRSREETKRIEEEIKRVEEDSRKKTEEIKEELKELIRRDGGIDREILERAKELLKKLEREYRELLKKIEKVVRDLEEKYRELLKRHRKETERLDREVR

SEQ ID NO: 18168 - protein, 179 aa, Artificial Sequence; identical to SEQ ID NO: 18167
  Synthetic sequence.

SEQ ID NO: 18169 - protein, 179 aa, Artificial Sequence
  Synthetic sequence.
ELAERVKRLIEEHRKTDKEVEDRIRKLIEDHDRENRKVEDEIRKLIKELREIVDRARKEGKVDERVEEKLRRLEEEIERVLRELREESKRLEEEIKEVLDRLKEESKKLEEDIKEVLRRDGGIREEILDKIREVHRRVRKKARDLAERIKDAHRKLRKKVEELLRRIKEMIRRLEEELR

SEQ ID NO: 18170 - protein, 179 aa, Artificial Sequence; identical to SEQ ID NO: 18169
  Synthetic sequence.

SEQ ID NO: 18171 - protein, 179 aa, Artificial Sequence
  Synthetic sequence.
SDRERLTRLIEELRKLLEKWEREVKKINDEIRRTVEKVEEDSKKSIEDLRRLLKEMEDRGSVDEEMRKRVEEVERRNEKVLRDLRETLKKVHEDNKKITREVRERVKEVEKRLEDLRRRQEEDTKDLERRIEDVIRRLKKLADDDLRDLRRFLKELKERADKLRKEDEEALKELRDRAE

SEQ ID NO: 18172 - protein, 179 aa, Artificial Sequence; identical to SEQ ID NO: 18171
  Synthetic sequence.

SEQ ID NO: 18173 - protein, 179 aa, Artificial Sequence
  Synthetic sequence.
SREDDIRRLIEEARKLVEDAERRSKKSIDDIRRLVKEWEEEVKRINDDLKRLIDEARKRGDVTEEIEEDLRRMHKKNREIADRVRRELKRVEDDNKRVLDELREVLERIEREIEDLRRRNREPDKDLKERIKKLLDELRRLVEELEKRDKEMLDRIKKLADDDRRELERILKKLEDDLR

SEQ ID NO: 18174 - protein, 179 aa, Artificial Sequence; identical to SEQ ID NO: 18173
  Synthetic sequence.

SEQ ID NO: 18175 - protein, 179 aa, Artificial Sequence
  Synthetic sequence.
SAEDTIRTLLERHDDLDREVEERSKESIRELRRLIKEWRERVRKLNEELKRLLDDLRRKGLVDERLTKKVKDVHDDNDRIKKELTKRLREVEERNKEDLKRHKRESDEVKKKLTDLRRRKRNRKEELIEEIKEMNKKAKKSVDELEKKDRDVLDEIRKMAKEDLDRLRKALEDLERDAR

SEQ ID NO: 18176 - protein, 179 aa, Artificial Sequence; identical to SEQ ID NO: 18175
  Synthetic sequence.

SEQ ID NO: 18177 - protein, 179 aa, Artificial Sequence
  Synthetic sequence.
SSEDRVRDIERRHKEEDDRVEEESRRSTREIRELLRTAKERSDDSIRKLRKLIDDLRKEGLVDERLKEKLKRVEEENEEVLRRLEKRLRDVERENKKLLDDHKKKSKEVKDRLRKIETDQKRRTEELEKELEDVNRDVDRSAKRLKERDEEALKTLEDEIRKLEEKDKKVLEDLEREAR

SEQ ID NO: 18178 - protein, 179 aa, Artificial Sequence; identical to SEQ ID NO: 18177
  Synthetic sequence.

SEQ ID NO: 18179 - protein, 181 aa, Artificial Sequence
  Synthetic sequence.
SDKEEVDKLKERNERVLEEVRRRLEKLEKDNKDTLKKIRDDSERLREKIKRVRDREQISEEVEKKIKRDEDENTRHNEELEEDNRRKTERVKEEMKRIEDENEKKDRRFDERVKRAKENNSSREFVEKALREYEELLKRSRETLEELLRRYKKLLDESRKTAKEDLDRSEEIIKKLADESK

SEQ ID NO: 18180 - protein, 181 aa, Artificial Sequence; identical to SEQ ID NO: 18179
  Synthetic sequence.

SEQ ID NO: 18181 - protein, 181 aa, Artificial Sequence
  Synthetic sequence.
SDEEEVKKLHDENKKVNDEMREESKKLHDENDRVNKEVKERAKKVSKELEDMLRREQRPEEELKRIEEELRRLAEKVKDLNKKNKEIDDRNKDHNRELNKENKELDEELKKELDRAKRENSSEETVRRLLEKVREEIRRSKKRADDDLKTTKELIEKSEREVDRLLEEIKKIIEELERRAR

SEQ ID NO: 18182 - protein, 181 aa, Artificial Sequence; identical to SEQ ID NO: 18181
  Synthetic sequence.

SEQ ID NO: 18183 - protein, 179 aa, Artificial Sequence
  Synthetic sequence.
SELEKVLREVEENLREVKRENEEKLRRNEENIKRLEEEDRRRLEEIEKMIEEIERARIREDELDRRLRELRERVKKIEKKNRDHLRRDEKELRDVLRKHKKHAEETEKRVEDAKRRVLDGKEVEEELRRLREEYEEVSRRSKEELEKSLRRLEEVHKESRKRLRDLLKKLDDVAREERK

SEQ ID NO: 18184 - protein, 179 aa, Artificial Sequence; identical to SEQ ID NO: 18183
  Synthetic sequence.

SEQ ID NO: 18185 - protein, 179 aa, Artificial Sequence
  Synthetic sequence.
DELRELLKDIKRTTEDVEREVEEILRKVEEMIRRLEEEDRKVLEDIRRKIEDIRRANIPREELEEELKRLEEEIEKILRDNKRKLDELKEEVDRARRKLEKLSRDLEEKIKELARRVLDGEEVRKEMERLRREHEDVDKKVRDELRKLEEELRRVHRESEKALRDLLRKLREVAEREKT

SEQ ID NO: 18186 - protein, 179 aa, Artificial Sequence; identical to SEQ ID NO: 18185
  Synthetic sequence.

SEQ ID NO: 18187 - protein, 179 aa, Artificial Sequence
  Synthetic sequence.
DELEDFLRKVERVIKELRDDDKRALDRIREVTKDVERKAREILKRVEEVIRRIEESNIREDELKEVLERLKEEARRLKRELEKLSEELKKEIKEILDRNRKKLRDLEEEVKEVRKRVVRGREAEEALERLKTRLEKVHRDSKRALEKLRRDHEEVDKRITEELRKLMERLKRVVDELRR

SEQ ID NO: 18188 - protein, 179 aa, Artificial Sequence; identical to SEQ ID NO: 18187
  Synthetic sequence.

SEQ ID NO: 18189 - protein, 181 aa, Artificial Sequence
  Synthetic sequence.
SADEALRELEERNRKVNEDVKREDERLHREDREVNKRIREEDKKLHKTLRDVLEELRKKVSEEELKKIEERLKRVNDTNEDLHRRNEEKVRRLNEENRKKHEENEKKSRDLKEEFERDKDGDERRVEKLLRRYKKVLDEVKRELKESLDKAERVTRKSEDDARRSLEEIKKEIEEVRERIR

SEQ ID NO: 18190 - protein, 181 aa, Artificial Sequence; identical to SEQ ID NO: 18189
  Synthetic sequence.

SEQ ID NO: 18191 - protein, 181 aa, Artificial Sequence
  Synthetic sequence.
RVDEELRKLVEDNKRKNEEVKKELKKLKEENERVNKEVRERDRKLHEKLRRVLEEVRRTIREDELREIEETLKRLNDRNEELHRRNEEESKRAEDKVRTELEKNRKISEEIKKKAEDRKDGDEEEMRRLLEEYEELVRRVLKRLKEILEEYERLVRRVEEEVKKSLEDIERKIKEAKDRVD

SEQ ID NO: 18192 - protein, 181 aa, Artificial Sequence; identical to SEQ ID NO: 18191
  Synthetic sequence.

SEQ ID NO: 18193 - protein, 181 aa, Artificial Sequence
  Synthetic sequence.
DVEEEVKKLKDKNRRINEEVKKRMRELEERNKELNKRIREEDERLHRELRKVLEEARKTIDEKDLKRIEDELKKMNEENEKETEENERRSKEVKDRVREELERNRKESRDIEERLRRIKDGSREEVEKLLREYEERLERVRKRVEEILAKYKELLDRVEERARKSLKEIKETIEDARRRIK

SEQ ID NO: 18194 - protein, 181 aa, Artificial Sequence; identical to SEQ ID NO: 18193
  Synthetic sequence.

SEQ ID NO: 18195 - protein, 181 aa, Artificial Sequence
  Synthetic sequence.
SMDEELDKLTRENEAVNERVEREARRLKEENRKVDEEVRRAVEELKERVRRVLEEVRRKISEEKLRKIEEDLKRIEEEIERLEERNRRESEKFEKEVEDKLRENDKKSKEVRRDVERIKDGDEEDVRRLLEEYARLVREAEREVREILRKYEELVRKARKDAKKLLDDIERKIEKIKRDVD

SEQ ID NO: 18196 - protein, 181 aa, Artificial Sequence; identical to SEQ ID NO: 18195
  Synthetic sequence.

SEQ ID NO: 18197 - protein, 181 aa, Artificial Sequence
  Synthetic sequence.
SMDEELKKLVKENEDLNRRVREEAERLRKENEKVDEDAEREDKRLHDKAERVLRELRRRIRKEELDRVRRELERVNEENRELLERNKEESKRFREEVERTLEENRKLSEELKKKMEDIKDGDERTVTELLKEYRELVRRVEERVKKILKEYKEEVEEVKRRLEESLKDIERKIDEIRRRAT

SEQ ID NO: 18198 - protein, 181 aa, Artificial Sequence; identical to SEQ ID NO: 18197
  Synthetic sequence.

SEQ ID NO: 18199 - protein, 181 aa, Artificial Sequence
  Synthetic sequence.
SMDEALEELTRRNEEVNKRIEEEDRKLHKRNKEVDDEVRKRDKDLHDELRRVLEDARRTIREEELKRIEDKLRRLNERNEERLKRNEDRSREVNRRNKKLLDENRERSKRMKDDADRIKDGDEDEVEKLLREYKRRVEEVKKRAEDSLKRYEEEVKELEDEVRESLERIRRDIEDVKRRID

SEQ ID NO: 18200 - protein, 181 aa, Artificial Sequence; identical to SEQ ID NO: 18199
  Synthetic sequence.

SEQ ID NO: 18201 - protein, 181 aa, Artificial Sequence
  Synthetic sequence.
SMDEAVEKLKKENKDIDEEVRRRLDELRKRNEEVNKKIKEDDDRLHKEAKEVLEDVRKTISEDELRRIKERLEEINKRNEELLRDNRRRSEEMTRRVEELLKRNEDESRRLEETLKRVKDGDEDIVRKLLREYEKLLREVRERARRILEEYKRLVKEVRERAERSLEELKREIKKVRDRAK

SEQ ID NO: 18202 - protein, 181 aa, Artificial Sequence; identical to SEQ ID NO: 18201
  Synthetic sequence.

SEQ ID NO: 18203 - protein, 176 aa, Artificial Sequence
  Synthetic sequence.
SEKEELLRKAKEVIDRIRKELEELLRRAREVNKDSRRTVEEVLRKAREVSERVRKASERGTDDKEELAKENERLVRELEEEVKKLHDDDRKKDETLRREVEELARRIRKLLKELEEEVGRDEELDDLRRRAEELLKRAEDEIRKLHEENKRSNEEAERAIRELAKRNKELDDKTRE

SEQ ID NO: 18204 - protein, 176 aa, Artificial Sequence; identical to SEQ ID NO: 18203
  Synthetic sequence.

SEQ ID NO: 18205 - protein, 176 aa, Artificial Sequence
  Synthetic sequence.
KEKEDLIEKMKKVLEDIRKRLEELLKRARKVNEDSRKLVKEVLDKIKKVNEDVRKVATESTDDKKKLAEENRKLVEELRKELKEVHDEDKKLDDELRDRLRRIEEDIRRLLRDLEREVGRDEELTRLAREIEKLLEEARRRVEKLHEENKRSNEEAKERMERLRDHNRKLDDDTRK

SEQ ID NO: 18206 - protein, 176 aa, Artificial Sequence; identical to SEQ ID NO: 18205
  Synthetic sequence.

SEQ ID NO: 18207 - protein, 176 aa, Artificial Sequence
  Synthetic sequence.
REREELIKKVRTVHKRSEEELRRHSEEVKKVNRDSRERVKEHLKRVKEVIKELEDVARESTDDKKKLLEEVRKLLEDLDRHLRELHKRDEKLDRELDKHLRDLKRDNERLLRELEKEVGRDRELKELADRNKKLLEDIEREHKKLHEDNRRSNEDARRRHEELKREVEKLLDELRK

SEQ ID NO: 18208 - protein, 176 aa, Artificial Sequence; identical to SEQ ID NO: 18207
  Synthetic sequence.

SEQ ID NO: 18209 - protein, 183 aa, Artificial Sequence
  Synthetic sequence.
SLEEEIKRLVKHHEELLREVRKRLKELEDHHRELDERHRRMLEELVREARKLIKDVKDDIDRKLVEELRKKLDDLARELEELNRESNRKLKKLVEEVEKILEESLRRVEELKRDVERKRSKPTDEETVERILRTLKTTDERTTDTVREILRKIKRTNEESKETADRTVKRAKDLIREIRERVR

SEQ ID NO: 18210 - protein, 183 aa, Artificial Sequence; identical to SEQ ID NO: 18209
  Synthetic sequence.

SEQ ID NO: 18211 - protein, 183 aa, Artificial Sequence
  Synthetic sequence.
SAREAIKEIKKHHKKLLEDVKETIDRIEEHHRKLDKDHRDELKKLLEEVRELLRDIRSRIDKKLVDDLERKLRELEKKLEEENERSNRRLEKLKREIEDELRESEERVRRKEEEVKKTESKPTDERTVEKILEELKDMNRATKRRVEEILRRLKKTNDESEKRARDTLTRIKELIEEVERRAR

SEQ ID NO: 18212 - protein, 183 aa, Artificial Sequence; identical to SEQ ID NO: 18211
  Synthetic sequence.

SEQ ID NO: 18213 - protein, 185 aa, Artificial Sequence
  Synthetic sequence.
DESEELKKEAKEILDRLEKVLRELTDRNREMLKRIEKLIRENEKRLEDILREIAKRASEDRDERVLREIVRDVRRLIKENREEDDRIRRDVERYLRKSRRDMEELTRRLEEVIKRLEDKVREARVPEEVEKELKRIKDELKRLVEKAERSLRESEERLRRLLEEAEKRNRKVEREIEKLLDDTRK

SEQ ID NO: 18214 - protein, 185 aa, Artificial Sequence; identical to SEQ ID NO: 18213
  Synthetic sequence.

SEQ ID NO: 18215 - protein, 172 aa, Artificial Sequence
  Synthetic sequence.
SKEEKITRDAEEVLRRSEEIIRRLLRRLEEVLKDLERSARENKKRLDKILEDLAKLDTDRSVLKKAVEDVHKRDRETLKRHDEESKKVKDELEELLRRHNKELRDVRDELRRRGADEKRVKRMEEELRRLHEEVRRRVEKVKRDMDRLNKKIKEDSRRVNEEIRKLLEDKTR

SEQ ID NO: 18216 - protein, 172 aa, Artificial Sequence; identical to SEQ ID NO: 18215
  Synthetic sequence.

SEQ ID NO: 18217 - protein, 172 aa, Artificial Sequence
  Synthetic sequence.
SEEEKVRKELEEVLRRSDEDIERNRRRLEKVLDDLRRSAEENKRRLKEILDRLKDTDTEERVLKKIAEEVHRKDRKTEREHEERSKRVHDEDERSLREHNKKLKKVKEDLDRRGADEKEVRKVKDRLDKLHEKVKRISEEVNERIRRLNKRIKEISKRLNEELEELLRRRRT

SEQ ID NO: 18218 - protein, 172 aa, Artificial Sequence; identical to SEQ ID NO: 18217
  Synthetic sequence.

SEQ ID NO: 18219 - protein, 172 aa, Artificial Sequence
  Synthetic sequence.
DELEKFKEDVKEVIKKLAETIKRLLDDVRRVLEKLRKLAEENKERLDRILDELRRLRTDEREVERKVEEVHRRDKKTLDELRRDVKEVKERIEEVLKRHDEDSERVDKELKDRGADEKEVARLREEIKKLNERLKREVERLKRELEKLLRDIEKTSEDANRRLKELLDRTRK

SEQ ID NO: 18220 - protein, 172 aa, Artificial Sequence; identical to SEQ ID NO: 18219
  Synthetic sequence.

SEQ ID NO: 18221 - protein, 172 aa, Artificial Sequence
  Synthetic sequence.
RREEELLERAEEVLEKLERIIEETERELKEVLDRLRKSIEDNLRRLKKVLKELKDNDTDRETLRRELDKVHKEDRDTLREHKRESERVKKELDEKLRRAEEEVRRVEEELDRAGLDEKDLTEVKKRLRDLLKKMEDVLREVKKRLDDLNREMDDRSRKANEELRDLVRRKEK

SEQ ID NO: 18222 - protein, 172 aa, Artificial Sequence; identical to SEQ ID NO: 18221
  Synthetic sequence.

SEQ ID NO: 18223 - protein, 181 aa, Artificial Sequence
  Synthetic sequence.
DVERKLREVEERHKDVLKKAKELLDKVEEDHKKSSKEVEDVLEEMRRRAEKLVRDAVRKKGGSPRDLEELKKELEETLRRIRERNKRHHDEVKKRLEEVEEELKRHHDEVKKTLETLKDIRGDELARRIEEELEKLLRTLEELVTEIIKELEKLLKTHEDLLREVEKTLRRIIEELEKRDK

SEQ ID NO: 18224 - protein, 181 aa, Artificial Sequence; identical to SEQ ID NO: 18223
  Synthetic sequence.

SEQ ID NO: 18225 - protein, 181 aa, Artificial Sequence
  Synthetic sequence.
SVEETLRTVEEEHRKSSKEAEELLEEVERRHEESSKRLEDTLREAEKEVRRLAEDVVRRRGGSPEELRKIMEDIKRKLDRIREENKKHHEEVRREAEEIRKRNKKHHEEVKRVLERLKDIRGKELVDEARRELKELLETHKETVKRVLDKLRDLLRTHEEKMKDVEETLRRLLERLKEETR

SEQ ID NO: 18226 - protein, 181 aa, Artificial Sequence; identical to SEQ ID NO: 18225
  Synthetic sequence.

SEQ ID NO: 18227 - protein, 181 aa, Artificial Sequence
  Synthetic sequence.
KVEDSLREVKKRHKDKVDEVRKRLREAEEENKRLLDEVRRELERVEERIRRIVEEIVRKKGGSPKELERIKKEIEDELRRIEKELEDSERRNRELLREIEKRLEDHHRKVEKVLRDLKDIRGDEEARDIERRLRDLERTLEELVKEADERLKRSNEEDEERIRRVRKKLEELLRELEKRDE

SEQ ID NO: 18228 - protein, 181 aa, Artificial Sequence; identical to SEQ ID NO: 18227
  Synthetic sequence.

SEQ ID NO: 18229 - protein, 181 aa, Artificial Sequence
  Synthetic sequence.
DEDRDLKRELDRLLREHEELVDRSTKRLEKLLRKHEREARESKKELEKLNDELREIARKPTEERDLERSKRRLDKLKKELEDKNREARKELEDLREELREINERVRKKVKELEDDIRRKNSSEDVKRKLEEVRRRIEESVKRHRETVEEMRRRVDESVRRHERTVDELRRTHEELIERVRR

SEQ ID NO: 18230 - protein, 181 aa, Artificial Sequence; identical to SEQ ID NO: 18229
  Synthetic sequence.

SEQ ID NO: 18231 - protein, 181 aa, Artificial Sequence
  Synthetic sequence.
KDEEKIIEDLKRLLRKHEKLVEESRERLKRLLETIRKIAKDIVERLKRLNEELREIAKRPTPDEDLKRSKEKLDELEREIRELLEELEKRLRELEKELREINETVKREIEELRKEIERRNSSEEAREKIKRVVEELKESVERHERDVDRVRREAERLLEEVTRRIETVRRTHERLIEEIKK

SEQ ID NO: 18232 - protein, 181 aa, Artificial Sequence; identical to SEQ ID NO: 18231
  Synthetic sequence.

SEQ ID NO: 18233 - protein, 181 aa, Artificial Sequence
  Synthetic sequence.
SEKDEIKRELEELLREHEKLAEESRRRAEELLRDIERRARESLTELRELNKKLREEARRPVPDEVLEKSEKELEDRLRELEERNRKLKEDLDRLREEVEKLNRDVERKVEKLRKDIEERRTSEDVEREIRKVREDLKRSVDEHRKDLERIRRELEELLEKHHEDLRDVERTHRELLKEIKR

SEQ ID NO: 18234 - protein, 181 aa, Artificial Sequence; identical to SEQ ID NO: 18233
  Synthetic sequence.

SEQ ID NO: 18235 - protein, 179 aa, Artificial Sequence
  Synthetic sequence.
DVEDELRRLHEENKDLLREAEEELERLHRENKKLLEDARRLLERLEEELERIERRLKTDERDRREIRREADELRKRFEKLEKENRDINRKLREEFKRLKERNEKEDEDAKRRVEEKRGGDREEVEREVRKIEKLIRDSRERVRELIEKIERTLRDSERRVRELVKEVEKRLREIERKVE

SEQ ID NO: 18236 - protein, 179 aa, Artificial Sequence; identical to SEQ ID NO: 18235
  Synthetic sequence.

SEQ ID NO: 18237 - protein, 179 aa, Artificial Sequence
  Synthetic sequence.
DVEKELKELHDKNEEILERARRLLERLHKENEEINKRVEEALRRLAEELRRLKEELDDDESVKDKIDKLLEEAKKEVKRLNEENRELNRRLEERMRDLERRNRETNERLKKEAEEKRGGDRREVKELIRKIDELLRRSKEEVDRLVKEVERLLRESKRRVEEVIEKLRKIIEELEREVR

SEQ ID NO: 18238 - protein, 179 aa, Artificial Sequence; identical to SEQ ID NO: 18237
  Synthetic sequence.

SEQ ID NO: 18239 - protein, 179 aa, Artificial Sequence
  Synthetic sequence.
REVEEVIKDARRLLEELRKHSEDEVRKVEEEIKRLRDDNKRAVDDIERLLRELEEANLPEDEVEKVVREIRERAKEIKKRHEDKLRELRKKLEEVKKKHKKLVDDIKTKLKRVRDELVRDRRAETKLEELRRRLDEILRTTEELLRRLKRELEKLSEESKARLDELKRKLDEILKETRR

SEQ ID NO: 18240 - protein, 179 aa, Artificial Sequence; identical to SEQ ID NO: 18239
  Synthetic sequence.

SEQ ID NO: 18241 - protein, 174 aa, Artificial Sequence
  Synthetic sequence.
DEAREIVRELEKRIKDIEDRARKLIRELEKSLEDLKRRVEEMLREWEEESKELERRNVPRERVKEVKEKSDEKVTRIREELKKVNEENERRLREIEEELKKLAREMEKRLEEARDKIDREKVKEIKKRLDELLKRIEDELRRIREEDKRIHDEVEKELRKLERRDEELLKRLED

SEQ ID NO: 18242 - protein, 174 aa, Artificial Sequence; identical to SEQ ID NO: 18241
  Synthetic sequence.

SEQ ID NO: 18243 - protein, 174 aa, Artificial Sequence
  Synthetic sequence.
SEAEDIVRKIEELLKRHHDRVEEMLRRWEELTRRHSEKAEKIVREVEKLIDELREAKVPREEVERVARELEEKHKRVDEEHKEVTERSKRRAEEIRKESRDVAEDLKRRLSEVRDTIDEEEVKRLEKEIRDNLREMEERLKELEKRDKDNLDRIRELHRRLREELEKLLEDARR

SEQ ID NO: 18244 - protein, 174 aa, Artificial Sequence; identical to SEQ ID NO: 18243
  Synthetic sequence.

SEQ ID NO: 18245 - protein, 183 aa, Artificial Sequence
  Synthetic sequence.
SMDELLKRLEEEDRKLNEESKETLERLRKHDEDLNRKNREKLKELKDRVDRVLEDAKKRVPDEDLERIKKRLEELRRTNEELDRENEKLAEDLAREVKKTNEENRRTSKRIKEEADKLKKRKISEDDVRREVEDVKRRIEDSREKLRKLTEKWKKLNRESDEKVKKHVEDVEREIEKVRKEAE

SEQ ID NO: 18246 - protein, 183 aa, Artificial Sequence; identical to SEQ ID NO: 18245
  Synthetic sequence.

SEQ ID NO: 18247 - protein, 183 aa, Artificial Sequence
  Synthetic sequence.
SSEEELKKLSDKARRLNDENRKILERLKEHDERLNKRNKEELKRLREDVERLLEDARRRVDERVLRTITEILKRLEESNEELTRKNEREMEKLARTNEDEDRKARKKLKELEDEARRLRERNTSEEDVKRKLDTIDKVIRDVRRRIEEHVRRWEELNRRSKKEIEDHVKTVEDVIKEAKDRID

SEQ ID NO: 18248 - protein, 183 aa, Artificial Sequence; identical to SEQ ID NO: 18247
  Synthetic sequence.

SEQ ID NO: 18249 - protein, 175 aa, Artificial Sequence
  Synthetic sequence.
DEDEEVDREVREMIKRLEEHVKRDEDTLEEMLKRLRDHVERDRRRLEELLKDLERLVRERGRDEELEKKVKKIIRENRENLKRLEERVEKIRRDNEKNNEDLRREVEDIRKKLRDKVDDKEELKRLDREAEELLRRVDRLNEEVEKKLRKLLEEVRRENKRLEEEAKRLLDKAEE

SEQ ID NO: 18250 - protein, 175 aa, Artificial Sequence; identical to SEQ ID NO: 18249
  Synthetic sequence.

SEQ ID NO: 18251 - protein, 175 aa, Artificial Sequence
  Synthetic sequence.
DEDEEVRKKVEEEIKRLKKEVEEDRRDVERLDEESKDKVRRDEKKVKDLLKELEDLVRRDGRTEELRKRMEEILKENDEINKKLRKENEKINDENDKKNKELRKRVKEITERLRKEVDDKEELKRLEEEAKDLLRDVERLNRELHKRNREILEEATRRNEELKRELKELLDRARK

SEQ ID NO: 18252 - protein, 175 aa, Artificial Sequence; identical to SEQ ID NO: 18251
  Synthetic sequence.

SEQ ID NO: 18253 - protein, 175 aa, Artificial Sequence
  Synthetic sequence.
SEEERVKEELDKAIKTLEKLVKDDLKKVADALRRLREHVEKDLRDLEEVLRELKELVDKTGRTEELRDKVRKIEEDNERNNKKLADEVKRIADENTEINEELRRRVEEIKRELRERVRDTEELKRAERELDRLLTEADRRNDELRREAERLLEKVNEDNRTVKERARRLLDDARR

SEQ ID NO: 18254 - protein, 175 aa, Artificial Sequence; identical to SEQ ID NO: 18253
  Synthetic sequence.

SEQ ID NO: 18255 - protein, 175 aa, Artificial Sequence
  Synthetic sequence.
REDEEIVKEMERLLERLEELSRRIMEEVKRIDKESEDHIKRDEDKLREELERLRDLVRREGTTDELRDRVRRIKEENTENNKRLEDKNREANKRLKDLSDKLREDVKRIRDELRKKVDDKEELKELEERAKRLLERHERTNEELHRRNEEILRKANELNEEVRRRLDKLLDEVRT

SEQ ID NO: 18256 - protein, 175 aa, Artificial Sequence; identical to SEQ ID NO: 18255
  Synthetic sequence.

SEQ ID NO: 18257 - protein, 175 aa, Artificial Sequence
  Synthetic sequence.
DREREVRRRVKEALDEIKRHVDRDRKKAEDMDRRSRELSDELRRRVDDLIKRLKELVDRDGRTEELEKTVRKIERDLTEESRRLKDENRKINEENKDNNRRLRERVEDIKRRLKEEVPDTEELDELRKELDKLLTEVDETNKKLHEDNKRILDDHDRINEELRRRMEALLREATR

SEQ ID NO: 18258 - protein, 175 aa, Artificial Sequence; identical to SEQ ID NO: 18257
  Synthetic sequence.

SEQ ID NO: 18259 - protein, 175 aa, Artificial Sequence
  Synthetic sequence.
SEEEDMVRRVREMIKRLRDHVRRDKDKLDKEDKRSADHVDRDRKRLEDLLKELRDLVRDTGRTEELARRVERIIEENRENNERLRRENEKINRENDRNNKKLEEEVRRITEELRRKVDDTEDLKRLEKELRDLLDEVNKENEKVHRRNREILKRADELNEEAERRLRELLREAEK

SEQ ID NO: 18260 - protein, 175 aa, Artificial Sequence; identical to SEQ ID NO: 18259
  Synthetic sequence.

SEQ ID NO: 18261 - protein, 175 aa, Artificial Sequence
  Synthetic sequence.
KEDEEVKDKVEKLIRKLEKESRDISEEVKRLDEESKKLARDLTEEVDRVIKRLRELVERDGDTEELERRVREIEKELDKRLRDIEDRNEKANRELKRLSEELERRVEEIRRRLRKEIDDKEELKKLEKKLEELLERHRRDNKRLHEENRRILEELRRRIKELKERLRRLKEEARK

SEQ ID NO: 18262 - protein, 175 aa, Artificial Sequence; identical to SEQ ID NO: 18261
  Synthetic sequence.

SEQ ID NO: 18263 - protein, 185 aa, Artificial Sequence
  Synthetic sequence.
ETDERLDELRRRLEKSLKDHKKLLDEVRKKAEELLDRNARLLEELKRELDELLKKVEEDNRMRKDELKKIREDVERLREENRKTDREIRERLKELERRAEEIDKRAKETLDEIEREIERLKREGTTREVVEELLRRAEEEIRRHRKKVKESLDRLEDEIRKVEEDSRRSEKKVRKLIEDVKRRVK

SEQ ID NO: 18264 - protein, 185 aa, Artificial Sequence; identical to SEQ ID NO: 18263
  Synthetic sequence.

SEQ ID NO: 18265 - protein, 185 aa, Artificial Sequence
  Synthetic sequence.
STEETLEKLDRDLKDSSRRNEELLKRVDDRLRESSKENRKILKELSDRLRDLLEKVKKDNRAEEEVLERIRKEVEDLMRKNEDTNRRARERVKELEERNRKTNKDVEKRLEDLKREIKRLREEGTTDKVVRELVKRAEDEIRDHKRLSKESLDRLDEEIKRHRELSKESMEEADRLIKTVKERVR

SEQ ID NO: 18266 - protein, 185 aa, Artificial Sequence; identical to SEQ ID NO: 18265
  Synthetic sequence.

SEQ ID NO: 18267 - protein, 185 aa, Artificial Sequence
  Synthetic sequence.
ELDDLLREVEKRVRDLNRRNEEELRRVEDRMRESLRKSEEDLRRVEERLKKTLTRVKTERRVPDKDLDEIRKRVEKLSREIREINKDAKRRLKELVDENRKRDDEIRREVKKRKDDVKDLARKGDDRRSAKKILDDLERTLEDVERRSRESVRRLREEIETHRKLVEELKKRLDDLEEEVKERVR

SEQ ID NO: 18268 - protein, 185 aa, Artificial Sequence; identical to SEQ ID NO: 18267
  Synthetic sequence.

SEQ ID NO: 18269 - protein, 180 aa, Artificial Sequence
  Synthetic sequence.
SSDEILKRVKEELDRLLEENKRLLEEARKRLEDLIRKNREDLKRVEEKMRRLLEETPEDKKLEEIRERLKRLKEENERLNDEARRRLEKLRKENEETNRRIEEEVRRLAEEVERLKREGTTEEVVRRLAEELRRLIEEVKRKIEESERRLKETLDRYRKLVEDSLRKLEETIRRVREESR

SEQ ID NO: 18270 - protein, 180 aa, Artificial Sequence; identical to SEQ ID NO: 18269
  Synthetic sequence.

SEQ ID NO: 18271 - protein, 180 aa, Artificial Sequence
  Synthetic sequence.
SSEELLRKVKEDAKKIIKENEELLRKVDKDMRDIIKENRDLLEELTERVKRLLDRTPESDDLDRIRKIVEKLRRENEKLDEDAEKKLEDAKRRNKRTDRELEKRLKKLAEEVKDVRDKGTTEEVVKRILEELKKLLDEAERLSRESLKELEKMLREYRESVERSLRKVDDTLRRVEEKSR

SEQ ID NO: 18272 - protein, 180 aa, Artificial Sequence; identical to SEQ ID NO: 18271
  Synthetic sequence.

SEQ ID NO: 18273 - protein, 188 aa, Artificial Sequence
  Synthetic sequence.
DDKRLLEEIRRRADELIKENEELLRRLEKLNEDLERRNKELNERLAERVKRLEEDVRRRGLPREDVRRKIEDLRRLARELHEEDKKLNEEAKRLTETSRKRNKELNDEIRKLVKEIEERIEELERRGSDRRIVEEEVDRVRKTIEELKRKSEDLVREHEEIVRDLERKSRELVKKVEKLLRDVRERAR

SEQ ID NO: 18274 - protein, 188 aa, Artificial Sequence; identical to SEQ ID NO: 18273
  Synthetic sequence.

SEQ ID NO: 18275 - protein, 181 aa, Artificial Sequence
  Synthetic sequence.
SVDEMLKEIRDRAKKVDEDNRRLVERLEERNRELDERNKRLLDDIRRKVEEVMRIADERVDKKEELDRLKDELRRSLKRLEDLSKENHDRNRELNKRSKDRSEELHEELRRLLKEITDIIRAGDSGKELVDRVRKLLEEVRRKSEKLVREHEDLVRRNEEHSRRLVEEADRILERAKRELD

SEQ ID NO: 18276 - protein, 181 aa, Artificial Sequence; identical to SEQ ID NO: 18275
  Synthetic sequence.

SEQ ID NO: 18277 - protein, 181 aa, Artificial Sequence
  Synthetic sequence.
SVEEMLRRLRERDEEINDRLRRLAEDLKRENKRLDDENKKLVDEIREDVERLKEKLDRKLRDKDRMRELKRELEELLKELEEKSKRNHDRNKRENEKSEKILRELHKENREEVKRATEILEEGDTGSELLKRWEELLRRLEKRIRDLVEDHKRLVEENERHSRKLVEEVKKALTDAEKKVE

SEQ ID NO: 18278 - protein, 181 aa, Artificial Sequence; identical to SEQ ID NO: 18277
  Synthetic sequence.

SEQ ID NO: 18279 - protein, 181 aa, Artificial Sequence
  Synthetic sequence.
SVEELLEDIRRRVEKVKEDNKRMLEDLERKNRELKKEADDLAREIKKRVRDLEKELDEKLTDEEKVERLKRRLKKKLDELDRKLKENEDRNREENEKSKEDSKRLHEKLERLRERIERIVRAGDSGSKLVEEVRKLLEEARRESEELLRRHKKLVDDNRRHIRKLFEDVKKILDDARKEVE

SEQ ID NO: 18280 - protein, 181 aa, Artificial Sequence; identical to SEQ ID NO: 18279
  Synthetic sequence.

SEQ ID NO: 18281 - protein, 175 aa, Artificial Sequence
  Synthetic sequence.
SEEEEIVKDVERVIRELEERHKDLVRRAREDIKRLREHIRRSIRALDEDIKRIEEKIRRDGDDREVEEHIKRSKDELRKDEKRIEDHIRRSREKLDRDVERMEEEHKRLEKELRDRGLSEDLVRDLERKNKRVIDESRRLLEELRRRYEELLREYRELLEDLRRKYKRIEDEAKR

SEQ ID NO: 18282 - protein, 175 aa, Artificial Sequence; identical to SEQ ID NO: 18281
  Synthetic sequence.

SEQ ID NO: 18283 - protein, 175 aa, Artificial Sequence
  Synthetic sequence.
SEKEEIVKTVKTVIDRLEEEHRKILEDLRDDIRRADEYIKRSIDEVEEDLRRIEETVRRDGNTKEVEKHIEDSKRELEKNADKLRRHIEESRKELERLIREADEKHKKLDEDLKRAGLEERLVRELEKENEKLKRRSERMLEELEKEYRRLLKKYEDLLRELERKYEEIKDKLRK

SEQ ID NO: 18284 - protein, 175 aa, Artificial Sequence; identical to SEQ ID NO: 18283
  Synthetic sequence.

SEQ ID NO: 18285 - protein, 175 aa, Artificial Sequence
  Synthetic sequence.
SEDEDIVRKAKEDIERLKREVEETIKRVEDDARKVEKEVRDIVERTRKEIKKLEDEVRERGNTKEVERKIEELKKEHEDRNKKLVDHIKRSEEELRRLAKELEELIRRLKEELEKAGLKEKLVEELRRELEKLKKEIDDLLRDLEKKYDDIRKKIRKLSEELKKLLEELKRKLDE

SEQ ID NO: 18286 - protein, 175 aa, Artificial Sequence; identical to SEQ ID NO: 18285
  Synthetic sequence.

SEQ ID NO: 18287 - protein, 175 aa, Artificial Sequence
  Synthetic sequence.
SELEKIVEEVRRDIKRVRERVEEIIRKTDEMIRRLEEHIKRSIERVRKDAEDIERTVRRDGNDKELEKHLEKSKRELDKDAREVDERLKDLERRHREANKRLEDHIRRSEEELRRRGLDKDLLDELRRRYEELEERIRRLSRELEEKLKKLRKRYEDLLEELEREYRRIAEEARR

SEQ ID NO: 18288 - protein, 175 aa, Artificial Sequence; identical to SEQ ID NO: 18287
  Synthetic sequence.

SEQ ID NO: 18289 - protein, 175 aa, Artificial Sequence
  Synthetic sequence.
SEEEKIVEEVKRDIKKVDDEVKDIIRRTDKAIKDLRREHKELIDRTRKAIEELEDEVRKRGDDEKLRRKIRELEKRHERANEELERKHRKLETDHREMNERLKRHIRESEKKLEKDGLREDLVDELRKLYDTIREKIKRLSDRLREKNEKLKKESDDLSRRLRKELEKLEREVRR

SEQ ID NO: 18290 - protein, 175 aa, Artificial Sequence; identical to SEQ ID NO: 18289
  Synthetic sequence.

SEQ ID NO: 18291 - protein, 184 aa, Artificial Sequence
  Synthetic sequence.
SKEELLKEIRDELRKLKKKHDDLLEEIKREYDRLREKVRKDLEDIERKLRKLEEDVERKDVREEEKTDLDRLAKELREELKRIKKKIDDHIRRSEEELKRHHDEIRKILKKLKEELDTAASQDLREEEVKRVVERVKELIKRLEDNIREAIRKLREDIKRLEEEVEKARKDVEDFLRELRKKVK

SEQ ID NO: 18292 - protein, 184 aa, Artificial Sequence; identical to SEQ ID NO: 18291
  Synthetic sequence.

SEQ ID NO: 18293 - protein, 184 aa, Artificial Sequence
  Synthetic sequence.
SSDELAEELKREYDRNKEEHKKLLEELKKEYKRLLDEHRDLLRRIKERLDRLLRRIEEKDVREEDLKRLRKLVDDLRKRLKKHHEEVKEHIDRSRKELEDHHRELDEDHRRAEEKLRRMRSQDLREELVERVIRDVRKHIEDNTENIRRDIERVRKDIETLEENVKDAAKKVEDILKTLEDEVK

SEQ ID NO: 18294 - protein, 184 aa, Artificial Sequence; identical to SEQ ID NO: 18293
  Synthetic sequence.

SEQ ID NO: 18295 - protein, 184 aa, Artificial Sequence
  Synthetic sequence.
DKERLAEELRRLYERNKREHEKLLKKIEDDLRKLEEDHERLLREIEEAAERLRREIERKDVDEEKVRRLETELRKLREELKKHHEEIKRILDKLRKDLKKHHEELKRDHDKAEEELRDVESRDLREELVKRVVDRVRRHIEENTKNIEEAIKRVEDVIRELRKNIEEAIKRVREVLKRLKDEIK

SEQ ID NO: 18296 - protein, 184 aa, Artificial Sequence; identical to SEQ ID NO: 18295
  Synthetic sequence.

SEQ ID NO: 18297 - protein, 184 aa, Artificial Sequence
  Synthetic sequence.
SEDELLDRLREKYERNKERHKRLLDELRKRYEDLKREHEKLLRDIEEELKKLEDKIRRKDVPEEDLKRMKKLADDLRRELEKHHEDIKDHIRRSEEELREHHERVKDDHRKAEETLKDVRDRDLREDLVRKAIEDVDRHIKENTKNIEDTIRKVKKNIEDLKRNVEEAIKKVKEVLREIEERTR

SEQ ID NO: 18298 - protein, 184 aa, Artificial Sequence; identical to SEQ ID NO: 18297
  Synthetic sequence.

SEQ ID NO: 18299 - protein, 184 aa, Artificial Sequence
  Synthetic sequence.
SKEELLKRLKERNERLNEDSERLAREIKRRLEELRKEHRRLLKEIEERLKELEEDIRRKDVPEEKLERLKREIDRLREELKEHHKRVKDELDRLKKRLEDIKKDHDRKDRKVKEELEDMARRDLDEEDVKRVIRRWEELLKELEKDNRRVVKEAKELIDRLERNIRERIKEVRDALREIRKKVK

SEQ ID NO: 18300 - protein, 184 aa, Artificial Sequence; identical to SEQ ID NO: 18299
  Synthetic sequence.

SEQ ID NO: 18301 - protein, 184 aa, Artificial Sequence
  Synthetic sequence.
STDEKLKELEKRNRDLNEESRKLAEEIRKRYEDLKKEHEDLLREIEKRLRDLMREVERKDVPEKDLEELKEDARRLREELRRHHEEIERHIRESEKELRRIEDEHRKEDEKVKKELKDVRERDLDEKSVDDVIRRWEELLEELRRRNEEAVRRMERNIDELRRNVRETIDRVRKLLEEIKRKVD

SEQ ID NO: 18302 - protein, 184 aa, Artificial Sequence; identical to SEQ ID NO: 18301
  Synthetic sequence.

SEQ ID NO: 18303 - protein, 178 aa, Artificial Sequence
  Synthetic sequence.
SEAERVVEELERLLKKNRDDNERVIRRLEELLDRLREKNERAIEELRKLLDELKKVVDRGDVSERVVDKLLKEIKEKIDRVREEHRKLLEDIERTIRKVEKEHKESIERIRRRAEELKDLIRRELLREIEERLKTLSEESKRLIDRIREELKRLTKESEDLLKDIERLLREVKERART

SEQ ID NO: 18304 - protein, 178 aa, Artificial Sequence; identical to SEQ ID NO: 18303
  Synthetic sequence.

SEQ ID NO: 18305 - protein, 180 aa, Artificial Sequence
  Synthetic sequence.
DEMEDLRRDVERIHEESRKLSEDSVRTAEKIHRESEKLIDDLRRKVEKILKEVEDVVRRGDSDEKLKTRLRDLKRKLEKEAKEIMDRHERLAEELKERNKRINDDHRRKNEELKDELRRKRVGPEEELKKLEDRSRKLLEENKRLNEDLDRRSEELKARLKDILRRIDERLRDLEREADR

SEQ ID NO: 18306 - protein, 180 aa, Artificial Sequence; identical to SEQ ID NO: 18305
  Synthetic sequence.

SEQ ID NO: 18307 - protein, 180 aa, Artificial Sequence
  Synthetic sequence.
DEVEELKRRAEEILRKYDEDSKRIVEEAERIVRTSAEKIERLRKKAEDILREASKVVDDGRSEEELARRLTELTKRLEDEAKRIADEHDKLDEEIKRKIEELNKELKKLADDLRDRLEKERAGPERDLEKIETDVERLERKSKKLLEDLREKSERLKKRLEDILKRIKEEVERLKRKVEK

SEQ ID NO: 18308 - protein, 180 aa, Artificial Sequence; identical to SEQ ID NO: 18307
  Synthetic sequence.

SEQ ID NO: 18309 - protein, 180 aa, Artificial Sequence
  Synthetic sequence.
DEMEELKKEVEEILKEYEKRSRDLFKELKEILRRSKELSEDSKREADKILRDAEKVVADGDRREKLMETLERLLRRLEERNKRINEEHDKRDKDIEERVKKLNKELRDLVRRLREELRKRRAGREDDLRRIEEKVKKLEKESRELLKRIKDESEELKRDNKRLNDEVREELEKLKERVRK

SEQ ID NO: 18310 - protein, 180 aa, Artificial Sequence; identical to SEQ ID NO: 18309
  Synthetic sequence.

SEQ ID NO: 18311 - protein, 180 aa, Artificial Sequence
  Synthetic sequence.
DEMDELRREVKEILKTTEELIKRLEDKVRDILRRYKEVSDDIVRKAEDILRKAEDILRRGDSREEVSRELKRLLDELEKEIRKLNEDLKRLLDELREELERIVKTHRKLDKDLEDRLRKRRAGEERELEEIKKESEDLERRLKKVLERIEREVRRLEEETKELLKRIAEEVERLIREAEK

SEQ ID NO: 18312 - protein, 180 aa, Artificial Sequence; identical to SEQ ID NO: 18311
  Synthetic sequence.

SEQ ID NO: 18313 - protein, 180 aa, Artificial Sequence
  Synthetic sequence.
KEAEDLVREVERILEDYDRVVKELKDDADRILEESRRLIEELKKKAEDILRRVRKVVEDGDSRDDLKRELDKLAEDLAREAKEIADRHRKLDEELERRIRRLDEELKRLARELEERLARDRVGPEELLERIKDRLRKLHEKSKKLLTDIKRESRRLEKRLEDILKRIKEEADKLKEEADR

SEQ ID NO: 18314 - protein, 180 aa, Artificial Sequence; identical to SEQ ID NO: 18313
  Synthetic sequence.

SEQ ID NO: 18315 - protein, 174 aa, Artificial Sequence
  Synthetic sequence.
REEELERRVREESEELNRRLAEVHKRLRKKSKELNDRHKELDDRIRREADRLRKDIRRQGKEDDKLDREIKEIERELRKRSEELHDTNRKILRENEENLRRLHKENRDIERDLERKRLDDEVLKELKEMHDRLREHVKRDSERAERMHEELKRLSDELERRVREALKRLKEKVR

SEQ ID NO: 18316 - protein, 174 aa, Artificial Sequence; identical to SEQ ID NO: 18315
  Synthetic sequence.

SEQ ID NO: 18317 - protein, 174 aa, Artificial Sequence
  Synthetic sequence.
KKEEVRKRIEEELRRLKKDHRRLDEEIKRKLKKLDEEIKEVHERLKKAARDLEDEARRNGKRDDKLTEEIKEIIRRNKKNVDDLRRELKRIDEELKKESEKLERKADEIEERLRRREQTKEVEKDVEDLLKELEDDSRRLEEEVERLIERVKRHVERDERRVREMLREIKEKIK

SEQ ID NO: 18318 - protein, 174 aa, Artificial Sequence; identical to SEQ ID NO: 18317
  Synthetic sequence.

SEQ ID NO: 18319 - protein, 174 aa, Artificial Sequence
  Synthetic sequence.
SKEDLDRELRRLSEELNREHKELDERIRRELEKLRTRIDKVHEDIRREMKRLEDEVRKRGREDDRLRTKVKKILDDNKENVDRLRDELRKIKEELDRESKKLHDENEKIKRDLEARELTEEVFEDAERLHRELKKKSRDLEERVKKLLEEIEDHVRRDETRVRKVLRDIEEDIR

SEQ ID NO: 18320 - protein, 174 aa, Artificial Sequence; identical to SEQ ID NO: 18319
  Synthetic sequence.

SEQ ID NO: 18321 - protein, 174 aa, Artificial Sequence
  Synthetic sequence.
SKEDMLREAEERSRRLNEDHKRLDDELRKESEKLNRRHRDLDEKIDRELRRLKKDIRRRGKQDERLEREMKEKKDELDRLSKELHDKNREIKERLDRLSETLHKENEDIKEELRRRELTRELLERLRKVHEDLKKKSEDLKRTAEKLHRELEKESRDLVRDVERALDELRRKVE

SEQ ID NO: 18322 - protein, 174 aa, Artificial Sequence; identical to SEQ ID NO: 18321
  Synthetic sequence.

SEQ ID NO: 18323 - protein, 177 aa, Artificial Sequence
  Synthetic sequence.
SSEELLRDIERRLEEMNRDTERVVEEIRRRLEELRKRHKETIDKIREELKKVEDLVRRRGLDEDTSRELKELMRRLEEKLKEHHERLRELLERLEKELREAKERLDRKTEKIKKDLRKDGADEDVLRRAKRLIEKYKEDTKRIKEKLEKVIEDLRKNIEDFEEDVRRVLEELKKRIK

SEQ ID NO: 18324 - protein, 177 aa, Artificial Sequence; identical to SEQ ID NO: 18323
  Synthetic sequence.

SEQ ID NO: 18325 - protein, 177 aa, Artificial Sequence
  Synthetic sequence.
SSRELLERIKEELKELEDRHRDLLRRIEEKLERLNRRTREVLERIKRKLDELKKRVEEAGLDEDSRRRLEKKLKEIRDKLDEIRRRLEDETRKIKEELRRHHEEVRKRLRDVERRLREKGVDEDLLREVKELIERLRENIKRAKDKVEELIKKYKRDTDEAKKEVDEEIKRLKEEVD

SEQ ID NO: 18326 - protein, 177 aa, Artificial Sequence; identical to SEQ ID NO: 18325
  Synthetic sequence.

SEQ ID NO: 18327 - protein, 177 aa, Artificial Sequence
  Synthetic sequence.
DSERLVREIRERLKKLEKEHRELLEEIKDRLRRLNEESKKLLDDIKRRLEELRDRIRRAGLDEKTLTDLERILRKIEEDLKRMKEELDRLTREIERELEEHHKDIKRRLDEVRKELEKRGADEDVLRDLEKLIEDLKRNIERARAKVEKLIKEYEDKLEKIVRDAEELIKDLDRKVK

SEQ ID NO: 18328 - protein, 177 aa, Artificial Sequence; identical to SEQ ID NO: 18327
  Synthetic sequence.

SEQ ID NO: 18329 - protein, 177 aa, Artificial Sequence
  Synthetic sequence.
SSEEILRKIEEELERLEREVRKIHRDNERKSEELNRRSKKILDDIRRELDRLKKEAEEKGSSEETKKDLERLRRELEERLKEVEKESEELRREDKERNDRVREKLKELKKDIKRLLDEKGIDKEVVKEMRRALEEIKKEIEKVRKELEKRNREYRKRSEEVREEAERKLEEIKRRTD

SEQ ID NO: 18330 - protein, 177 aa, Artificial Sequence; identical to SEQ ID NO: 18329
  Synthetic sequence.

SEQ ID NO: 18331 - protein, 177 aa, Artificial Sequence
  Synthetic sequence.
RSEEILREIRDRLRKLNEESEKVHEENERRSRELNERSREILKRIDEELKRLKKEVDDKGADEKLKDELRRLVRRVEEELRRVEEESERLKREDDRKNEDVRRKSEELARDIERATREKGIDDDVVRDLKKKLERYKRETDRVRKELRDLNKKYEDRSREIKRELERLLRDIKRRID

SEQ ID NO: 18332 - protein, 177 aa, Artificial Sequence; identical to SEQ ID NO: 18331
  Synthetic sequence.

SEQ ID NO: 18333 - protein, 184 aa, Artificial Sequence
  Synthetic sequence.
SLEEVIKTVRKLLEEVERRLREVVERAERMLEEVRRRTREVSEEAREMLKDVEKALRDKNVSEEIEEKLRKIKEELERDNEKVNRDNERSVETLRRLLDRVRKEVKDIAKELEERLKEVERKSRDDRIVEKLLRDAERIVKRLRELIEKLREEVEKIVDENRKTVEELRRRNEEIVRRLRREIE

SEQ ID NO: 18334 - protein, 184 aa, Artificial Sequence; identical to SEQ ID NO: 18333
  Synthetic sequence.

SEQ ID NO: 18335 - protein, 184 aa, Artificial Sequence
  Synthetic sequence.
DVKEVLDDAERKLREVLKLIEDSLKKLKELSDEVIERIARSLEKLEKLIRDVDEELKRKVSDKDKLKRLKEKLDKVLRENEKLVEDLRRENKKVNDRNKRLVDELRRRLKKVKEDLERRVAEEDDKEVVKEIKERVDKVVDEARKLVEESERSIRELVERSKKVVEESERSIEELRRELKETVK

SEQ ID NO: 18336 - protein, 184 aa, Artificial Sequence; identical to SEQ ID NO: 18335
  Synthetic sequence.

SEQ ID NO: 18337 - protein, 184 aa, Artificial Sequence
  Synthetic sequence.
DLEEVRERARRLLRKLEEDLERVHKEMEELLRELEERIKASLERLDELLKRLADKLRRDVKDDDKLRKLDKKLKEAKKTNKDLADELRKELEEALRESRRSIDELRKDLERVTEEIEDILRKRKTKEVVKEIEDRVRKVAEKVREVIERNRKLVRDVLDKIRRMLKESERSVEEVLKRLDDELK

SEQ ID NO: 18338 - protein, 184 aa, Artificial Sequence; identical to SEQ ID NO: 18337
  Synthetic sequence.

SEQ ID NO: 18339 - protein, 181 aa, Artificial Sequence
  Synthetic sequence.
SLDEVVKRLEDLLREVEEKSKESSKRMEDLNREVNERLRRSSERLKRLNDEVKKRLEDAGRDDKIRRTLERLSEDTKRKSDKTNEDLKRLSDETRERSKRLNEELRRLVEEVRRRLEDLRRKGSPVEEIKKLADKVVTELEKLVEDDRRLAEESFERARKIVEEDERLARESVDRARRLVD

SEQ ID NO: 18340 - protein, 181 aa, Artificial Sequence; identical to SEQ ID NO: 18339
  Synthetic sequence.

SEQ ID NO: 18341 - protein, 184 aa, Artificial Sequence
  Synthetic sequence.
KLDEVIEEIRKLLRRMEEELRRSVEEIDKLLREVRELLRESSEKVKELLRRVTEELKKRGVPEEVKERLDRLVETLRRLSEETLKELDKLVREVKELSKESLKRLRELVERLRRELEEIKKRGEDEKLVEDLKRRAEEVIRELREIVKRNTEIAREVVERAKRIVEKNEKLLKDVVEEAKKIVK

SEQ ID NO: 18342 - protein, 184 aa, Artificial Sequence; identical to SEQ ID NO: 18341
  Synthetic sequence.

SEQ ID NO: 18343 - protein, 173 aa, Artificial Sequence
  Synthetic sequence.
SELEKAKEDVDRLLEDVNRVSEEVEDRVRKLLADSDRVLEEVERRVREVLKRLKDAGVPDEELERARRTLEDIIERLREKNKEVKERLRKIIKEDREVNERVEERVERLTREAKDKDVKTVADELRKVVKELLEINRRSLEELTKLVDESRRVNEKVMEELKKLVDDLRRRIE

SEQ ID NO: 18344 - protein, 173 aa, Artificial Sequence; identical to SEQ ID NO: 18343
  Synthetic sequence.

SEQ ID NO: 18345 - protein, 178 aa, Artificial Sequence
  Synthetic sequence.
SEIEKVKEVVREVIERSRKLLKEVRDTVEKVIDESRKLSDTVRRRVEDAIRDVLERRGDEDDELRRVKEELKKVIDENEDLNRRVEETLREIIKRLAEENKRVEDSLRKVIKDIERVRSREEVKKVIEDLTREAKRSLERNREVVKELKKLADDLKDLNKKSVDRLDDLVRRLKERTE

SEQ ID NO: 18346 - protein, 178 aa, Artificial Sequence; identical to SEQ ID NO: 18345
  Synthetic sequence.

SEQ ID NO: 18347 - protein, 184 aa, Artificial Sequence
  Synthetic sequence.
KRAEDVLEKLREDAKRVLKRNRDSVKEAEDLVRKSLRTSEEVVKTLRTELKKLLDELDRVKSEEARKRVEDVRDRLKREVDKLDRVSEEVEKTLEDLNRKNTEDNKRVVDRLREELDRLRREGLPEKVLRDIEREVRKIIKELEDMDDELRRILEEVIERSRRVNERLKELLKEADDRLREKLR

SEQ ID NO: 18348 - protein, 184 aa, Artificial Sequence; identical to SEQ ID NO: 18347
  Synthetic sequence.

SEQ ID NO: 18349 - protein, 181 aa, Artificial Sequence
  Synthetic sequence.
DAAEELLRLVEDVARELKRLVDELLKENRETVERLKKVVKRSEEINREVVRTLRELVANNGDKKEIDRIIKELKDANDKVAEDLRRVIEEDRRRNDEAAKTLRKIIEDLRRALEDVVRKRGEDEKIKEVRRSIEEARRRVEEALREVNEASKEAERTVREALKRSREAVEKAVRDVTEAAR

SEQ ID NO: 18350 - protein, 181 aa, Artificial Sequence; identical to SEQ ID NO: 18349
  Synthetic sequence.

SEQ ID NO: 18351 - protein, 178 aa, Artificial Sequence
  Synthetic sequence.
KELEDVLRESEKTAEELLRRVKKSIDRTRDVVRRLLEEIRKSIEETKRVADEAKREDRDEEVLKKIIRELEERSKKVEEDLERIIRELREESRKVEKELRDLIRRNEEKIKRVIERRGETDLVRRLERISEEVRRRVEKLVREDRKILEDVARALRELVKEDEEILRRVVKDLRDKTR

SEQ ID NO: 18352 - protein, 178 aa, Artificial Sequence; identical to SEQ ID NO: 18351
  Synthetic sequence.

SEQ ID NO: 18353 - protein, 175 aa, Artificial Sequence
  Synthetic sequence.
DEDKKVVRKVERIIKRVKELHDKSVRDSEEVVREVLKRHKESVEKIKEIVRRIVEIAARGDFREEVKKRLEEVIRELREENAKIHRELKELLERSRRRNDEIHRELKERLKEILEEAKDIEELKEVIRRVEKLSEDVKRENEKSNDEVRKLSEDAIRENEEVLRRARKLVDDLRR

SEQ ID NO: 18354 - protein, 175 aa, Artificial Sequence; identical to SEQ ID NO: 18353
  Synthetic sequence.

SEQ ID NO: 18355 - protein, 175 aa, Artificial Sequence
  Synthetic sequence.
DEEKEVVKKLRDIIREVERLHTESVRKVEEIVRRVLRLHKETVRELKEIVKRIVDIARNGDRREKVEDELRRRLEEIERKNKEIRDELKRLIDEVRKENTEIHDRLKKELKKILDEAREIRELEKVAKEVEDRSKELLDRNEEVLDRVRKLSEDVLRENREVIERVREEVKKESK

SEQ ID NO: 18356 - protein, 175 aa, Artificial Sequence; identical to SEQ ID NO: 18355
  Synthetic sequence.

SEQ ID NO: 18357 - protein, 180 aa, Artificial Sequence
  Synthetic sequence.
SEADKVVAELEKIVKDVVDAHKDSVRKLREIVRRAVERLRKDVDDTRRVVKEIVDIARSGDMREEVRKRLEELLRRSEEHSEKVERDLERVLKEVEDTNRDIKRRLEKRIREIEEKIKDLDERVRRKLEEVVKKVRDLSRRATEEVEEVIKEVRELVRRLKEENKRVVDEVRKRVEDTRK

SEQ ID NO: 18358 - protein, 180 aa, Artificial Sequence; identical to SEQ ID NO: 18357
  Synthetic sequence.

SEQ ID NO: 18359 - protein, 182 aa, Artificial Sequence
  Synthetic sequence.
KSMEDVVRKLDELVKTDKEIADRVVKELKDIVKRVEELVEDIVTKSRASVERVRDVVTRGVSEEELKRIHDENRRLIEEAKKRLEEIRREIEELVRRVEEESKRLNEELKRLIDDVTDKKRDVREAKELLDRLKRRLEKSTEEVKKKLETVLRELEEVIKRVKEELERVNRELRKVIEDAKK

SEQ ID NO: 18360 - protein, 182 aa, Artificial Sequence; identical to SEQ ID NO: 18359
  Synthetic sequence.

SEQ ID NO: 18361 - protein, 177 aa, Artificial Sequence
  Synthetic sequence.
ELEKLIRDVVRENEESAKEAHRRIKEVVRTSEDLVREVRERVRRIVESSKRVVEEVRKKMDEEELRRLVEESRRNVEEVRKALKKVEEDSRRNVEKVERDLEKLDRDNEREIRELRKRVKDMEKLLRDLKKLIEDNERVVRELKKNLDDDSERVKRVADELLKNLKKDTKKVKDTAK

SEQ ID NO: 18362 - protein, 177 aa, Artificial Sequence; identical to SEQ ID NO: 18361
  Synthetic sequence.

SEQ ID NO: 18363 - protein, 186 aa, Artificial Sequence
  Synthetic sequence.
DEAEDVVKRADDIVKRNRELLERVVRDLERIVRKNKDIVRKVVDEAKKLVKTVEDLSRQDNKREELRRRLEEVKERLERLVDKLRRESEKSKRELEKLLKELRDLSRKTEEELRKLVEDLRRKLKNVKEVEDLLRRVEEKLRKSVKEVEELLDTVRRRLEDSSRDVKRLLKEVLDRLEDVLDKEEK

SEQ ID NO: 18364 - protein, 186 aa, Artificial Sequence; identical to SEQ ID NO: 18363
  Synthetic sequence.

SEQ ID NO: 18365 - protein, 186 aa, Artificial Sequence
  Synthetic sequence.
SAVEEADKEVRRILKKNTDLVRRVVEEAKKILDRNEKRVREVFKELTRLLDELRKLIEEGNREERLRELLDRVRKRLKEEMDKVRKEDEKSREDLRRLVRELEELSKRTKEELDELTRALRKDLKDVEEVERLLRELERRLEDSVRKARELLKDIERRLRESIKRSEELLRDVERRLKELEERLEE

SEQ ID NO: 18366 - protein, 186 aa, Artificial Sequence; identical to SEQ ID NO: 18365
  Synthetic sequence.

SEQ ID NO: 18367 - protein, 177 aa, Artificial Sequence
  Synthetic sequence.
DVEEELKRVVEKLRDVERKVRELNKRVTDKNEDVVRTVRELNERVTRENRRVVEDIDRKKRTKDLKKLLEDSERNVDRVNKESERLIRESKKNVKDVNEESERLIRKVAKDLERLTERVSDLDDVLRRLEELVKDLERLIEESVRYLERNVERSRELVERSLRYLKENVDRSRKLAE

SEQ ID NO: 18368 - protein, 177 aa, Artificial Sequence; identical to SEQ ID NO: 18367
  Synthetic sequence.

SEQ ID NO: 18369 - protein, 175 aa, Artificial Sequence
  Synthetic sequence.
DEVREVVERARKLVKDNLDAARKAVKRLRELVKENLDTVRDVVRKLRKLVEDLKRLIRSGGSEEAVKRLKEELERLIKEVKERSDETRKRLEDLIRELEERSKRTAEELEKLIREKAKGKELADEVRELAKRSHEELKRLLDEVRKLLKDSERALRKLLEDVRREADKVAEEVRT

SEQ ID NO: 18370 - protein, 175 aa, Artificial Sequence; identical to SEQ ID NO: 18369
  Synthetic sequence.

SEQ ID NO: 18371 - protein, 175 aa, Artificial Sequence
  Synthetic sequence.
SEVDEVVRRARELVKKNRDDVKKVVEDLRRIVKEDLDTARRVVKRLRELVEELKELIRSGGSEELLKKLKEDLKRLLDKVREESKRTNDRLEELIEKVARDSRKTLEELKDLIRKKVRGKELADEVDELMKDSDRELKRLLEEVRKLAKRSTDELERLIEEVRKELEDVLDEARQ

SEQ ID NO: 18372 - protein, 175 aa, Artificial Sequence; identical to SEQ ID NO: 18371
  Synthetic sequence.

SEQ ID NO: 18373 - protein, 179 aa, Artificial Sequence
  Synthetic sequence.
SREEELLERLRRVVERNKKLVDDLADRADKVVKENEKLVRDLLEESRKTSEILDRLVKNRGDERRLEDIDREDRKTLKDVKDTSRESKKRLEDELKKVEDESRKLTRELEERLERAVRERGREPELVEEVRRLSEKSNRDLKELVKDIERKLDKVHKDLEKVIEEVERSNERVKEEVKT

SEQ ID NO: 18374 - protein, 179 aa, Artificial Sequence; identical to SEQ ID NO: 18373
  Synthetic sequence.

SEQ ID NO: 18375 - protein, 182 aa, Artificial Sequence
  Synthetic sequence.
SDAERIVEEAKRLVEENTELVERVLEKLERLVRENRTLVERVIEELDDLVRRIEDVVRRGVDEKDIAKLEKELRERIKEVRDRSKKTRDDLEKLIREVEERSKESTRKLEELLRDVTRKNKDSKKLEKLLREVERLMEESHKRLKEVADTARRLMDDSERELDRLLREAEKKIRDVREEIRR

SEQ ID NO: 18376 - protein, 182 aa, Artificial Sequence; identical to SEQ ID NO: 18375
  Synthetic sequence.

SEQ ID NO: 18377 - protein, 182 aa, Artificial Sequence
  Synthetic sequence.
SLVDEILKDLDRLVEENEKLVKKIVEDAEELVKRNTDLVEEVLRELKEIVETIRDLVRRGVDEDTIKKLEDDLRRKEEKVRRESKRSVERLEELAEEVRRESKRLTEELKRLVEDVLRRAKDVEELKDVLRRVEEKIRKSNEKLEKLLEEVSRLAKRSDERLKKVLEDIKEEIRKVKEDLER

SEQ ID NO: 18378 - protein, 182 aa, Artificial Sequence; identical to SEQ ID NO: 18377
  Synthetic sequence.

SEQ ID NO: 18379 - protein, 181 aa, Artificial Sequence
  Synthetic sequence.
SLEEVVKKAEDLLKRVNDELKKVSKKVRDDLRRVNEKLKTVVEDVLRKLEAVVDKIRKSGVDEERLRELKELIERAKRELERILEESEKTTRDVERESEESLDRSRRTTEEAKRELDDVRRRGVDVKDVDKRIRDVVRRHEEVVETNARRVDEVVKRHDKLVKDLERRVEKVVRELEEKVR

SEQ ID NO: 18380 - protein, 181 aa, Artificial Sequence; identical to SEQ ID NO: 18379
  Synthetic sequence.

SEQ ID NO: 18381 - protein, 181 aa, Artificial Sequence
  Synthetic sequence.
SLDEIVKRAEEELKRLNEELKRVSDRVKERLDRVLDELRRISERIKELLERVKRKLEREGVDEDTLRELARELKELEDRSRESLKRVEDLIRKVEEDSKESLKESKRLTDDARRRLDEIRKAGVDAEDLRREVEEIIRRHKEVIRKNEEDVKRVLDTLREMLKKNKKLVDDMVRKLDETIK

SEQ ID NO: 18382 - protein, 181 aa, Artificial Sequence; identical to SEQ ID NO: 18381
  Synthetic sequence.

SEQ ID NO: 18383 - protein, 177 aa, Artificial Sequence
  Synthetic sequence.
SEAEKVLEKVERVAREVLERIKRIVEHTKRVVEDVIRRADESVRRSEEIMEDVRRKVDSEKVEEIERRVREVVKENRRLVEELRERVRRVVEENKRLLEEIERIVREVVRRVEELARRNGPKEDVERLVRTVKEELDRLVDESRKLSRDVRETLEELVKRSEDVTRRVEETLREIVK

SEQ ID NO: 18384 - protein, 177 aa, Artificial Sequence; identical to SEQ ID NO: 18383
  Synthetic sequence.

SEQ ID NO: 18385 - protein, 177 aa, Artificial Sequence
  Synthetic sequence.
DELERILEEVKKVVEEVVRRAEESVKKTEDVMRKVVERVARSLEESRRVAEEVERRIRSEKLRRVREIVKEVVRINEELVKRVKDIVREVLERNRDLVRRVRDIVRRVEEEVKKLADNNGPEKDVKRLVDEVRKELEELVRRSEELTKEVKKTLEELVKESKEVVKDVEKKLREIEK

SEQ ID NO: 18386 - protein, 177 aa, Artificial Sequence; identical to SEQ ID NO: 18385
  Synthetic sequence.

SEQ ID NO: 18387 - protein, 181 aa, Artificial Sequence
  Synthetic sequence.
REVDEAVKNNEEDAKESRRVVEEAVKRDEDIARDIERRAREVVERDKEIVDEVRRRVKDEKKLREVVTLSKKIVDETKEIADRVLELSKRIVKETRDIAKRVLKLNDDSVKDVRRIAREVRSKEVKDLLDENSKRSNEISREVKKDLERTVRENKKIVDEVRKKLEDTVDKNRRIVEEVTT

SEQ ID NO: 18388 - protein, 181 aa, Artificial Sequence; identical to SEQ ID NO: 18387
  Synthetic sequence.

SEQ ID NO: 18389 - protein, 181 aa, Artificial Sequence
  Synthetic sequence.
SEVDKMLKRSNDIVREIARVVEEAVKTDERIMREILEHARKVVEEDKEIVDRVRKEVEDEEKLREVVERSRRIVKETEESAEEVLRRSAEIVKDTKRIAEEVRRRSKRISDEIRRIAREVRSEEVVRRLRTLVEENRKIVEDVKRELERTVRDNRRIVEEVAKRNHDTVRENKEIVDRVKT

SEQ ID NO: 18390 - protein, 181 aa, Artificial Sequence; identical to SEQ ID NO: 18389
  Synthetic sequence.

SEQ ID NO: 18391 - protein, 180 aa, Artificial Sequence
  Synthetic sequence.
KEAEDVIELVRRILEEVDRRVRDVLRKDEESLRRVKKTVEEVLKRHKDIEDEVRRRVRSEKLRRLVKKVRDMLKNVEKLARELIEKVARSIEKTKKIAEDLIRKAEEVLREVERVRDELDSEEVKRVLEEIVKKVEEIVKDVERKLRKTVEENEEVVRRVKRYLEKSVEDLEKVVRDVTT

SEQ ID NO: 18392 - protein, 180 aa, Artificial Sequence; identical to SEQ ID NO: 18391
  Synthetic sequence.

SEQ ID NO: 18393 - protein, 177 aa, Artificial Sequence
  Synthetic sequence.
SAEDILREVEELVRRTRKHLEDSLREVTKLVEETKREADRILKEVRDRVKEVIERGRDKKDLVRELEKAIEEVERRIRENVRRNEKVVEDHERLIRENEKKNDDAIERIRKIVAETKDEEVLKTVREELRDIIRRSVEHNRDSLRRLREIIERSLRHVEEVLERVRKEIERIKRETK

SEQ ID NO: 18394 - protein, 177 aa, Artificial Sequence; identical to SEQ ID NO: 18393
  Synthetic sequence.

SEQ ID NO: 18395 - protein, 177 aa, Artificial Sequence
  Synthetic sequence.
SAEDILREIKRLVEETERLLKRILEEVRKLVEETRRRLETILRRVEEKVRRLVEKGRDKRELKKRLEDVIEEIRKIIEDNIRRNDRVVEEVERLIEEDLRDNRRLVRRIEEIIRRVKDEETLKRALDEARKIIEESKKHVKDVLRKVTDEIRESKKDVERVEDEVDKRIREVDERTK

SEQ ID NO: 18396 - protein, 177 aa, Artificial Sequence; identical to SEQ ID NO: 18395
  Synthetic sequence.

SEQ ID NO: 18397 - protein, 181 aa, Artificial Sequence
  Synthetic sequence.
SIDEVAEEVERLLEEVKETSREVLERVKRELEKIIDTSRRILEEVRRLLERVLEEVERRKKNRERVRELVRRLLERARKVLEDNKDSVRRILEKLKEVLKRNEESVARIKEELERVRRDVKDDRDVKRVLDKVRKKIEENKDTVRRVEEEIKKLIEDNKRTSEKVRKEVTDIIEEIKEEIK

SEQ ID NO: 18398 - protein, 181 aa, Artificial Sequence; identical to SEQ ID NO: 18397
  Synthetic sequence.

SEQ ID NO: 18399 - protein, 176 aa, Artificial Sequence
  Synthetic sequence.
DVEDVVREAEDLLRKLEEKSRKVVEDAKRLLDEVKRKMEESVKEAKRLLDEVLRKSDEEKIRELVKRLEEINRRSLEEIKKLVKTLEEKLREMNERNKESVERLRRELTEARKRIRDKKIVEEVRRRVEEVVRRDEKSVEDLKREVDRVITELDRLVKRNTEEVERVIRRLDEETR

SEQ ID NO: 18400 - protein, 176 aa, Artificial Sequence; identical to SEQ ID NO: 18399
  Synthetic sequence.

SEQ ID NO: 18401 - protein, 179 aa, Artificial Sequence
  Synthetic sequence.
SEEEDAERLLRDLKRRADEVVKESEKILEDIVRDAERVLRESKRISEEIVRRADEIRRKVRGEEELEKVVRELEKLTRENKERVDRIMKKLAKLVEENERRVRELEEELKRILEEIVRRIGRESRLVEELRRLVEEVRERLDRSVKKTKELLKEVIKELEKLLKKDEDDVERVIRRLED

SEQ ID NO: 18402 - protein, 179 aa, Artificial Sequence; identical to SEQ ID NO: 18401
  Synthetic sequence.

SEQ ID NO: 18403 - protein, 178 aa, Artificial Sequence
  Synthetic sequence.
SEVEDILRRVEKRARDSLKHLEDVLRKVDKRVRESLDNLRRVLEEVERIVRELERLLDEGTDIEELLRRMEEMIRRIEEKVRRNLDDNRRVVEEVRKEVAKDLRDNERVVKDVRREIRDERLLEEIVRRLEDSLRKVEEIARRIEKRLRDSLRETKRIADEIRKRLEDALRRVEERAR

SEQ ID NO: 18404 - protein, 178 aa, Artificial Sequence; identical to SEQ ID NO: 18403
  Synthetic sequence.

SEQ ID NO: 18405 - protein, 178 aa, Artificial Sequence
  Synthetic sequence.
SDVEKILDDVRKDAERSLENLKEVLEKVEEEVRRSLEDLRKVLEDVERIARKLEELLKEGVDIRELKKELERVLEEIRRIAEENLKRNKDVVREIRKIVKENLDRNRRVLEKVRREIKDEELLRRIERTLRESLEAVKRIAEEIERTLEESLREVERIVKEMEDLVRAALKRVEDKAR

SEQ ID NO: 18406 - protein, 178 aa, Artificial Sequence; identical to SEQ ID NO: 18405
  Synthetic sequence.

SEQ ID NO: 18407 - protein, 178 aa, Artificial Sequence
  Synthetic sequence.
SEVEEILRRIKEEVRESLEDLRRVLEEIEKKAKESLRELKEVLERVKEIADKLKRLLDEGRDIRELEEELKKVDEEIDRIARRNKEENRRVLDEVRKVAKRNKDRNKEALRRVEKDIRDEKLLRDIKRDLERSLEAVDKIVKEIMERIKESLKATERIVKEMKDLITRVREEVKRRAE

SEQ ID NO: 18408 - protein, 178 aa, Artificial Sequence; identical to SEQ ID NO: 18407
  Synthetic sequence.

SEQ ID NO: 18409 - protein, 177 aa, Artificial Sequence
  Synthetic sequence.
DEVEELKERAKRSNEELKRKVEELKKRAKKAIDDVRRVVDENKKLVKEAIDRLRKTDVDEKIIEDLKRKLEKSVKESEDLVRRLEELMKEVVERLKKLVETNKRLTDEVVKKLARVREKETLKKLLEELKKLVDESRRRLDELRKEVEKKVEEMLERARRLLKKTEDLVREVKRRVD

SEQ ID NO: 18410 - protein, 177 aa, Artificial Sequence; identical to SEQ ID NO: 18409
  Synthetic sequence.

SEQ ID NO: 18411 - protein, 177 aa, Artificial Sequence
  Synthetic sequence.
DELKELEDRLRRAEEEARRLLEEIKKRLKESNEELKRLVEENEKLVKEALRRLENTDVDKKIIETLKRLLEESVERSRRLVERNREESEKVVERLKRILEELRRLLRRVVEEAARVKDKDVLRKLLEEVERLVKRVLDELRALLKEVEDLVRKSVEDLRKLLEETRKLVREMEERVR

SEQ ID NO: 18412 - protein, 177 aa, Artificial Sequence; identical to SEQ ID NO: 18411
  Synthetic sequence.

SEQ ID NO: 18413 - protein, 177 aa, Artificial Sequence
  Synthetic sequence.
SLVEKLEKRLRDVIKTIEDIIRENEERLRRSNRELEKLVDENRKLVEEVLKRLADTDVDKKIIEELERRLKESLDRSRELVKENKRLSEESVRRSRRLLEELKKLAEEVIERLRRVKDERVLEKLLREVEELAKRVLTELRRLLRETERLVRESEKRLRDLLRDTERLAREVEKRVE

SEQ ID NO: 18414 - protein, 177 aa, Artificial Sequence; identical to SEQ ID NO: 18413
  Synthetic sequence.

SEQ ID NO: 18415 - protein, 177 aa, Artificial Sequence
  Synthetic sequence.
SLVEDLKRELEKAKEEIEKIVRDLERELDRVIKENERLIRENEDTVRKALERLRRQDVDERIIRELEKKLRESVEESKKSLEEVEREVDEVRKRLDELVKELEKRVREVIEELRRVREEDVLRELKDRVRRIVEEVARRLEELLKKVKDLVKKSLKTNEDLLRKTEELVRRAEERVK

SEQ ID NO: 18416 - protein, 177 aa, Artificial Sequence; identical to SEQ ID NO: 18415
  Synthetic sequence.

SEQ ID NO: 18417 - protein, 181 aa, Artificial Sequence
  Synthetic sequence.
SEVEEVLKRLKELVDTVLEELKDVIRRIEELLERVRRDNERTIREDEELVRKVLDELRKISDKKTIERIVRRITRESERLLEENHRINKRITEELERLVRELERVVEEIIERLKELLERVKSGELAEEIERVIREAERRLKKLLDELRRLVEEVRRELEELDERLKRSSEEAKKRLDELVK

SEQ ID NO: 18418 - protein, 181 aa, Artificial Sequence; identical to SEQ ID NO: 18417
  Synthetic sequence.

SEQ ID NO: 18419 - protein, 181 aa, Artificial Sequence
  Synthetic sequence.
SEVERVLEDLRRLVRDVEEKLRRIIERDRRLVEEVERENRKTIRKIEELLRKVLEELKDISDKKTIERIVREIIKEARDLVRRNHERNREIVDESRRLVEELRRIVEEIIRRLRELLERVKSGELAERIEDVVREAEKRLRELLKELEKTSRDLKKRLEELDRELKALVEKVERDLEELRK

SEQ ID NO: 18420 - protein, 181 aa, Artificial Sequence; identical to SEQ ID NO: 18419
  Synthetic sequence.

SEQ ID NO: 18421 - protein, 185 aa, Artificial Sequence
  Synthetic sequence.
SEAEELLRRLKELVDEVLKRLRDMIKRSEDLARDVLRKHEDLIRKLEELMKKVEDLADKISDKDTVRELVKEVKKRLERLLRESEKLSKRVKEELKRSLDRSKELVDRVVETVREILKRLRDAGVPEEVVREIERIVREVTERLRRLVEENAEVVKRVEKELKELNDELRRVVEEIVRKAKEKTK

SEQ ID NO: 18422 - protein, 185 aa, Artificial Sequence; identical to SEQ ID NO: 18421
  Synthetic sequence.

SEQ ID NO: 18423 - protein, 185 aa, Artificial Sequence
  Synthetic sequence.
SEAEELLKRLEDRAEEILRRLEEILRTSRKLAEDVLRELEKLLRESERRIREVLEELRRIKDKKELEDVIREVEKELDESLERSRELLKDVLKKLDDNLKESERLVEDIDRELRKILEDLKKAGVPKEVVDEIKRIVDEVRERLKRIVDENRKIVEDARRKLEKIVKENEEILRRLKKELRELRK

SEQ ID NO: 18424 - protein, 185 aa, Artificial Sequence; identical to SEQ ID NO: 18423
  Synthetic sequence.

SEQ ID NO: 18425 - protein, 183 aa, Artificial Sequence
  Synthetic sequence.
DMRKELEKRVEEIRRAVTELVKRNEDIVREVKKRVEELVKRNEDITKKAEDDIRDLVRKRDREELRRLVERLKKLLKESNEELRRLVRELEERLRESIRNSRRVVEDLERKLEEIRKEISRVDEEEKLRRLLERLEDIARRVLKYLEEDLRETEKLAKEVLDRARKILEETKELVKDVLEKAR

SEQ ID NO: 18426 - protein, 183 aa, Artificial Sequence; identical to SEQ ID NO: 18425
  Synthetic sequence.

SEQ ID NO: 18427 - protein, 183 aa, Artificial Sequence
  Synthetic sequence.
DMDEELRRVVKEIEDELRRLVEENRDVVRKVEKLNRDLLKRNEDITDEARKRVEDLVRKRDDERVRELVRKLTEELKESNERNRKVVEESKRRLEESIRNSERVVEELKRLLREIIRTIDDVREREKLEKLIRRLREIAKEMLEYAKRDIERTKELAKRSLERHKESLDRTEKLVKEVLDKAR

SEQ ID NO: 18428 - protein, 183 aa, Artificial Sequence; identical to SEQ ID NO: 18427
  Synthetic sequence.

SEQ ID NO: 18429 - protein, 183 aa, Artificial Sequence
  Synthetic sequence.
DMVRDLERIVEKIKEDIKELVKRNREVTEKVVRDVEELVKTNREVVREATRRVEKLVEEEDREEVRRIVEELRRRLTKSIENSERVVEKLKKDLEKSNRDLEDLVRRLTELLKKIIEEIRRVKDEDTLRKLLKTLRELARRVLEEARKIIERSKELAERVLRYLKRDIEESKKIVKEIEDRAR

SEQ ID NO: 18430 - protein, 183 aa, Artificial Sequence; identical to SEQ ID NO: 18429
  Synthetic sequence.

SEQ ID NO: 18431 - protein, 183 aa, Artificial Sequence
  Synthetic sequence.
DMERELDDVVRKAEEDNRRLLKENEDIVREVVDRNARLLEENRRVVEEAVRRVEDMLRRRDRERLRDIVDRLRKELKKSEDNSRRSLKESEDRLRESIENSRRSIEESRKLLEEIRETIRRVKDERKLRKLIDDLRKLVRESLEYNKDDLEKTKELARRSLKYNKEDIDRSREIVRDVRRKAQ

SEQ ID NO: 18432 - protein, 183 aa, Artificial Sequence; identical to SEQ ID NO: 18431
  Synthetic sequence.

SEQ ID NO: 18433 - protein, 183 aa, Artificial Sequence
  Synthetic sequence.
SVIEALEEIAEKIERDVRKLVEENREVVKEAEKRVEEILRTNSKRSEEVRREVEDLVRKDDREEIRKLVEDLTRRLEESNRELKKLLEELKDLLRRSIENSERVVEKLRREARTLIEELSRVKEERVLEELLRRLEEIAKRALEYLTRDIEETKRLVEEVLKRLKEILDKTDDLAREVLERAR

SEQ ID NO: 18434 - protein, 183 aa, Artificial Sequence; identical to SEQ ID NO: 18433
  Synthetic sequence.

SEQ ID NO: 18435 - protein, 185 aa, Artificial Sequence
  Synthetic sequence.
SEVEKIEEDLKRLVKRLREINEESKKRLEELIRTAEEINKKTTDELERLAEEVDRLVKRVTSKEVKDLLREIEEELKKLLRKNREINEDIVRRLEELVRRNEKINKEIVERLDKTVKDVKKDLRSVREAVDRLRRVVDEIRKEARKLNEEIRKRVEDVVRKLDKMDEDLRKRVEEIERKVREATR

SEQ ID NO: 18436 - protein, 185 aa, Artificial Sequence; identical to SEQ ID NO: 18435
  Synthetic sequence.

SEQ ID NO: 18437 - protein, 185 aa, Artificial Sequence
  Synthetic sequence.
SEVEEILERLRRLVKEVDKRNTDSLDTLKRLIDELERKNRDSLRRVDELAKELEKLARRVTSEEVKKLAEDVVRRLEELVKENKEENERIVKRLTELLEENRDENRRIKEELEELLRDLKRKLRSVKDAVTELEKDVREIKKRLDEMDKRLKDVVDEVRRRAEEVNRRIERLVREIEKRAREEVR

SEQ ID NO: 18438 - protein, 185 aa, Artificial Sequence; identical to SEQ ID NO: 18437
  Synthetic sequence.

SEQ ID NO: 18439 - protein, 185 aa, Artificial Sequence
  Synthetic sequence.
SEAEEVLERLKRLRETVKEENDDSLRKDRELVDRLEKDNRDSLRKLKELIERVREILKRVTSEDVRRLLRRIVEELKELVERNKERNKRIVETSKRLVEKNRKRNEDITRDLRRLVEDLKRRLKEKKDVVETVKRVVEEIEKELEEANRRLEKSSREVEDRIRKANKRLEEVVDEVREEVDKATR

SEQ ID NO: 18440 - protein, 185 aa, Artificial Sequence; identical to SEQ ID NO: 18439
  Synthetic sequence.

SEQ ID NO: 18441 - protein, 185 aa, Artificial Sequence
  Synthetic sequence.
DEVREVLTRLEELVRRVTKELEDSLRNTERVRRTIRKLAEEVNRDSKRLKDEVKKVLEKIKDKDTLRKVVDDVEKELEELNRTLERLVREVSRYLRENNDRSRKLVEEVIERARRIVDTLRRAGVPEEAVETLKRKVEEIERRLKRMVEEDRKTIEEIEEEVRRLVKTNREIIKEIVETLREAVR

SEQ ID NO: 18442 - protein, 185 aa, Artificial Sequence; identical to SEQ ID NO: 18441
  Synthetic sequence.

SEQ ID NO: 18443 - protein, 185 aa, Artificial Sequence
  Synthetic sequence.
KEVEEVRTRLKKLRDDVKRLLDEVNEESKRLAEEVRRRLEESNRNTERVVEEIERVIERIKDKDTLERMVREVKRYLEENNKRSEALVDKVEKDLKRLNDKLREDVKRVIERLRRLVEELKRAGVDDKVVDEVRRRVEEAEREVKDMVRTNNEIVRRIVEEARRLVDEDRDRIKKIEERLRRELQ

SEQ ID NO: 18444 - protein, 185 aa, Artificial Sequence; identical to SEQ ID NO: 18443
  Synthetic sequence.

SEQ ID NO: 18445 - protein, 185 aa, Artificial Sequence
  Synthetic sequence.
SEAEEVLREVDELAKRLERVATESLKNTKKVVDDVRREVKRVNERSEEIMRRIEDVLRKIKDKDTLRRTVEEVIKELEDLNRELEKRVREVIRYLRENNRTTKEKVDEVRRRLEKLLDDARKAGVPEELIREIERIVREIDKRARELVERDNREVERIVEELKELVKTNNDIVRRVVEKLKETVR

SEQ ID NO: 18446 - protein, 185 aa, Artificial Sequence; identical to SEQ ID NO: 18445
  Synthetic sequence.

SEQ ID NO: 18447 - protein, 183 aa, Artificial Sequence
  Synthetic sequence.
SEAEKILEDLKRIVRRIKEELRRVLDHTRELVERIRRLAKKILDDTEKIVRDIRDKAEKVRDKDDLRRLVEEIRERLRRSDEELRKLVEKIARDLDKNLEDSERLVEKITKELEELLEDIRRLPEDVVRELKREVERIKREVKKMVDDNRRTVEKIKRDAEKMVRDNEELSRRIEKDVDDKTK

SEQ ID NO: 18448 - protein, 183 aa, Artificial Sequence; identical to SEQ ID NO: 18447
  Synthetic sequence.

SEQ ID NO: 18449 - protein, 183 aa, Artificial Sequence
  Synthetic sequence.
SEAEKIEERLKRVVEKLRRDATRVRKHTDDLVKEITDLAEESKRRVEEIRERVKRLRERVTDKDTVRKLVEEIKKRLDDSDKTLEDLVERIERLLEENLKDSERLVTEIEKELRRLLEEVRRLDEKVVKRLEDEVKRIKDEAKEMVDENKRKVDEIRKELRRLVEENRRESEKIKKKLDEDLK

SEQ ID NO: 18450 - protein, 183 aa, Artificial Sequence; identical to SEQ ID NO: 18449
  Synthetic sequence.

SEQ ID NO: 18451 - protein, 183 aa, Artificial Sequence
  Synthetic sequence.
DEIREILRRIREVVADATRRAKESLDNLKRVVEEVDRRVKESLDRLKEIVDRVRELSKRVTDKETVKELVERIRKELDDSNEELRKLVRDVEKYLKDNVRRIAELVKKIEKELRDLLREISRLPKDVVKRVEDEVRDIRRVLEEMVRRDKKVVDEIRERLKEAVRRNEEVSRKIKKDLKDETK

SEQ ID NO: 18452 - protein, 183 aa, Artificial Sequence; identical to SEQ ID NO: 18451
  Synthetic sequence.

SEQ ID NO: 18453 - protein, 177 aa, Artificial Sequence
  Synthetic sequence.
SMEERLREVVTEIRKKVEKLLRDNRKSNKEIKETVDDLVRRNRELTERAKRRVDARGIREDVVRRLEKRLRESNEKVERVVEEIEKRLRESDKKVEEVIERLDRLLKELIKRISRVTREREAEELLRELADVVRRAEELAERSLRESEKVMEDITREAERILRDTKRLIEEIERRAR

SEQ ID NO: 18454 - protein, 177 aa, Artificial Sequence; identical to SEQ ID NO: 18453
  Synthetic sequence.

SEQ ID NO: 18455 - protein, 177 aa, Artificial Sequence
  Synthetic sequence.
SLREDLEKDVRDIVREIDEAVERNRRSVEEVDKRVEDMLKNNRDSNKKIEEDVRRAGIPEEVVEELRRRLEESDREVERILKELRDRLREIIERSEDLVRRLREELKRLIDTIDRITREEDAKRLKDELREVVDKIRRDLKKSNDDIRRLVEKIKRELEELNKRSRELVERARETVR

SEQ ID NO: 18456 - protein, 177 aa, Artificial Sequence; identical to SEQ ID NO: 18455
  Synthetic sequence.

SEQ ID NO: 18457 - protein, 177 aa, Artificial Sequence
  Synthetic sequence.
SLEETIEEKVRRIREEVRRMLENNRRINEEVDRRVTEMVERNRKTVEEVVREVDRDGIPESVVDELRKAVEAVIRKSEKIVEDLRREAEKSDDELRKVVEKISERLEDIRRKVRKLTREEDAKRLLEEVEDIVRRLRKELEDSNRKSRKLVEEIRKRAEESNRELRELIKRIKDRAR

SEQ ID NO: 18458 - protein, 177 aa, Artificial Sequence; identical to SEQ ID NO: 18457
  Synthetic sequence.

SEQ ID NO: 18459 - protein, 177 aa, Artificial Sequence
  Synthetic sequence.
DVLERLAEVVRRVVKEAEDLVRNNRRLNKEVEDEVDELVRNNRRLTKDVVKKVEDAGVPEEVVDEIRKLLTTSNERVERLVDELKKRVETSDERAKRIVDRLRKIVEKLIREASKVTSKEEVKRLEDELRKVVDKVRKDMKRSNDDSERLREDITRKAKRLNEETRKVMEDVTRRAT

SEQ ID NO: 18460 - protein, 177 aa, Artificial Sequence; identical to SEQ ID NO: 18459
  Synthetic sequence.

SEQ ID NO: 18461 - protein, 185 aa, Artificial Sequence
  Synthetic sequence.
KEAEELIREIERKAEEVRKENERSIRENERLAREVEKRLKRTNEELKRLVRELEEKLKRDDDGETVKREVKKIDEDLRRLVEESERIVKEIVERSRKSVEDNRRRNEEIERDLRRLVEELKRRGVDEELIRRLEEVVKRIREDLKKLDDDLKRSVEEIERRLKKVIEDNRETLERARRRLDERVK

SEQ ID NO: 18462 - protein, 185 aa, Artificial Sequence; identical to SEQ ID NO: 18461
  Synthetic sequence.

SEQ ID NO: 18463 - protein, 183 aa, Artificial Sequence
  Synthetic sequence.
DEAEEILEELRRLIEEDKKTVEEVLRRDEETIKRLEEENREALKDNRRLIEELEDIVRRIKDKDTLREILKRVLEESEELLRRVHKRNREVIEENRRSVEELKKINEDSIKRIEDLLREIRRVDEKVREKVERILDDLRRVVEETVKRAEDLLRKSREVVKRVDEELKESHDRLDERIKRDLK

SEQ ID NO: 18464 - protein, 183 aa, Artificial Sequence; identical to SEQ ID NO: 18463
  Synthetic sequence.

SEQ ID NO: 18465 - protein, 183 aa, Artificial Sequence
  Synthetic sequence.
DEAREILKTLKDLIKELEDRNREVLERDKKTIEDLERRNARVLEENKKLIDEIRRIAKDIKDKDTLSEILKRVLRESEKLLRKIHKENREVIKRNEDSLKEVHDENRKVREEIKRLLDDARRVDRSVEEALKKILRELEKKVEEVDRRLKRILEDSRRVVRRVDEEARKSHEELKRELDRIRK

SEQ ID NO: 18466 - protein, 183 aa, Artificial Sequence; identical to SEQ ID NO: 18465
  Synthetic sequence.

SEQ ID NO: 18467 - protein, 183 aa, Artificial Sequence
  Synthetic sequence.
KEAEDLLRKLRELIKKLDDTNRRVLERDRKTIEELERRAEKILTDIERLIRELEDRVRRTKDKDTLRELLRRAKDTIRKLLKDLRDELEKVIKENERSLREVHKRNKEVDEDAERLVAEVRRVDEKVVEKARRILKELRDRIREVDKRLRELLEESRKRVEEVERELERLVRELEKKVREAEK

SEQ ID NO: 18468 - protein, 183 aa, Artificial Sequence; identical to SEQ ID NO: 18467
  Synthetic sequence.

SEQ ID NO: 18469 - protein, 182 aa, Artificial Sequence
  Synthetic sequence.
SEVEDVVRKIKEILERLKKEVDDVLDRNRKLLEELKKRADEVLKRNKDLLETLKREADRDGKDEDVVRRARKILKELRDHSKKVVEDMERILEESKKHSEDAVRRLREIVKRLAEEVDEVTKRGVDKDELKRLLDELREIVKEAEERLRKSDEDLERIIREVKKRLKESNEELERTIREVER

SEQ ID NO: 18470 - protein, 182 aa, Artificial Sequence; identical to SEQ ID NO: 18469
  Synthetic sequence.

SEQ ID NO: 18471 - protein, 184 aa, Artificial Sequence
  Synthetic sequence.
REVEEVVKEAEDLLRKLRELAKEFLTRHKKLIRDVTEKVKEVLKRSADSIRELEKIIDKVTSDEVRRLLEEINKRNREEIERLLRELEKILRESRELSKELKKILDEILKRIRELVEKVKARGLPEDAVRKLEEMVERLARIVEDVERKLKKLNKELEEIVRDAKRRLERLNEELRRRIREAER

SEQ ID NO: 18472 - protein, 184 aa, Artificial Sequence; identical to SEQ ID NO: 18471
  Synthetic sequence.

SEQ ID NO: 18473 - protein, 184 aa, Artificial Sequence
  Synthetic sequence.
DEDEDIERKLKELIDRLREEVKKAEDEHKELIKRDHRRVEEVERRSEKSIKDLRDLAKKVSSEEVERLLEDINRRNRELIDRLRKELEKTNEESKRLSEELKRKLTEVLKRIRELVEEVRKRGLPEDVARRLEELVEELEDIVRKVKESLRRLNEELRKNSETVKKKLEDLNRELRKDIEEKRR

SEQ ID NO: 18474 - protein, 184 aa, Artificial Sequence; identical to SEQ ID NO: 18473
  Synthetic sequence.

SEQ ID NO: 18475 - protein, 184 aa, Artificial Sequence
  Synthetic sequence.
SEAEKVLEEAKRLIEELERRVREVLKRSKKTIEDLRREVDRVVKEHKKLIRELREIIKRVTSREVEKLLEDILRDSRRLTKELDEKLKEINKRNAELIEELKRILDKIRKDIKRLIEEVEKRGLPEEVAKRLKDVLRELKDLVEKIEEEARRLNEELKEIIDRARKTLEDLNRELEEVVRRARK

SEQ ID NO: 18476 - protein, 184 aa, Artificial Sequence; identical to SEQ ID NO: 18475
  Synthetic sequence.

SEQ ID NO: 18477 - protein, 178 aa, Artificial Sequence
  Synthetic sequence.
SEVDEVRRELERVITDDKRLVDESRRKNEKSIRDDEELIKTSRRINEESIRRLKELVERGVPEEELERIVKENKEKVARVVEESKRLVERNKREAEKVVEESRRRVKRLREELKDVVRKGVDEETLRRLVKRLDETSEELEDENRRLNETLKRSSDELRKTNEELNKRLKEVVDRAKK

SEQ ID NO: 18478 - protein, 178 aa, Artificial Sequence; identical to SEQ ID NO: 18477
  Synthetic sequence.

SEQ ID NO: 18479 - protein, 178 aa, Artificial Sequence
  Synthetic sequence.
SVEEKIKEMVDKIKDSVRRSTEENDRLVKEIDKVLKEAEKRNRDLLKEAADVLKRVLDKRRESEELRRIVEEVEKTHRDLLKKTADLVRKVREDHDRLLKESKELNDRSERRAEELERKVDDIDTVLKDMKKILDDNKKLVDDSRKKHKESIDRLRKLVKDSLDEHRESIERLERAAR

SEQ ID NO: 18480 - protein, 178 aa, Artificial Sequence; identical to SEQ ID NO: 18479
  Synthetic sequence.

SEQ ID NO: 18481 - protein, 179 aa, Artificial Sequence
  Synthetic sequence.
REVEELERELEESNKELRKLIKELDDLLRETNKRLNDLIRELKERLDRVLEELRKIIKDDRRLVEELRRLVEDVRRELKKAIDELKKIVEDSERELERMIKRLRDIVDESRKRLKEVSRTREVEKLVEEAIKRNEDLVRTVERKVDEAIKENRRSVEKVAEEVKKAEEELERIVDTVRR

SEQ ID NO: 18482 - protein, 179 aa, Artificial Sequence; identical to SEQ ID NO: 18481
  Synthetic sequence.

SEQ ID NO: 18483 - protein, 179 aa, Artificial Sequence
  Synthetic sequence.
REVEELKKEADKTNEDLNRLIKELEERARESNRELKRLIDELRRRLEEVLKRLKDIIDKERRSTEELRKLVKDVEDELEKVIRDLERIVDRSRKELERVIRELEKIVRESERRLKEVSRTEEVERLVTEMIKRNRTSVDAVRRKVKEMIDRNKALVETVRDEVRRAREKLRDILRKAEK

SEQ ID NO: 18484 - protein, 179 aa, Artificial Sequence; identical to SEQ ID NO: 18483
  Synthetic sequence.

SEQ ID NO: 18485 - protein, 180 aa, Artificial Sequence
  Synthetic sequence.
SIEEIVRKVKEDLKRSLDELRKVSEDMARRLRESLKELEEVVREMEERLKRILDDIRRKVPEDRVRELERRVRELIERLRKKVKENKERLEKIVKDSDDHVERNVEELEKIVRELEKLVRDGRDERDLKRRVDEVLTRSKESVDENKRTADRVLEESRESIKELKERAKRLLERLEEERK

SEQ ID NO: 18486 - protein, 180 aa, Artificial Sequence; identical to SEQ ID NO: 18485
  Synthetic sequence.

SEQ ID NO: 18487 - protein, 178 aa, Artificial Sequence
  Synthetic sequence.
KEVEELEREARRMLEHTKRLIDEVRDRAKKSLDNTRRVDREVEKLVEDTERRLDELRKRGEPEERLKDIHRENRELVKRIEEYLKRDLDRSRKLVREIEERLRENLETSEDLVRRLVKGEELKRTAERMIEENRRLVETLKRVLEEAIRRNEELVKTLLRKLEESDKKIRKLIEETRT

SEQ ID NO: 18488 - protein, 178 aa, Artificial Sequence; identical to SEQ ID NO: 18487
  Synthetic sequence.

SEQ ID NO: 18489 - protein, 178 aa, Artificial Sequence
  Synthetic sequence.
SELEELRDRLKEILEHTKKLIKESVERLEESLRNTRRVIRKVEEEVERTRTKLDDLRRRGEDETKLREIHRENRELVRRIVKYAEDDLRRSRKLVEDSKRRSKKNLDDSEELVRRLVRGEEMADVARRVIEENKRLVEENEDRLRKAIERNRELVEEVKKRLEDSDREIERLIREVKK

SEQ ID NO: 18490 - protein, 178 aa, Artificial Sequence; identical to SEQ ID NO: 18489
  Synthetic sequence.

SEQ ID NO: 18491 - protein, 178 aa, Artificial Sequence
  Synthetic sequence.
DEVETLRREARKLLERIKREIEEVRRRLKESLDNTKRVEDEARKLVKETKDKLKRLAERGSPKEDLERIHRENRDLVRRIEEYLKRDLDESRKLVEEIERRLEELLRTLEDLVRRLVRGEEMRKVAEDMEREIRRLITDLRRELEEAIERNEELVRRLARELERSDREIKKRIDEIET

SEQ ID NO: 18492 - protein, 178 aa, Artificial Sequence; identical to SEQ ID NO: 18491
  Synthetic sequence.

SEQ ID NO: 18493 - protein, 178 aa, Artificial Sequence
  Synthetic sequence.
SELDELRKRAKRSLETTEELIRRSRKLMRESLDNTRRVEEKVRRLVEKTLRDLEDLKRRGVPEETLREIHKENRELIRRIEKYLEEDLRRSRELVKESKKRSKDDLDRSRDLVRRLVRGREMEETAREAIERNRKLVEDNERDLKKAIEDNEKLVRDLKRELERSDEEIKKLIREVKN

SEQ ID NO: 18494 - protein, 178 aa, Artificial Sequence; identical to SEQ ID NO: 18493
  Synthetic sequence.

SEQ ID NO: 18495 - protein, 178 aa, Artificial Sequence
  Synthetic sequence.
DSREELRREAKRLLDDIKRLEEKVERLAREVLKHTEELDEKLKRLVEETLKKLEDLRRRGEPDESLRRIHEENRRLVDEIRERLKENLRTSKKLVKEIEERLKELLEELRDLVRRLVRGEELKRTAEEMERRIRELIKRLKDRLEDMIRRNKELVDRLKKKAERSDEEIERLIRETKK

SEQ ID NO: 18496 - protein, 178 aa, Artificial Sequence; identical to SEQ ID NO: 18495
  Synthetic sequence.

SEQ ID NO: 18497 - protein, 182 aa, Artificial Sequence
  Synthetic sequence.
KEIEDVVRELERKVRENKRRNDEVIKRLERLVEKNTELVRRLIRTLEKLVEDLEDIVRRIKDKDELEERLERIRRRIKELVRKLEELNKKSLDDIRRLVEKLERENERSLREIKRDVDELVRSEEAKKVAEDVERRIRRSVEEARRLLEEVKRKMEESVEESKRLLKKVEDEAKDVVDRARK

SEQ ID NO: 18498 - protein, 182 aa, Artificial Sequence; identical to SEQ ID NO: 18497
  Synthetic sequence.

SEQ ID NO: 18499 - protein, 182 aa, Artificial Sequence
  Synthetic sequence.
SEIDKVIEELKDLVRKNEKRNRDVVRRDDKSVKDNTKRVEDVIRDLDRLIRELREIVERIKDKDTLRRILKEIKDRIKELVRRLDEENKKSIRDNERSVEEVEKENRESLKTIRELVRNLVNDKRAAELAKEVIDRMEESVKEAERLLRELKRKSEDSVRKSKELLDEVEKKVEEVVREAER

SEQ ID NO: 18500 - protein, 182 aa, Artificial Sequence; identical to SEQ ID NO: 18499
  Synthetic sequence.

SEQ ID NO: 18501 - protein, 182 aa, Artificial Sequence
  Synthetic sequence.
EEIERAIEKVEREIRELEERVREIIERDRKSVEDNSRRVRTVIKELEKLVEELRKTVKDIEDKDTLRKILDEIRRRIEELVRKLKRENDESNKKNKKSVKDLEDELETILKRIEDEVRKLVNSEEARKLAEELRKEIKRVVDEVRKLLRDLERKSKESVREAEELLKRVRDELKEVVDRTEK

SEQ ID NO: 18502 - protein, 182 aa, Artificial Sequence; identical to SEQ ID NO: 18501
  Synthetic sequence.

SEQ ID NO: 18503 - protein, 177 aa, Artificial Sequence
  Synthetic sequence.
SLREAVERLRKRHEDVVRELEKLVRRVKEELERVNKDLRKVVEEVRRRLEKVLEDAKDVERIKEIKDEVERVIRELKKIVDESRKNSKDLKEELDDVLKKSEDNVRRVTEELKDVVRRGGPVTDLLKRADDNVKRNRDLIRRLKEKADEIVKRNEDLIEDARRKADEMIKDLEEKAR

SEQ ID NO: 18504 - protein, 177 aa, Artificial Sequence; identical to SEQ ID NO: 18503
  Synthetic sequence.

SEQ ID NO: 18505 - protein, 182 aa, Artificial Sequence
  Synthetic sequence.
SEVDELRERAKRIVDDLRRKIEEVVKRLEDSDEENKKLIEKAVRELEKIIRDLEEVIRRGVDREEVRRIEKELRDKLEKVKEESKRTIDENRKIVTEVIKTVEEVLKRLREELDRVIKEKKDVRELKELVDRLDKEATDVLRKVREDLRKAIERSERSHRRLEKLIEEIERELKRVVDEVTR

SEQ ID NO: 18506 - protein, 182 aa, Artificial Sequence; identical to SEQ ID NO: 18505
  Synthetic sequence.

SEQ ID NO: 18507 - protein, 180 aa, Artificial Sequence
  Synthetic sequence.
DIEELLRKVAEEITRSVKESRDRLDEVEKKAREVVERSEKRLREVEEKIERVVRRIVKSDELRDLARKVLDEIRKLVEKLRRLNEKSLRDIERLVRKLEELNKRSLDEIRKLVEELKRVDREEDADKVLKEAEELVRRNRRLVEEVLRRLEEIVKRDEDLVRKVLKEADEIVRRLEEAAR

SEQ ID NO: 18508 - protein, 180 aa, Artificial Sequence; identical to SEQ ID NO: 18507
  Synthetic sequence.

SEQ ID NO: 18509 - protein, 182 aa, Artificial Sequence
  Synthetic sequence.
SRVEDVVRRLKELNDENSEDSRRVLEKLKDEVRKNSDEIEKAAEELKEKLTRLKRLIEGGVDEETVRRVLEEIRKDLEDLLRRSKESVERIKRELEKSLKRSEESLRKSDEDLKRLLDESRDVKEVKELVKRVRETSKKSLKEDEDMVREVKKKLDDSLRRVDELVRRVEEEARRVLEEVKK

SEQ ID NO: 18510 - protein, 182 aa, Artificial Sequence; identical to SEQ ID NO: 18509
  Synthetic sequence.

SEQ ID NO: 18511 - protein, 182 aa, Artificial Sequence
  Synthetic sequence.
DEVERVVKELRDKVDRNSREIEKAVTELRKIVKRNSDESKEVIERLEELLRRLEELIKSGVDEKTVREVLEEIDRRLKESERRSEESKDEIRRLLKRLLERSKESLDEIEKELKRLIERSKTSSRVKTLVDEVRKRAEDSLDTVKKLVDRVRERLDESLRDDKRLVDRVREEAERVVREVEK

SEQ ID NO: 18512 - protein, 182 aa, Artificial Sequence; identical to SEQ ID NO: 18511
  Synthetic sequence.

SEQ ID NO: 18513 - protein, 182 aa, Artificial Sequence
  Synthetic sequence.
SDVEKIFDELRKLLEDLRRKVEEVFRRLKELVERNTRLNREVVKELKKTSDDLRDMVRRTKDKDTLDDLLKKVKKEHEDLVKRLEDLNDRSEKEIRRILKELRDTLRTITRRIEDLVRKAEKDEKVRKLVKEIRERIEKVLRDAEELLKEIEERVKESKKEAKKLLDEVRESVDDVKRKAEK

SEQ ID NO: 18514 - protein, 182 aa, Artificial Sequence; identical to SEQ ID NO: 18513
  Synthetic sequence.

SEQ ID NO: 18515 - protein, 182 aa, Artificial Sequence
  Synthetic sequence.
SDVEEIVRKLDKLVEDNTRENEEAFKRLDETSKKLEEEVERVFRELKKLVDDLEKIIRDIEDKDTLRKIVKEILKEIEEIARELEKRLEDVLREHKKLLDDIRRRNERSKREIERLVREMEKDEKVRKLVREVEKKVDESTERAERLLKRVEDSVRDVLRRAKELLDEIRKRVKDVERKAEK

SEQ ID NO: 18516 - protein, 182 aa, Artificial Sequence; identical to SEQ ID NO: 18515
  Synthetic sequence.

SEQ ID NO: 18517 - protein, 179 aa, Artificial Sequence
  Synthetic sequence.
DEAREIRRRLKEVVDEVRKRLEDSLEEIDRRAKEVLEKVKRSLDRLRKVAEEVLDKLRRKGVDEKKIRELKKKVEDLEDKNRRVLREVEEIAKKNKEDHKRVLKELEKEVKDLEDELRELKELDERVKRRVDEVVRKLREIVRKLTEENKRTVEDLERIVERLDRDNRKMVEDMEREVK

SEQ ID NO: 18518 - protein, 179 aa, Artificial Sequence; identical to SEQ ID NO: 18517
  Synthetic sequence.

SEQ ID NO: 18519 - protein, 181 aa, Artificial Sequence
  Synthetic sequence.
REVEELKKRLEKIVEELKRIVDDHKRKVERIVEELEKLVEDHKRTVEEIVERAKRIVEKDKEKREELDKLVERVKRISDEVRKELERITKRVREESKKVLKRLEEIVKEVRDELDKVKRERDDERLEEVAREIEEALKKVKRDLKESNRELEEVADRVRKELDRSDEDLERRMREVREELK

SEQ ID NO: 18520 - protein, 181 aa, Artificial Sequence; identical to SEQ ID NO: 18519
  Synthetic sequence.

SEQ ID NO: 18521 - protein, 182 aa, Artificial Sequence
  Synthetic sequence.
SVLETLAERVKEVKDNLRKLVEDLKRLVDRIKETLDKLVEELRELVERLDDRLRKNDKSEEMLERLAEEAERRAKEIEDRLEKHVDESRKRAEELLRRLEDHVRKSKRELERIREEVNSTRDLLKRLEEIMRRLEKEHKDVSKLLRDIEREIDRVHREVKRKIEEIVRKVRKSLEEVKRRAK

SEQ ID NO: 18522 - protein, 182 aa, Artificial Sequence; identical to SEQ ID NO: 18521
  Synthetic sequence.

SEQ ID NO: 18523 - protein, 172 aa, Artificial Sequence
  Synthetic sequence.
SRAETVLKEVTDKIKKLKDSSDELLRRNKENIDELKKSSEELLRRLTKAIEEIEKANVDEKTLEELIRRVEEELERHHRELEKNSREDEKRNRDHHRKLEEEMRRVEERLEREGIDDEVVKRVRDLLDTVRRRNEKVNEDVKRMNDKLRRDNEDVIRRVEKLLRELEEKRRT

SEQ ID NO: 18524 - protein, 172 aa, Artificial Sequence; identical to SEQ ID NO: 18523
  Synthetic sequence.

SEQ ID NO: 18525 - protein, 182 aa, Artificial Sequence
  Synthetic sequence.
DLEEVVKEARRLLDTVRKKLDESIKEARELLREIEERFKKSADEVREELKRVEDELRRKRVPEEVERRLDELRKRLEELTRRLKKELDDLKEELERRNERTKRELKRLIDELERRLRRVTRDKDDDVRELRKEVEDIIRRLDELVKKNTEDNRRVIKELRELVEEHTRRVKKIIEDLEREVR

SEQ ID NO: 18526 - protein, 182 aa, Artificial Sequence; identical to SEQ ID NO: 18525
  Synthetic sequence.

SEQ ID NO: 18527 - protein, 182 aa, Artificial Sequence
  Synthetic sequence.
SVEEVVEEAKELLKEVEEELKRSAEEAEKLLRDVARKMEESVERLRRLLKDVERALREKNVDEKVKKKLRDLLKELEDINRKSKRDLDELVEELRRRTEELERRLRELVRRLEEDLDRFRRDKDDDLRRLREKIEEIVRRLRELVRRHNEEVRRIIETLEELVRRNTETVEREVRRLRDEVR

SEQ ID NO: 18528 - protein, 182 aa, Artificial Sequence; identical to SEQ ID NO: 18527
  Synthetic sequence.

SEQ ID NO: 18529 - protein, 182 aa, Artificial Sequence
  Synthetic sequence.
SVEKVLEDARRLLEEVKDRLKKSIDDAEKLLRELEKRLRESADEARRLLRRVKELLERKNVDDKLRRDLDRLIKELEDRTKKLIDELRRLIEEVREENRRTKEELERLIRELEEKLRRFKRDKDDDLRELKREIEEIVKRAEDLVRENTEKNKRVVDTVEELVRRHNEEVRRVVKELEERVR

SEQ ID NO: 18530 - protein, 182 aa, Artificial Sequence; identical to SEQ ID NO: 18529
  Synthetic sequence.

SEQ ID NO: 18531 - protein, 184 aa, Artificial Sequence
  Synthetic sequence.
GLDEIIKRLREVLEKIREELRKSSEELERLLKRVDDDLERSNKELEELLERVRKKLEDSRIDRKLLEDVRREIKRVKEESKEIRDTLKTLLDRLRELSKKIEDDLKRKLEKLDEDLRTIRRKPQSEELLRELEKEIKRVDEDLKRLVEEHEELVRDVLRKLEKLVREHKEKVRERVERADDKVR

SEQ ID NO: 18532 - protein, 184 aa, Artificial Sequence; identical to SEQ ID NO: 18531
  Synthetic sequence.

SEQ ID NO: 18533 - protein, 182 aa, Artificial Sequence
  Synthetic sequence.
SLEEVLKELKKIVEDVTRRLEEMLRESKETSKEVEKELKKLDDEIREIIERAEEDLRRANKPEEELDKARRRLEKILEDNNRKNREITKRSRTENKRLEERLEEIVRRLKTELDKLRKVLEEGKVDEEILKEVAERLKKTAEEVKRELEKFIEDDRKRADEVRRENEETLKRIEDIVRELKR

SEQ ID NO: 18534 - protein, 182 aa, Artificial Sequence; identical to SEQ ID NO: 18533
  Synthetic sequence.

SEQ ID NO: 18535 - protein, 183 aa, Artificial Sequence
  Synthetic sequence.
SALEKIMKDLEKSIEDVRRKLEDILRKLRKSSEEVKRRIEDIERKVDRAAKEILRSKGTESEEVKKLDKELKDVRDTLRRIMERLEEINRRIEEELRRLLKELEEENDKVKKELKDRIDKDGDDEDVVRRLKRTVEEVHKRNEDVVREAEKLVEKLSRINEEAVRRLADIVRRLEEELRKAEK

SEQ ID NO: 18536 - protein, 183 aa, Artificial Sequence; identical to SEQ ID NO: 18535
  Synthetic sequence.

SEQ ID NO: 18537 - protein, 172 aa, Artificial Sequence
  Synthetic sequence.
REKEDVLRRIERIVREIERRLRESLKRNREIVKDLERLARRVLKESEDNLRKLKEDRKELEEVLDELRKKNKELEDDIRRLLRELEERTERWEDELRRILRELEKRLEEIERADVSREKLRKRLEEMKEELRKADERAKEIDTRTKRLVDEAVRKLEKLVEEHRRMTDEIRR

SEQ ID NO: 18538 - protein, 172 aa, Artificial Sequence; identical to SEQ ID NO: 18537
  Synthetic sequence.

SEQ ID NO: 18539 - protein, 183 aa, Artificial Sequence
  Synthetic sequence.
REDETLEKILRRIEEIVRRLVREAEDVVRRDRETIERLVRENEKAVKEIKDIVDELTRLKKDKREEELERMLKKLEEEVKRIIEESERKLEDNRRKVEEIIRRLEDVLRRLEEEIRKMIKDLPDTESVREAAERLKDILRRLEELLRKVAKDLKKSNDELERLSEESVRRLREILKRLEDALR

SEQ ID NO: 18540 - protein, 183 aa, Artificial Sequence; identical to SEQ ID NO: 18539
  Synthetic sequence.

SEQ ID NO: 18541 - protein, 181 aa, Artificial Sequence
  Synthetic sequence.
SEVEKILEDLDRSAKEAADRIKEIVDRLTELVKDLKKKNEESLEELDRLVKELADLLRRGEVDEEALKRAVETLRRILKRDKEAVDEAVRTLEKIIEDLKRELDEHTRRLEEILKRARDEVEEDKLRDIARRVREVNKRLEDLIRTVARAVRKALKDSEDLVREIAKRVEKALEDVRRAAK

SEQ ID NO: 18542 - protein, 181 aa, Artificial Sequence; identical to SEQ ID NO: 18541
  Synthetic sequence.

SEQ ID NO: 18543 - protein, 175 aa, Artificial Sequence
  Synthetic sequence.
REVEEVIRKLERILEEAERMSRESERKLREILEKLERAIREIREELERIHKELEEKAGRDEEVREILKRNRDNIRKLEEDARRILEDLKRLIKKLTDENKRILDELRRRIDELRKANVDRDRLDKAVEELRKEIEEMLRRSDELVKRLDEKVKKVLKELREHVKRDKEKVDKDAE

SEQ ID NO: 18544 - protein, 175 aa, Artificial Sequence; identical to SEQ ID NO: 18543
  Synthetic sequence.

SEQ ID NO: 18545 - protein, 175 aa, Artificial Sequence
  Synthetic sequence.
SSRERVIKKLEESLERLERLARKIKEDLERINRDLERLARKVEEELKRIHEELERRSGDDREVREILRRNRENIRDIKRKIEEIHRENEKNIRKLVEEAKDILRRSEEKIRRLREAQIREDELDKRVKDLHRENEREIRRLEDHVRRDRERLEEALRDLEAHVKRDKDKLDKDAK

SEQ ID NO: 18546 - protein, 175 aa, Artificial Sequence; identical to SEQ ID NO: 18545
  Synthetic sequence.

SEQ ID NO: 18547 - protein, 173 aa, Artificial Sequence
  Synthetic sequence.
SEIEDVARRLEEINKKSEDMARRIKEELEKVDEESERLVREVAKRLDEVLKRVRDDGVDEKKLKELEDKVKRIKDEARRLLEESKELTRRLVEEVRRLLEDSRRAVEEIERKLKDGTAEELKKRVEDLKRKNEDLIRRLEEKVRRLKKRNRDLIEELKKLVKELKDEAKKTSD

SEQ ID NO: 18548 - protein, 173 aa, Artificial Sequence; identical to SEQ ID NO: 18547
  Synthetic sequence.

SEQ ID NO: 18549 - protein, 173 aa, Artificial Sequence
  Synthetic sequence.
SEEERIEKRLREIHERHKRMLDEIKKRLDDSLKTLEDLIRDVTRELEKVLKKAEDDGIDEKLLRELKKEVEEIKRRAEKLLDESRRKVEELARRAKEINERLKKMIEDLRRELKDGTAEDLDREVKRLEREIERSIKELEELVRKLHKENEELIRELEELVERLKRKIDETSR

SEQ ID NO: 18550 - protein, 173 aa, Artificial Sequence; identical to SEQ ID NO: 18549
  Synthetic sequence.

SEQ ID NO: 18551 - protein, 182 aa, Artificial Sequence
  Synthetic sequence.
SEVEDAERVVRELEREVREEVKKLRKHVKETRDRDKDTVRRVEEKVKRLREKVKRVEDARRPKEELRRVLEELKKEIDKLTKELEEIEERNRRNIEDVERKLKKILRDIEEKIKELVRKIGSEDRAVREVLKELERVLRDAKRELDRVREEHERSHKELRDMLDRVKKELEKILEKLERALR

SEQ ID NO: 18552 - protein, 182 aa, Artificial Sequence; identical to SEQ ID NO: 18551
  Synthetic sequence.

SEQ ID NO: 18553 - protein, 171 aa, Artificial Sequence
  Synthetic sequence.
EDKERVEEKIKRSLEEARREAERVRDKLRKSEEEIDRVMKRVLAEIDRVLKEVKEAGVSEDVDRRLEELLRTLERKVRELRKDSDEVRKTLEDLVRRNEEDNRRILEELRREDRDSKELEDIVRRLEERNRRTVEEVERLVDEHNKRLREAAKELKKLVDDLERKLREDTR

SEQ ID NO: 18554 - protein, 171 aa, Artificial Sequence; identical to SEQ ID NO: 18553
  Synthetic sequence.

SEQ ID NO: 18555 - protein, 175 aa, Artificial Sequence
  Synthetic sequence.
SEIEEVKKKLEKILRDHNRVVEEVAKEHEKILRDHNRVIREVKEELDRVLKKLRDDGVDEKLVREMEERLRELAERVKKKNKELEDNIRRVRREAEEINKELEKKIRDIEEKARRRRDDAEKLERLVKRIKEEVEESVKRLKDHAKENREDVKRSVEELRDVVRRLEERIKESAD

SEQ ID NO: 18556 - protein, 175 aa, Artificial Sequence; identical to SEQ ID NO: 18555
  Synthetic sequence.

SEQ ID NO: 18557 - protein, 175 aa, Artificial Sequence
  Synthetic sequence.
SEIEEVARRLDEILERHNDVLRKVKEKHEEILRRHRKRVREVEEELKKILKELREKGLDEKDVRKTEKEVREIKKKAKEDHERLKRNIERMERELEKRNEDLRREVEKIKREARDDREDAKDLKRKVDELRRKAEESMKEVERHVRENAEHVKRSVEELEEDVRRLRKKLEEKER

SEQ ID NO: 18558 - protein, 175 aa, Artificial Sequence; identical to SEQ ID NO: 18557
  Synthetic sequence.

SEQ ID NO: 18559 - protein, 175 aa, Artificial Sequence
  Synthetic sequence.
DEKEKVKEDLDRILEEHRREVEDVERKHRKILKDHEEVVRRVREEHEKILKRLKDNGVDRRLLEELRRNIERLEKEARDDHRRLKENIERMRREIEKDHEDLKREVDKIARRAREDTDDAKKLEDLVRRLKEHVDRSRERLEKHLRENKRHVEESAKRLEKHVRDNEEDVKRKST

SEQ ID NO: 18560 - protein, 175 aa, Artificial Sequence; identical to SEQ ID NO: 18559
  Synthetic sequence.

SEQ ID NO: 18561 - protein, 177 aa, Artificial Sequence
  Synthetic sequence.
KEEEDLEREVKRLEDKVREDAKKLEEVVKTVEKLVRDDARRNEEVVKEVADRVRRLTERKLDEETLRKVKEDLKRTLERLKRENEKSLEELRDILRRLKKENDDTLKELRDELKRLTDSGASEDVIRKMEEIIKRLEEVSREVEKRLRRIIRELERVSKEVLDRLREIIEKLDRDAT

SEQ ID NO: 18562 - protein, 177 aa, Artificial Sequence; identical to SEQ ID NO: 18561
  Synthetic sequence.

SEQ ID NO: 18563 - protein, 171 aa, Artificial Sequence
  Synthetic sequence.
SVEDDVRRKLKEIEDEHRKVVKDARDELEKSHRRLRKVIEDVKRKLDRVLEELERSGVDEKIIRKAKELVERLTKKAEDVLREHKEKLDRIEKKAEDSHRRLREDLERLDRAKIDEKDLEEVIRRIRKKVEDSKRDLERLLEKSKRDVEEVMKDLKRRIEELEKLVRDETT

SEQ ID NO: 18564 - protein, 171 aa, Artificial Sequence; identical to SEQ ID NO: 18563
  Synthetic sequence.

SEQ ID NO: 18565 - protein, 185 aa, Artificial Sequence
  Synthetic sequence.
SLKDELEKLLKELKEHVDRSEKKARENLKRLEEHVRKSKEELEDRLRRIEEKVKRLTESNLRKEDVKRVLEEVRKELKRILDDVRADHRRLEEHLKRSVKELEDDNEKLERDARRIEEKLRRSNVPEEMVERAIRKLEDIHRRHREVVERVEREHRRIKEEHEKVVREAEETLKRIIEDLRRSAD

SEQ ID NO: 18566 - protein, 185 aa, Artificial Sequence; identical to SEQ ID NO: 18565
  Synthetic sequence.

SEQ ID NO: 18567 - protein, 185 aa, Artificial Sequence
  Synthetic sequence.
KLEEEARELLRRLEEHVRKSKKEAEDNLRRLEKHVEDSKRRLKELLDRLRKTVEDLKRANLDKKDVKRVLDKLRRDLEKILEELRRDNERLERHLRKSTKRLEDDNKDLRDKLEEIKDRLRRSNVEEDVVRRAADALRRVHEAHKRMVEEVKRRHDEIHKRHEKVVRDAERALREVLKRLEEAAR

SEQ ID NO: 18568 - protein, 185 aa, Artificial Sequence; identical to SEQ ID NO: 18567
  Synthetic sequence.

SEQ ID NO: 18569 - protein, 179 aa, Artificial Sequence
  Synthetic sequence.
SLRETADKRLRDVNRDLKRVIEELRERLKESNKKLEDLIRELRERAERILDDLRRSGVDESILRELEERIRRIEEELERIHREHEREVREVKKDLDRIHEEHKRRLDEARRELEEGRRPEEDLARRLEEIVKESKEIVDRARRRLEEIVERSEDRVRRVEERIKELVKRLEDIVRREKT

SEQ ID NO: 18570 - protein, 179 aa, Artificial Sequence; identical to SEQ ID NO: 18569
  Synthetic sequence.

SEQ ID NO: 18571 - protein, 182 aa, Artificial Sequence
  Synthetic sequence.
KEIEEVLRRLEELIRRVREELRKNNEDIEREADKLRKELKRVNDELEKKIKDVKDRARRDGAREEDIDRIRKDLKKSKEDLERLIKEALDRLKKNLDDLKKRVEEVEKRLEDLIRDVERKGLPKEVLDELRRVVEEVTREIREVLETSRELVRRIVETVKEVLRSHDEKIKKVEEELDRDRQ

SEQ ID NO: 18572 - protein, 182 aa, Artificial Sequence; identical to SEQ ID NO: 18571
  Synthetic sequence.

SEQ ID NO: 18573 - protein, 175 aa, Artificial Sequence
  Synthetic sequence.
DVDEKVRELLRKIEEDLRRSVKELRELAKRIEEDLRRISKKSKDLLKKIKDDVKRAGLPEDILRRLDELAKRLEKKNEDIRRDLERVAREIDKENEDMRKKLKEDVDRLEDLLRRGEVKEEDLKRVIEELKKEVEELHRRNEKIIRELEDKVRRVREDNERVIEELARDVERAER

SEQ ID NO: 18574 - protein, 175 aa, Artificial Sequence; identical to SEQ ID NO: 18573
  Synthetic sequence.

SEQ ID NO: 18575 - protein, 185 aa, Artificial Sequence
  Synthetic sequence.
SLREEAEKIIRDLEDHVRRDEERVKEMVDRSRKLVKELEKRLRDLIREITRRVDKLRKDNIDEDKLRKIIEDLVRDLKRILDELEKLIRELDKRNKKILEDNERNIRELEERAKRILDKLREDGVDEKVLRKAEELLKRIIAELKKIHEELRRLSKESKERLERILDEARKMLEEVKKRLEDIEK

SEQ ID NO: 18576 - protein, 185 aa, Artificial Sequence; identical to SEQ ID NO: 18575
  Synthetic sequence.

SEQ ID NO: 18577 - protein, 185 aa, Artificial Sequence
  Synthetic sequence.
SLEEKLEKLLKELRDHVRRDKKEVREALERLKDHVRKDREKLERAIAEIKKAVEKLKRDNIDEERLTRIVKELSDRLREIHRDNRENIKRLEDELRRILKKNKENIEDLARKARELLKRLEEDGVDEKVLRKLEKAAREVAEAVKKVHEELKRALEEIRRELEDINRKLKEAADEVRKKLRDIAE

SEQ ID NO: 18578 - protein, 185 aa, Artificial Sequence; identical to SEQ ID NO: 18577
  Synthetic sequence.

SEQ ID NO: 18579 - protein, 185 aa, Artificial Sequence
  Synthetic sequence.
SLEEELREVIKRLRDHVRRDKERAKEAIKRAEDHVRRDEEAVEEVIKELKRLVDELRKAKLDREDLERVVRDLDRKIKEIEERNKRNIDELRKELERIHRENEKNIRDLDERLKREREKLARDGVEEDVLRRATKALEDIRRELEKINEELKRAAERIEKRLKEIHDRLKKALDDVRRELEETRR

SEQ ID NO: 18580 - protein, 185 aa, Artificial Sequence; identical to SEQ ID NO: 18579
  Synthetic sequence.

SEQ ID NO: 18581 - protein, 185 aa, Artificial Sequence
  Synthetic sequence.
SLKEKLEREIERLRKHVEDDERRLREVIRRLEEHVKRDEDRLKKELDRLREEVERLRRANIDKEELKRIVERRTEDMDRIRKENEDNIRKLDEELKKIHEDNRKNIERLKTEAEKILRELAEDGVEEEVLKEAEDLLRDVTRALEEVNRRARKLLKEIKEKLDEIHKRLNKMLEEVKRRLDEIRR

SEQ ID NO: 18582 - protein, 185 aa, Artificial Sequence; identical to SEQ ID NO: 18581
  Synthetic sequence.

SEQ ID NO: 18583 - protein, 178 aa, Artificial Sequence
  Synthetic sequence.
SRAEEMIKDVRRIVEEVRRENKRVLEEIEEIIKRSKEEWEKILKELRDIIEEVERRNLDDERLREILERLEKKLKDVDDRAKEINEELKDLLRRVHERNREILRRLEEKVKEVKREGIDEELLRRIKEVVDRARDTLRRLDEELKRIVEAVHDTDDKVKKELEKIVREVEEIARRRSK

SEQ ID NO: 18584 - protein, 178 aa, Artificial Sequence; identical to SEQ ID NO: 18583
  Synthetic sequence.

SEQ ID NO: 18585 - protein, 179 aa, Artificial Sequence
  Synthetic sequence.
SEAERVVRENEENLERIKREVERDLRRNEEVLEDLRRKVKKVLDEIRETLRRLREAKLDSEELRKVLEKLKREIEEIRRRLKKTLDDLRKANEKSEREIRENLKENRKRNEDIIEKLKEVEEAVRKLDDLDRRLEEIVRRASEALKRSLEEIERILRKAEEDLRRLLKRLEEIIREVER

SEQ ID NO: 18586 - protein, 179 aa, Artificial Sequence; identical to SEQ ID NO: 18585
  Synthetic sequence.

SEQ ID NO: 18587 - protein, 179 aa, Artificial Sequence
  Synthetic sequence.
SVEDTLREMLKRLEEIVRRAEETLKRLNEEIERVVREAARRLDKLNKELRDIVRDIKRRKPDKEKLVRELEKILKEHNDELKKIKDDLRRILKKSREDTEKILRELEDILRRLEKEIRDNDKRKDDLKRRLEEILKELKRIVDEAEERHREIIKRLRDIVREATEKSREVLKRLEDKAK

SEQ ID NO: 18588 - protein, 179 aa, Artificial Sequence; identical to SEQ ID NO: 18587
  Synthetic sequence.

SEQ ID NO: 18589 - protein, 185 aa, Artificial Sequence
  Synthetic sequence.
KVREKLERALRRSTTSSRDIERRLKELLDTNREIVDRIVKRLKEMLDRLREEIRRIEERRKEAEDRIRELREKLRDLERKVRRVVREMEERTRELEKRLEDILRRNDEENKRVEERLREIEKRPQDDELVKRLEDDLRRWEKESKEIVDRVKEEIDRVNRESKETLKELEKEAKRVLDELERDER

SEQ ID NO: 18590 - protein, 185 aa, Artificial Sequence; identical to SEQ ID NO: 18589
  Synthetic sequence.

SEQ ID NO: 18591 - protein, 185 aa, Artificial Sequence
  Synthetic sequence.
DVERTLDEMLKRSEDVTDEVREELKRALESNNKLIKEIVDTADKVLKDIEDTVRKIIEKKREDKDLVDDLRRLIEEVRRIVEKIKRDLKKLNDELEDRIRKIEEDLKRKNDEVRKMVETIKKKPESEKLVKEVEDRARKWLKDLRDKIERLREELEKVNRDTERILEKVERDLRRLLEEVRKRDR

SEQ ID NO: 18592 - protein, 185 aa, Artificial Sequence; identical to SEQ ID NO: 18591
  Synthetic sequence.

SEQ ID NO: 18593 - protein, 178 aa, Artificial Sequence
  Synthetic sequence.
DEVEKVLREIEEIIKELKKEVDKDLEELKRTIERLKKKADEVVKRNEEVIRTLREGNIDEEKLKEILKRLHDENKEILDRIRELLKKLSRDNEKKLDEIREMLERLERRARKILARTKIKEAADKLRELLKRLEEVVRRWKEAIEDINRKLEKVVRDIERLLRDLDRKAREVLERLRK

SEQ ID NO: 18594 - protein, 178 aa, Artificial Sequence; identical to SEQ ID NO: 18593
  Synthetic sequence.

SEQ ID NO: 18595 - protein, 178 aa, Artificial Sequence
  Synthetic sequence.
SSVEKVLRELDDLIRRNRDLVEEDRKELKRTSDENRERVERIVRKNEKAIRDLRRNNIDEKDLRKKLEELHRENKKFVERNAESSKKLSDDNKELVDRSREKLKRLADKIRDILRKERIKKAADDLKRVLDKLRKSHREWNELIKKANKENTEILREAEERLRELDRRLRKVLEDLRR

SEQ ID NO: 18596 - protein, 178 aa, Artificial Sequence; identical to SEQ ID NO: 18595
  Synthetic sequence.

SEQ ID NO: 18597 - protein, 180 aa, Artificial Sequence
  Synthetic sequence.
SEVERVLKELKELLDRLRELVEEILRRLEKIIKETKREIEESLRTLEEIIRRLEELAERVDEKKLREILKKLEDHIRRSREKLERSNKKLRELLERAEREMKKLIDTARRIVDEVRKQDLREDADRALRKVLEDIKEIVKKAKEDLERVYKKHKKLVDEVKKAHEDVLKKAREVLEEIRR

SEQ ID NO: 18598 - protein, 180 aa, Artificial Sequence; identical to SEQ ID NO: 18597
  Synthetic sequence.

SEQ ID NO: 18599 - protein, 180 aa, Artificial Sequence
  Synthetic sequence.
DEVEDVLRKIKEIIKRTEDKVRESLKTLKEIIRRTKEEVKKILKEIKELIERVEREARRVDRRELEKILKDLKKLVDDAVRKLKRSDEELERHIEESERDLERSNRELKRLIDDVKRRDARERAETKLRELYERHRKVIKEVRERHKEVHKRHRDVLEEIRRRLEKLLKDLEDVIREIER

SEQ ID NO: 18600 - protein, 180 aa, Artificial Sequence; identical to SEQ ID NO: 18599
  Synthetic sequence.

SEQ ID NO: 18601 - protein, 172 aa, Artificial Sequence
  Synthetic sequence.
DEEKDVVRRLKRNVEENTKNVERMVRELERNIRENTENAKEVITRLKKIIDELRRRELDRKLVRKILEDVRKLSEDHLRESERNLRRMEEESKRHIKESKENLEEVEREAERDVRDQEDVKRVRKLARESLERVRRLHREVLEKLKKSHDDVKRLHEEIDERAKRVVEEREK

SEQ ID NO: 18602 - protein, 172 aa, Artificial Sequence; identical to SEQ ID NO: 18601
  Synthetic sequence.

SEQ ID NO: 18603 - protein, 176 aa, Artificial Sequence
  Synthetic sequence.
DAEELLKEIERELKRSIEEARRLLEEVEKRLRKSKRDVEKLLKEVREKLEKVVREIPKDDRLEKVKEDLERILDTLRRRTEELERRVRELIERLERRNEETERRLKKLVDDVKDVKDRDVVRRLVEEARKLVEENTRENRDMIEKLRRLVKRHSEEVEEIIRRLDKLIDDVRREAE

SEQ ID NO: 18604 - protein, 176 aa, Artificial Sequence; identical to SEQ ID NO: 18603
  Synthetic sequence.

SEQ ID NO: 18605 - protein, 179 aa, Artificial Sequence
  Synthetic sequence.
SLEELLREVERRLRELNKKLEDMIREVEERLRKVIRETEKLIEDVKRELEKILEKARERVDEDTLRRLRKELEDAIRKVAEDVKRLEEENEKSVRELRKKLREIHERNRDTVRKLAELLETIDEKELEKEVRDDLRRTDEDIRRLLDEARKDVERHKEELKKLLEDAKRLLERVERTIR

SEQ ID NO: 18606 - protein, 179 aa, Artificial Sequence; identical to SEQ ID NO: 18605
  Synthetic sequence.

SEQ ID NO: 18607 - protein, 173 aa, Artificial Sequence
  Synthetic sequence.
RELEEVVKKVREEVKEHTEKVKRLVEEAEELNRRYEEEVKKLVTTAKRLNDEARKRNSKDETVVRELKRLNEELNRRSRKLVEELKKLNEELARKAEESKEELKRRLEDLARRMIDSKELLDEVAKLVEESLRRLDRLLEEIKRTSDELIEKNERLNRELNKTSDKVVEDMRR

SEQ ID NO: 18608 - protein, 173 aa, Artificial Sequence; identical to SEQ ID NO: 18607
  Synthetic sequence.

SEQ ID NO: 18609 - protein, 184 aa, Artificial Sequence
  Synthetic sequence.
SLEDLIREVEDRNRKSVEEVERLLEEVRRKLDESRKRLEELLKRVEEKLERVIEEAKRRLKNVKDVEERLKEVRKTLKRLKERLEERTDEVRRRLERLIEELRKRSKEHSERLRDRVEKVRDVKDEKVVEELAREMKKSVEEHTREVRRMVAELEKLVKRHTEEVERAVREAEKLVETLREELR

SEQ ID NO: 18610 - protein, 184 aa, Artificial Sequence; identical to SEQ ID NO: 18609
  Synthetic sequence.

SEQ ID NO: 18611 - protein, 184 aa, Artificial Sequence
  Synthetic sequence.
SLEDLIREVEKRNKESVDTARRLLDEVRKKLKDSIDRSRKLLEEVRRKLEEVIKDAKRKLKTDKDVEKELKDVTDTLEKLIRKLEEENERSRKRLEDLIKRLRDESRKHSDDLRRKVEDARKVSDERVVEEIMRRLEKSVERHTEEVKRVVREAEELVKDNTRKVEELVRRAEKLVEDLERRTR

SEQ ID NO: 18612 - protein, 184 aa, Artificial Sequence; identical to SEQ ID NO: 18611
  Synthetic sequence.

SEQ ID NO: 18613 - protein, 184 aa, Artificial Sequence
  Synthetic sequence.
SLEELIREVEERLRKSVDDSRKLLEEVKRKLEDSKREVDRLIEEVKRELERVIEDVTRKLKDVKEVRRRLDEVRRELEERAERVRRENERTDRELDELIKRLEEINRETEERLRELAREIRRVKDEKVVKELADEMRKLVRTNTEIVKDVVKKLDELVERNTRTNRDVVRRARELVEELERRER

SEQ ID NO: 18614 - protein, 184 aa, Artificial Sequence; identical to SEQ ID NO: 18613
  Synthetic sequence.

SEQ ID NO: 18615 - protein, 172 aa, Artificial Sequence
  Synthetic sequence.
RELERVVEEARRLVEEHTEEIERSADKARKLNEEHSRRVDEIFERLERLIREAEKKNSKDDKVIEDLKRKLEDITEKVKKSIDEMRKLTKDINDENRESIKRLRDEIRKIEKDVRNRELLEEIRKLVEESVERVKRLNEDVNRTSKESVKRLEDLVDEIRKRVEEVVRRLKK

SEQ ID NO: 18616 - protein, 172 aa, Artificial Sequence; identical to SEQ ID NO: 18615
  Synthetic sequence.

SEQ ID NO: 18617 - protein, 172 aa, Artificial Sequence
  Synthetic sequence.
SELERVAEEAERIVREAEEKIKKSVTELKELVKRHSERVKRIFKELEELLRRLREKNSKDDRVIKRAEEELRRIEEELRRSLEELKRRLEEINKENEKLIKELRDRIRKIEEEVRNEDLLREVRKKVEEVVKKIKRLNEEVNRDVKRSAEELKRLIDDIRRILKKVIDDLKT

SEQ ID NO: 18618 - protein, 172 aa, Artificial Sequence; identical to SEQ ID NO: 18617
  Synthetic sequence.

SEQ ID NO: 18619 - protein, 172 aa, Artificial Sequence
  Synthetic sequence.
DEMEEVVKRAEEIVKEARERIEESFRRLREENKEALERLKRIAEEMRRLLKEVLERNSKDRRVIKELKDLLDEIRKRVEDEIRELRKRTETINDENRKLIETLKRILEDIKRKLRNEELLRRVEKEVRRVEEEIRRLNKEVNETSDRVEREAEKLVRELEEAVRKVVEDLER

SEQ ID NO: 18620 - protein, 172 aa, Artificial Sequence; identical to SEQ ID NO: 18619
  Synthetic sequence.

SEQ ID NO: 18621 - protein, 181 aa, Artificial Sequence
  Synthetic sequence.
DLEEVIKEARKRLEDSHRRLEKLIREVEKEHEDSHRKLRELVERVKKKHKEVEEKIKRNGVSEKDLKRIEDNIRKSEKELRDALKRHKENVDRSRKKLEDILRRHRKKLEEVERKLEEMRRKGSPVEELLKDLERMVRELNEEIERALEDAKRNVDRLDDEIRKLEERVDRNVKRLEEDIK

SEQ ID NO: 18622 - protein, 181 aa, Artificial Sequence; identical to SEQ ID NO: 18621
  Synthetic sequence.

SEQ ID NO: 18623 - protein, 181 aa, Artificial Sequence
  Synthetic sequence.
SLEDVAREAKKRLEDLKKKITDLIREARRKHKESHDRLRELVEKIKEDLKRVLKKLEDDGSSREKLERLKRKVDELARELEEVLKRHKENVDRSDEELKRVLKRIEEEIKRLEDELEEVKKDGSDVREVKEKLRRTVEALDERIDKLRKELDENVRRLDKEIEDMVRKAKKVVDELREEIR

SEQ ID NO: 18624 - protein, 181 aa, Artificial Sequence; identical to SEQ ID NO: 18623
  Synthetic sequence.

SEQ ID NO: 18625 - protein, 181 aa, Artificial Sequence
  Synthetic sequence.
DLDEVVKEVDRRLEESHERLRRLIKKVDEDHRRSHEDLKRVIDEARRLLEEVLERLRRNGKEEETLERLKRTVEKVEEELKRVLDRHEENVRRSRKELEDVLRRHKEKLDELKKKLEEVRRRGMPVEEVLKEVKKAVEKLNEDIDRLFEKARENVKRLDEDIKRLLEELRRKVKKAEDEIR

SEQ ID NO: 18626 - protein, 181 aa, Artificial Sequence; identical to SEQ ID NO: 18625
  Synthetic sequence.

SEQ ID NO: 18627 - protein, 181 aa, Artificial Sequence
  Synthetic sequence.
DLERVVEEVKKLLRDSHEEHKKVVKEVKERLDRSHKESKRVSDEVRKKLEEVLKELEDRGVSEDLLRRLEKTVRDIEDENREVNERHERKLREVERELKESNDRHEKMVRDLREELKRIRKDGKDVEKVLRDVRRVVTELNKHIEDLKRKVTEDVERLNTEIKELKKRNDEAVRRAREEIK

SEQ ID NO: 18628 - protein, 181 aa, Artificial Sequence; identical to SEQ ID NO: 18627
  Synthetic sequence.

SEQ ID NO: 18629 - protein, 174 aa, Artificial Sequence
  Synthetic sequence.
KEDEDLDRDVKRHIEETEKRVKEVEKRHKDEIRKVREDVKDVERRHKEKIDDVRRKLRDGRLSEEVIKDLERDLRRSKDEVRRRVEEARRKLKESDEEIKRTVRENEEKLRELRERGLPEEILRKLRKRTEEIKREAERIHDRTREEIEKIKRDLDEIHKRTREVIKELEERSR

SEQ ID NO: 18630 - protein, 174 aa, Artificial Sequence; identical to SEQ ID NO: 18629
  Synthetic sequence.

SEQ ID NO: 18631 - protein, 174 aa, Artificial Sequence
  Synthetic sequence.
KKEEDIEREIRDHIRRTREKLEKLAKELRDDIRRLREELKRIEDEIREESKRLEDILRKGRLSEEVIEELKERIKTIERDVERLIKESEDELRRLKREIEETLRENEKKIKELAEEGLPEDILRRLREETEELRKEAERLLREYKRLTEELARELRELVKKLEEEVRDLERRSR

SEQ ID NO: 18632 - protein, 174 aa, Artificial Sequence; identical to SEQ ID NO: 18631
  Synthetic sequence.

SEQ ID NO: 18633 - protein, 174 aa, Artificial Sequence
  Synthetic sequence.
SEEERIEEDIRRHIKRTRDRLDELRRRLEEDIKRLRERVEDLKRDLERNIRELRDRLRRGRLSEKVVRDSREKLERLREEMEREVKESRDRLREVKEEIEDLIRRNKEKLDRLRERGLPEEILRRMERLTRELAKDADRLLKKYRKLTEDLKRELEKILKTYRDLTEELKERSR

SEQ ID NO: 18634 - protein, 174 aa, Artificial Sequence; identical to SEQ ID NO: 18633
  Synthetic sequence.

SEQ ID NO: 18635 - protein, 182 aa, Artificial Sequence
  Synthetic sequence.
SELDELRKRIEEAAKELKKRLEDHKRRLEEAEERFERDLERIHRRSREVVRDLKERPLEEEEIKKRVKEVREEYDRVREELKRKIEELRRRNDKTRRELEEDVRRLEEELRDAKRKVNSEDRILREVEDIVRKLKEILKEVRDRLRELSKRLEDRLKEVEDKLDKDVKDVEEELRRILEERK

SEQ ID NO: 18636 - protein, 182 aa, Artificial Sequence; identical to SEQ ID NO: 18635
  Synthetic sequence.

SEQ ID NO: 18637 - protein, 182 aa, Artificial Sequence
  Synthetic sequence.
SRLEKAEEDIKRYIEEHKRRSEETLKELTDKAREITRRLDESLKTVEDTSREIKKDVEDRGNDKDTMEKVKEDYKRLVRRLEELIEEMIREADKSVKDLERETEESKRKIEEEAEKLREESDDEDLRRVIKRIRELLERLEREDRRIIEEIKKLLDRLKKKVEDIIERIERSLKRLEEELRR

SEQ ID NO: 18638 - protein, 182 aa, Artificial Sequence; identical to SEQ ID NO: 18637
  Synthetic sequence.

SEQ ID NO: 18639 - protein, 178 aa, Artificial Sequence
  Synthetic sequence.
SEEELLRKLEEISRRVTRALEKLLEDHERLSREVAERLEDLLRRHKKLLEELIKLAEERVSDKDKVRELKERLRKNLDDLREHVRRDKERNEKNIEDLERHIRRDKKENEEALDDVRKTKQPEEELDERIRRLKDKNKKNLDDLREHSKEVLERNKENLDELRKHSKKVLDEARKELK

SEQ ID NO: 18640 - protein, 178 aa, Artificial Sequence; identical to SEQ ID NO: 18639
  Synthetic sequence.

SEQ ID NO: 18641 - protein, 174 aa, Artificial Sequence
  Synthetic sequence.
DEKERAKEEVKKLRDDAEKTDRDLEKEVEDTARELKETLERLRREVERLEEELERISRRGNKDDETLKRIKEKLEKLKKKAKDDNDRLEERIRRKREELKKHLDDLRKTLDELRRRVRDKDLTEELKRVLDDHERTLRKIEEDLRRILEEHKKETKKITEELERILEKMRKDEE

SEQ ID NO: 18642 - protein, 174 aa, Artificial Sequence; identical to SEQ ID NO: 18641
  Synthetic sequence.

SEQ ID NO: 18643 - protein, 171 aa, Artificial Sequence
  Synthetic sequence.
STKEELLERAKEIIKRLEELLRRNNRTLREILKDLKKRLEESNREIKRLIDEVTRNGLDRKLVEKLREALEKHDEDVKRLLEELERIIRTHEKKAEELLKRLKDEIEKLAREERDDEDLRRELERLKEEVDRAHKESEEIVKKLEKRIRDAIRRSKKRVDELEKELREAEK

SEQ ID NO: 18644 - protein, 171 aa, Artificial Sequence; identical to SEQ ID NO: 18643
  Synthetic sequence.

SEQ ID NO: 18645 - protein, 173 aa, Artificial Sequence
  Synthetic sequence.
SEKEEVDETLRRLEEEHERVVRDAKRRLEEDHEKLRRVIRDSDRINDEINKKAEEDRLEEELLKRLRDKSKKLREDLEDLLRRHKEKLDRIDEELKEDHKRLKEEAKRLRERLDELDAEELKRILDETRERIRESMEEIKRKLEESRRESEDIRRKLKEDNDRLKKELDDRAK

SEQ ID NO: 18646 - protein, 173 aa, Artificial Sequence; identical to SEQ ID NO: 18645
  Synthetic sequence.

SEQ ID NO: 18647 - protein, 182 aa, Artificial Sequence
  Synthetic sequence.
SSEEEIRETVKRLKEIVKKHKKDVDEIAEELRRIVEELRRRNEEEIKKIRKILRELEEKRSGDRRKIKELVDRMKKRLDDHKKTLEEIKRKAKEELEKSKKRTDEIVEELRRRLRELEKKGVDEKLVRELERIVEEIKEELEKSDRELEKIIREIAKRLEEIHEETERAVREVKKRLDEVAK

SEQ ID NO: 18648 - protein, 182 aa, Artificial Sequence; identical to SEQ ID NO: 18647
  Synthetic sequence.

SEQ ID NO: 18649 - protein, 175 aa, Artificial Sequence
  Synthetic sequence.
SEEEKLLERLERTVERLEREARRLLEKSKEKLKRLEDSSRELLDKLRKEVERLRREERDREELKTELERLKREIEKYVEEMKEELKKHKKESRDFVERLKKELEELKEEIERSNVPEDFLRELEKLLEEIKRKIEEARERLERSNKELEDVIRDSERRLRKLLKEIEEVIRRKAT

SEQ ID NO: 18650 - protein, 175 aa, Artificial Sequence; identical to SEQ ID NO: 18649
  Synthetic sequence.

SEQ ID NO: 18651 - protein, 175 aa, Artificial Sequence
  Synthetic sequence.
SEIERLLERLKKALEEIKRSSERLIRKLEEVLRDLEREVRKLLEDSRRTLERIRKEDKSDEELKRELDEHKDRTRKAERRLEEKLKTLAEEIKEYTRRLEEDLKRLREEIRRANVPRDAVEELERLLKEIEKTIEESRRRLEELLERIERLIRKVIEELRRSNEELERVIREKSK

SEQ ID NO: 18652 - protein, 175 aa, Artificial Sequence; identical to SEQ ID NO: 18651
  Synthetic sequence.

SEQ ID NO: 18653 - protein, 183 aa, Artificial Sequence
  Synthetic sequence.
KVEKRLRELVERIRESHERVLREVERLVEEHRETLKRILDRIREILKRIEEDIESIRRRVDERKEKKLRERLKRLEDELRKIEKRIRDSLEEVRKKLEELVRKLRKNLEEIKRRLEELKRTKLDEEVVREELERLERNIKESRDDIRRALKELKDTNEKAKEELERKLEELDRDLKRLREEAR

SEQ ID NO: 18654 - protein, 183 aa, Artificial Sequence; identical to SEQ ID NO: 18653
  Synthetic sequence.

SEQ ID NO: 18655 - protein, 179 aa, Artificial Sequence
  Synthetic sequence.
SEVEDELRKSRKEIEDLAREAERELEEIKRHIERSERKAKEDIDRIEREIEELDKLRKENSSSEKTLDDDLERLKRKIEKIKREMEKSLRELEKRIREIVEKMRRTLDRHREKLEDLRRRGIDEKALRKSHKELEDLVREVEKKLRELLERYRKRIEEVAKKLDDLLDKLREVVDRAKK

SEQ ID NO: 18656 - protein, 179 aa, Artificial Sequence; identical to SEQ ID NO: 18655
  Synthetic sequence.

SEQ ID NO: 18657 - protein, 179 aa, Artificial Sequence
  Synthetic sequence.
SEVERELKRIKDEIRELAREAREDLERIKEHIKRSKERVEEELRRSEEEIKEIERLARERRVSEKTLDDRLRDHRRKVKKIVDDLRKSIEDLRKEIEDIVRKLKEDLDRLREEIDRLRKRGISKDDLDRLLEELERVVREVKKRLRKLLEDYKELVDRVRKKLEDSHRRLKELAERTKK

SEQ ID NO: 18658 - protein, 179 aa, Artificial Sequence; identical to SEQ ID NO: 18657
  Synthetic sequence.

SEQ ID NO: 18659 - protein, 186 aa, Artificial Sequence
  Synthetic sequence.
DVERELDRIHREHEELLRDIEKKLREILREHEELLKRIKEELDEILERLRKLVEDVKREKPDIKDLMKKLDDKLREVEERLRRIKEKLEEHHKEAEKLVEEIKRKLDDHNRRLKEKLKRVKDRGKVDEEEVRDILRRLKEEIDRSRREAEEILRRLKKEIEDTKREVDETKKDLKRTLDEIREEAK

SEQ ID NO: 18660 - protein, 186 aa, Artificial Sequence; identical to SEQ ID NO: 18659
  Synthetic sequence.

SEQ ID NO: 18661 - protein, 186 aa, Artificial Sequence
  Synthetic sequence.
SEVEEEVERIDRNIDRLRKEVEDNIRRSEEEIKRIKEEVEKNLEDLRREIDRIRELVEANKQSEDDLERVLKRLKDHLEKSKRDLERKLRRHEEHVRRSAEELEKDNRKNKRRVEEILRKLKDSEDMERMKRKLKELLDKHKKLVDDAKKKHDDSNRKLERLIREATKEHKKALEDLKKLIDDSRR

SEQ ID NO: 18662 - protein, 186 aa, Artificial Sequence; identical to SEQ ID NO: 18661
  Synthetic sequence.

SEQ ID NO: 18663 - protein, 183 aa, Artificial Sequence
  Synthetic sequence.
KDTEEAEERWKAKDKKLEDDVRENLKRLREEITRLEKEVKDNVRRIKELIDKLRRDVEREGTDDETLKEVEKRLRDNIEESRKRLEEMLKKIEDNIRKSKKKLDDYKRELEKELREMERRVKDLEEAKDSLRKLKKHSDDTVRRVKEEHERVLKEAKELLDKVEKEHRRLLEELERLLREARK

SEQ ID NO: 18664 - protein, 183 aa, Artificial Sequence; identical to SEQ ID NO: 18663
  Synthetic sequence.

SEQ ID NO: 18665 - protein, 183 aa, Artificial Sequence
  Synthetic sequence.
SEEDKERKKWERRDEELRKRVERNEREWERADKELEEEVKREVERIRREIEELRRRVEKDGTDDKELRDLLRRLEEELRKLDERLKEYLRRLEENLKRSDEELKEYLRDLEEKLRRIEEKVKDLDEARKELERLLEHSRKLLEDVRRSHEELVKHSKERADRIRETLKKLLDDLRKLLEDARK

SEQ ID NO: 18666 - protein, 183 aa, Artificial Sequence; identical to SEQ ID NO: 18665
  Synthetic sequence.

SEQ ID NO: 18667 - protein, 183 aa, Artificial Sequence
  Synthetic sequence.
SDIERRKEEWKREDEKLEKRSRKNVEDWERRDEELKRRSEENVRRIKEMIERLEDRVRRDGKDEDELRRVEEELRKNLEENDKRLKEYLDRLRKNLEKNRRDLEEYLKRLEEELREAEERVKDLEEARKELEKLLRNSKRLVDESERRLRELERHSRELLKRSRRELERLMKELEDLAREIRR

SEQ ID NO: 18668 - protein, 183 aa, Artificial Sequence; identical to SEQ ID NO: 18667
  Synthetic sequence.

SEQ ID NO: 18669 - protein, 183 aa, Artificial Sequence
  Synthetic sequence.
RESEKIKEDMDRSNEKHNKEVEETLKRLEEELKRLEDEVRDAKRELDELLERLERRARDGDRSEELLDRDLKDVLKKLEEKVRKIEEDLKKFKDDLRKIIEKLVTDSKRHHDELKKEIDRRTRTKELEDLARDVAKKNKESVDRVKKELKRVDEEVKRLLDEVKKDLDKVREDLKRVIDEIRR

SEQ ID NO: 18670 - protein, 183 aa, Artificial Sequence; identical to SEQ ID NO: 18669
  Synthetic sequence.

SEQ ID NO: 18671 - protein, 177 aa, Artificial Sequence
  Synthetic sequence.
SEVEKVITEVEELVREYRKRLEDKRREAKKRVDEYEERLKRMEDEVRKLLEEIERRIRKDGGASEKTEDEIRRLLEELKRRVEKLIEETKRLNEEIDDESRREMEELRERLEEIADKSISSKDALRRAEEKLKKLIKENKEINDEINERSKELNERSKEVLKKIEEDLRRLIEEVRR

SEQ ID NO: 18672 - protein, 177 aa, Artificial Sequence; identical to SEQ ID NO: 18671
  Synthetic sequence.

SEQ ID NO: 18673 - protein, 178 aa, Artificial Sequence
  Synthetic sequence.
SREDLVREVRERLKKLLKHSAELIKRVKEELEELLRHSEENVREVKKRLDEIKEEAKKRGKSEDALKKLDEKLRKVTRKSKEYLDDLRRRVEEVERKLKEYLDRLREEVKKVEERLEKSRRPIEDERRAVEETEERWRRKDDTVRKEVEEEKEKWRREDEKHHRDVERALRKLKRDIE

SEQ ID NO: 18674 - protein, 178 aa, Artificial Sequence; identical to SEQ ID NO: 18673
  Synthetic sequence.

SEQ ID NO: 18675 - protein, 178 aa, Artificial Sequence
  Synthetic sequence.
DEDELVREAKDRLDKLLEHSRKNVEEAEKRLRDLLEHSKKNVEEAERLLEEIEEEARRSGKSKEVLDRLRKKARDLKEESKDYLRKLEEEVRRIVRKSEEYLKRLKDRVDEVKERLDKGRRPLEEVRKEVKKEIDDWRARDEEHHRDVKRREEEWERKDEEHHRKVEEVIERLKRELK

SEQ ID NO: 18676 - protein, 178 aa, Artificial Sequence; identical to SEQ ID NO: 18675
  Synthetic sequence.

SEQ ID NO: 18677 - protein, 177 aa, Artificial Sequence
  Synthetic sequence.
SVEELIKEVEERLKRLKEHSEDLAREVRERHKKLIEELRRILEEVKKRHKDLTEKLEKDGGSEELLDRIRRNVEKSKRELERVLREAEKNLERSDEELKEYLDRLRKRLERVREELKREPADEEMKKRVEEEEKKWKRDDERLEKRVRENIERLRRLLERLRKRVEDNIKRLDDERR

SEQ ID NO: 18678 - protein, 177 aa, Artificial Sequence; identical to SEQ ID NO: 18677
  Synthetic sequence.

SEQ ID NO: 18679 - protein, 177 aa, Artificial Sequence
  Synthetic sequence.
REEDLIREVERILEELLKHSKRLIDEARDSHRRLLEHSKRLVEEVERLHKELLDRARENGGSEELLTRIKKNIDESRKELKEYEDDLRRNLRESDERLRRYLDDLRREKKEVEDELRRRKADDRMREEVRKTEERWRDKDRELEKRVRDNERRWEDRDRKLEKRVRDNIKRLRDELE

SEQ ID NO: 18680 - protein, 177 aa, Artificial Sequence; identical to SEQ ID NO: 18679
  Synthetic sequence.

SEQ ID NO: 18681 - protein, 177 aa, Artificial Sequence
  Synthetic sequence.
KAEELVEKVRRDLEALLEHSKTLAEKVRRDHRKLKEELKELLERVKRRLEELKKRLEDSGGDEKKLRELERRLKEVEKELRKVLEDIDRNLRRSDEELKKYLEDLRERLKRVEDELRREPADDELRKKVDEDRRRWEEDDRRLEKRVRENLRRLEKIIKDLEDRVRREVEKIDKDRK

SEQ ID NO: 18682 - protein, 177 aa, Artificial Sequence; identical to SEQ ID NO: 18681
  Synthetic sequence.

SEQ ID NO: 18683 - protein, 177 aa, Artificial Sequence
  Synthetic sequence.
DREKLIEEVKDRLRRLLKHSRELLKEAEDRHRELLKHSERLVRESERRLEELLRRARKSGGSEELLKRIEENVRDNKRRLDKYKEELRRNLKASKEELDRYEEELRRRLKEVEDELDKKEADDEVRKEVKKDEDDWRKADDDLRKRVEDNVRRWEERDRELKERSERNLEKLERERK

SEQ ID NO: 18684 - protein, 177 aa, Artificial Sequence; identical to SEQ ID NO: 18683
  Synthetic sequence.

SEQ ID NO: 18685 - protein, 177 aa, Artificial Sequence
  Synthetic sequence.
SREDLVRRVDKALRDLTRHSEELMRRSDETLKELLKHSRRLAKESEDRLKELLDEARERGGSEELLKRIKENVDKNKEELEKYIRDLERNLKENRERLKKYEDELREELRRVKRRLEEEEADERLEEKVRREEEEWKKKDEELKKRSEKNVDEWRKRDDKLRRDSKRNLDKLREEIR

SEQ ID NO: 18686 - protein, 177 aa, Artificial Sequence; identical to SEQ ID NO: 18685
  Synthetic sequence.

SEQ ID NO: 18687 - protein, 180 aa, Artificial Sequence
  Synthetic sequence.
SLVDEIRERVRRLDEDVRRLIEEIEKRIREIDKRAEDLIRKIEDDSRRTLEEVAKQPRDEEVLERVERIARDSLRLLEEVIEEVRRIAEKTRRDLTRVIEEVKRTVTDSIRKLEEVIERVKVEELEKVVEENERSLRELVKTLEDVLRKNDKTVKELEKRLREVLDRTRRFMEELIRRAR

SEQ ID NO: 18688 - protein, 180 aa, Artificial Sequence; identical to SEQ ID NO: 18687
  Synthetic sequence.

SEQ ID NO: 18689 - protein, 180 aa, Artificial Sequence
  Synthetic sequence.
SLKDKIREDSERTLKTVERLLREIEKEIRKLDRDIERLIEEIRRRIEKLDKDIERQPRDDEVLKRVEDIVKKTRELIERVIEEVEEILRETKELLDTVLKEVERIIRESERRLREVIERVKVEELEKVLKDTRDEAERLKEEVRRVLEDNDRTAKELRKTLEEVLKRNEESARELKKRIT

SEQ ID NO: 18690 - protein, 180 aa, Artificial Sequence; identical to SEQ ID NO: 18689
  Synthetic sequence.

SEQ ID NO: 18691 - protein, 170 aa, Artificial Sequence
  Synthetic sequence.
DEERRVEEELREVDKRLKKLLEESKRKLDEVIRRVREVVKKLKKRLDDVNRLVARDVKSEELERLLRESSEEVKEVIKKLKRLLEKVLREDEKSVDEIRREAEEVLKRVRDAGIDEKILRTVEKLVRDIERELRETNKRVREDVEKIIEDLKRILEENDKRADDWRRADK

SEQ ID NO: 18692 - protein, 170 aa, Artificial Sequence; identical to SEQ ID NO: 18691
  Synthetic sequence.

SEQ ID NO: 18693 - protein, 170 aa, Artificial Sequence
  Synthetic sequence.
DESEEVARELEKVDRDVDKLVKDSRKELEDSNREVEELLRRSTERLKEVNTLVARDVRGEELEELLERLDRENEETIRRVEELLRRSLKKNEETLERLERLAKELLERLKRAGVDEKLVREVERRVEDIKRKAEKTLDDNRKLIEEWVRRLEKSLEDNRRLAKKWKDEDK

SEQ ID NO: 18694 - protein, 170 aa, Artificial Sequence; identical to SEQ ID NO: 18693
  Synthetic sequence.

SEQ ID NO: 18695 - protein, 178 aa, Artificial Sequence
  Synthetic sequence.
SELDELKKEVDDVAREVRRHNKKLEEEVEREVRRMRRHNEENVKRVEESAKEARKDVDREELLRRLEKLVEELRKLNEESLRKVEKLAEEIADVLRRSKKAVDEVVREIARLLEEVKRRNEDLREVKKLVEEVTRRLERINKELERLIREVRKRMERVNDELHKRNRDVERKLREVVR

SEQ ID NO: 18696 - protein, 178 aa, Artificial Sequence; identical to SEQ ID NO: 18695
  Synthetic sequence.

SEQ ID NO: 18697 - protein, 171 aa, Artificial Sequence
  Synthetic sequence.
SELEALEEDVKRVVKEIKDHNEKLIRELEETIRRIDRHNDENIRRTEEEIKRVLDKKPDVKEIEEVLKLAKEVNKRSKEEVKKVAEEVKRVLDESRKRVDRIVEEAKRVLERGLPEEDLRRLLEKLKEDLRKVNEDLERLLREAKRRLERVNEKLHELSRRIREKLEEVDR

SEQ ID NO: 18698 - protein, 171 aa, Artificial Sequence; identical to SEQ ID NO: 18697
  Synthetic sequence.

SEQ ID NO: 18699 - protein, 171 aa, Artificial Sequence
  Synthetic sequence.
SELEKLVEKIKERVERARRHNERLREDVERVLTESDKENKDLIDDARRAVKEVLDRKPDVREIEKLIREIEEVLKESKRLVKEIADELRKVLDDSKRLVDEIEEKVKRVADRGLPEEELDRLIREIIKELEDVNRTLRKLLEEIKRRSKDVNRDLRRLLEEIKEKLRRKSK

SEQ ID NO: 18700 - protein, 171 aa, Artificial Sequence; identical to SEQ ID NO: 18699
  Synthetic sequence.

SEQ ID NO: 18701 - protein, 184 aa, Artificial Sequence
  Synthetic sequence.
SEIDELKKDVERRVREVEETNRRLEKEVRERLERSRKHLKELIEDARREVERVEREVKEDEVLRLLRELARELEEMLKRVEDESRRVAKELERVIKESEERIKEVVKELKDVLDEVRRLMKEDDKKKVLDELKKVIKEVEDRLRKIDEELKKVIDEVRKELEKINRDLERVIREVKKRAEEVRR

SEQ ID NO: 18702 - protein, 184 aa, Artificial Sequence; identical to SEQ ID NO: 18701
  Synthetic sequence.

SEQ ID NO: 18703 - protein, 184 aa, Artificial Sequence
  Synthetic sequence.
REIEELAKTVRKEVDDSRKHLKELREDAKRTLDEVKRETKKLEEDVRREVERVKREVKEDRVLEELEKLVEELKTVLERIKRKDEESARRLEEVLKRIKEESDRVVRELERVLRDVRRLVEEDDKEKVLRELKKVIDEVRKLLEDINRELEEAIRDVKRKNEDTLRELRKVIKEVEKRLKDVTR

SEQ ID NO: 18704 - protein, 184 aa, Artificial Sequence; identical to SEQ ID NO: 18703
  Synthetic sequence.

SEQ ID NO: 18705 - protein, 173 aa, Artificial Sequence
  Synthetic sequence.
KEVEDVVRELKKSLEENEKRVRDIERELREVVKKIAKRVEETREEVERMLEEIRRRSGEDEIVKEITEVVETVVRLDRESLEELKRVVDRIVELLKKNVEDLKRAIEEVERLLREDDIKKVVDEARKVLKEVHENTERIVDEARKLLKRMEEKNRKTEEDIRRVADEVREKAR

SEQ ID NO: 18706 - protein, 173 aa, Artificial Sequence; identical to SEQ ID NO: 18705
  Synthetic sequence.

SEQ ID NO: 18707 - protein, 173 aa, Artificial Sequence
  Synthetic sequence.
SKVDKVREEVTRSLEDNKRKVEEIEREARESLERNRKKVEDSIREARKVVEEIERKKGQDRIVEEVRRVVEENERRLRENVRELRKVLEDIRRLLKRNVDELERVVREVRDLLEKEDIDTVTRRIREVMKKVHDNTRRIAEELRRLMKRVHDNTERSHEELKRLLEEVKRKAD

SEQ ID NO: 18708 - protein, 173 aa, Artificial Sequence; identical to SEQ ID NO: 18707
  Synthetic sequence.

SEQ ID NO: 18709 - protein, 173 aa, Artificial Sequence
  Synthetic sequence.
REVEEVVKELKKSLDDNRDEVRKIIEEVTRLNKRNEEDVKRVTDEAEEVVKRIVEKKGDDEIVRKVREVVREIKERLDRVVEENKKVVDEVVKYLKENVEDLERVVRTVKELLRRDDIRKVVEEARRLLERVHRNTKRVADEIRKLDKRSSELLDKILKDLRKLLEDVEREAR

SEQ ID NO: 18710 - protein, 173 aa, Artificial Sequence; identical to SEQ ID NO: 18709
  Synthetic sequence.

SEQ ID NO: 18711 - protein, 181 aa, Artificial Sequence
  Synthetic sequence.
DEKDEVRRRVDRELEDVHRETKKSSDDDKRLLEDVHRKLKESEKEVRRIADEVRKKLEDVRRREDLERVARELLRELEEVVKENHKSVRKSLEDIERSARTNRDIVEKTLERIERVLEEIARRIKVREVLEKIKRSLDENKERVEKSKKDSDDSLRENKDRVDKTDEEAKEMIKDLKRKTD

SEQ ID NO: 18712 - protein, 181 aa, Artificial Sequence; identical to SEQ ID NO: 18711
  Synthetic sequence.

SEQ ID NO: 18713 - protein, 181 aa, Artificial Sequence
  Synthetic sequence.
DEKEKVTREVRRILEEVDKRLEESRERVERIAEEVHRRTEESHRRDEEVVERVKEELKEARRDSRLKDVVRELLRKVEKSARDNKRIVDTTLKLIERVIRENHKSVTKLLRELEDVIRRLKEEINVREVLEELKRELRRLEEDVRRTDRKLEESLKDNERKVRRSKEESDRLLRELEERTR

SEQ ID NO: 18714 - protein, 181 aa, Artificial Sequence; identical to SEQ ID NO: 18713
  Synthetic sequence.

SEQ ID NO: 18715 - protein, 181 aa, Artificial Sequence
  Synthetic sequence.
KEVEDVRRRVEKILEEVHKKTREVTERVRRILEEVHRKTEESHRRDEEVMRRVRDELEKARRREDLERVVRELTKRVEDSLRENEKIVERTLEEIEKVLDELRKIAEDTLRLIAEVLRRAKEEINVREVIEKVKESLRENERRARKVEKEIRDSLERNRERVEDSKRTSKKLIEDLREAVR

SEQ ID NO: 18716 - protein, 181 aa, Artificial Sequence; identical to SEQ ID NO: 18715
  Synthetic sequence.

SEQ ID NO: 18717 - protein, 181 aa, Artificial Sequence
  Synthetic sequence.
DEEKELVRELRDILKKVHKETKESSDTDREVLKRVHEDTERSHRDDERVVEEVKKELDKIRDREDLERVVRELLEIVKRSAEENKRIVEETLKEIERSARENERIVRETLDKIRKVIEELRRRVRVREVEDEVRRSLEDNRRRVEESKRRSDESLRRNKRKVERSKEESDRLLKELEDEVR

SEQ ID NO: 18718 - protein, 181 aa, Artificial Sequence; identical to SEQ ID NO: 18717
  Synthetic sequence.

SEQ ID NO: 18719 - protein, 175 aa, Artificial Sequence
  Synthetic sequence.
REVEEALKRNEAVVEESREAVERALRENETMVRESEKEAKRVKDENRKSIEELKRSNVSDRVERTLRETLKELEKVVEELKDIHRRTSERLKDVARKLKKIHDDTRKELEDFGDVPEEVLERVVRKLKELDDKSREDLEKVKKELRDVDTRSEELLREVEKRLREVDDRLRREEE

SEQ ID NO: 18720 - protein, 175 aa, Artificial Sequence; identical to SEQ ID NO: 18719
  Synthetic sequence.

SEQ ID NO: 18721 - protein, 175 aa, Artificial Sequence
  Synthetic sequence.
SEVEEVEKENKKMVEESERELEKLERENDKLLKESEDEARKVEEELKRVVEELDRSNVSEEIREELKKAIEKVKRVLDDVLRKHEETKKELKEVVKELREIHKRTSDELRKFGEVPEEVLREVVKDLRRVDKESKERLKRMADKLRDVDRELKEKLKRALEDLRRIVTELRERAR

SEQ ID NO: 18722 - protein, 175 aa, Artificial Sequence; identical to SEQ ID NO: 18721
  Synthetic sequence.

SEQ ID NO: 18723 - protein, 180 aa, Artificial Sequence
  Synthetic sequence.
DEVETVTRELEDTNRDIEKKVEEVERELRKTDREIREKVKRVEEELTRSDRELAEIVKKKNTEDRIVKEVVRLNEDIVRRLREVVKEVEELNKRAVERLREVVKKVKRLNREIVEELRRVRGEDVKRIVEKARKINEDVRREIEKITEEVRRINEEVDDRIRRIAEEARRINEKVKRRLT

SEQ ID NO: 18724 - protein, 180 aa, Artificial Sequence; identical to SEQ ID NO: 18723
  Synthetic sequence.

SEQ ID NO: 18725 - protein, 180 aa, Artificial Sequence
  Synthetic sequence.
KEVDDVAEELRRTNKEIKDRVKDVLRELEELLTDIEKTVRDVERELRESDERLEREVRRKNTSDDIVREVKELNKEIVERLKKVVEEVTRRLKKLVDEAEEVVKEVVDLNREILKELRDVRGEEVRRIVEKARKINTEVKKKIEEIEKTVRKILKEVRKIIKDIRDEARRINEEVRKKLE

SEQ ID NO: 18726 - protein, 180 aa, Artificial Sequence; identical to SEQ ID NO: 18725
  Synthetic sequence.

SEQ ID NO: 18727 - protein, 180 aa, Artificial Sequence
  Synthetic sequence.
KEVEDIVRELEEEVEKIRDHSRRVSEELDKSVKDNKRRVDEVKKTLEKSVRDIRRKVRDDSLREIVERLKEKVDRMVRRLEEITEELEDKVRKVVENSRRIVKEVEDKVREVVRELERIKDGEVLKDVARRAREMLEEVRRKDRENTERARRLLEEVHRRTEEVERRAREVLKKADEDVK

SEQ ID NO: 18728 - protein, 180 aa, Artificial Sequence; identical to SEQ ID NO: 18727
  Synthetic sequence.

SEQ ID NO: 18729 - protein, 185 aa, Artificial Sequence
  Synthetic sequence.
SELDELRKRVRDLDERLKESDDTLRKLVKELIERVKKSDTELERLVERVIEEIERVLRDRKDSSEEVRRLLDTLRKIIEENIKRSTDLAREVTRIIEENIKTSRRLAEDAERTLEEVIRRLKDKSVKDRLRELEEELRKRMKESDERNRDLRRRLEEMIKDSKRTNDELKKRVEKVAREAEEKLR

SEQ ID NO: 18730 - protein, 185 aa, Artificial Sequence; identical to SEQ ID NO: 18729
  Synthetic sequence.

SEQ ID NO: 18731 - protein, 185 aa, Artificial Sequence
  Synthetic sequence.
DELERLEEEVEEVRRRLEKSDDDLRKLVDEVERRLRESDKRLHDLSEEVIRRIEDVLRKNRELRERLRTLAEELERISEENMRRVERLLEELERIIEENIKKVEELAERLRRRVEDVVRRLKDKSVKDELRKLKEKIKKVADESRRRNEELRRKVDKVIKDSRETNKRNTEEVRKVAKDVDDTVK

SEQ ID NO: 18732 - protein, 185 aa, Artificial Sequence; identical to SEQ ID NO: 18731
  Synthetic sequence.

SEQ ID NO: 18733 - protein, 174 aa, Artificial Sequence
  Synthetic sequence.
SEEERIAKEAEDLVRRVKENNARTIKEAREVARKVEAETKKIHDDARKLVEDVKRKVERRGVEELLEELREMVERSKKLSEDNVRESRRVSKEVKERDTESLKRLRDLVREVIKKVDKVRELKERLERVIKEIEETIRRSARELDEVNRRNEKMVKENEDELRKVIEEIERRIR

SEQ ID NO: 18734 - protein, 174 aa, Artificial Sequence; identical to SEQ ID NO: 18733
  Synthetic sequence.

SEQ ID NO: 18735 - protein, 174 aa, Artificial Sequence
  Synthetic sequence.
DEEEEIKKELRRVAEDVKRETKRIHEEIRRVLKEVKERLKRVHDELRRVAREVKEKLKKRPVERILEELRKVVKDSEDLSRRILEEIRRVVEESRKRSEDNVRESRRVVEKVIRDVDKVRELTEEAKKLIKENEEEIERNEREARKVIEELERVVRTNKEDVKRVEKEIEDATR

SEQ ID NO: 18736 - protein, 174 aa, Artificial Sequence; identical to SEQ ID NO: 18735
  Synthetic sequence.

SEQ ID NO: 18737 - protein, 178 aa, Artificial Sequence
  Synthetic sequence.
KEVEEIAKEAEDVLRRLDETVKEIADEAREVLRRLNESSKRIEEEARKAIKELRDRAREKEEILREVVEKLKRVIEELKKTDEEVERKLREVIKRLKDTNDEVRKKLKEAIDRLREITDKDELRKILKEVRDVLEEVKRRNEDILRRLRKIAEEVKRRNDKIREELERVLKEAEDRLR

SEQ ID NO: 18738 - protein, 178 aa, Artificial Sequence; identical to SEQ ID NO: 18737
  Synthetic sequence.

SEQ ID NO: 18739 - protein, 177 aa, Artificial Sequence
  Synthetic sequence.
SRLEKIKDDVKRLDDDSRRTLEEVHRRNKETARRVERLLEEAHRLNKKTVDEARSKPNDEDVARRLREIVKESLKLSKDVLKEIKDILDKSLKDSEDVVRLNEDILRKIERTVDSVERSDEIRKIKTDVKEMVKKNREDVKRNNEDVKRVEDKLRKELKKNDDDVRRVLEELERRLR

SEQ ID NO: 18740 - protein, 177 aa, Artificial Sequence; identical to SEQ ID NO: 18739
  Synthetic sequence.

SEQ ID NO: 18741 - protein, 180 aa, Artificial Sequence
  Synthetic sequence.
SEIEEVTRRLEELVKTVREVLREAHERTRRLVEKVRKLIEDVIRTNRKIKERVRELLERVRSEELKRLVEEVAEEMKKSDKELRDRVRRVVEELRRVTEEVRRLVEEAAKELRRVVDELKPGDEIRKLRRRVEEVVRELEEELEKDRREVEKVIEELEREVDRSNEETRRVVKRLREEVE

SEQ ID NO: 18742 - protein, 180 aa, Artificial Sequence; identical to SEQ ID NO: 18741
  Synthetic sequence.

SEQ ID NO: 18743 - protein, 174 aa, Artificial Sequence
  Synthetic sequence.
REKEEVRRKLREAERRVEEIDRRLEKLIRDVKRRVEEADRESEETSDRVRKEVERVDRRGERFEDLLRIVRRVLEENKRRLDETLEDVRRVVEEVERLVEETLRTVEEVIKELERDGVDEEVKERLKKVLEDNRRSIDELRRRIEEVLKENKRTVEEDKKRLEKVLEDVERRAR

SEQ ID NO: 18744 - protein, 174 aa, Artificial Sequence; identical to SEQ ID NO: 18743
  Synthetic sequence.

SEQ ID NO: 18745 - protein, 173 aa, Artificial Sequence
  Synthetic sequence.
SDTEEVEKLTEEIVREVKRLDEEVKELIKEIRKESRRTLEEVRRLIEEVRDRVEKISDDEKVRRLLKKVIEEVEEIARRSLRLLKEVIDEVRRIVEESKELLRRVIREVEKRVDSKDLERLRRELEEVLKENADSIRKLETELRDVLRRTREEAEKLKEELKDVLRRVEEKAK

SEQ ID NO: 18746 - protein, 173 aa, Artificial Sequence; identical to SEQ ID NO: 18745
  Synthetic sequence.

SEQ ID NO: 18747 - protein, 179 aa, Artificial Sequence
  Synthetic sequence.
DEERKIREEAKRADDEIRRLLEENKRALDESNKRAEELVKRLADEVREALKRIEDLLRERPRKEMEDLLRDLKRVLEEIKEELKKVLEDNRRVSEESKRRLEKVVRELRELLKEIEDLVKKDDVKKVVERLRRLIKEVKKRLEKIHEDSRRMVEESEKLLKEIVRKLRELIKEVEDKVK

SEQ ID NO: 18748 - protein, 179 aa, Artificial Sequence; identical to SEQ ID NO: 18747
  Synthetic sequence.

SEQ ID NO: 18749 - protein, 179 aa, Artificial Sequence
  Synthetic sequence.
DEKEDLKRTAEESDREAKKLLDENRKRLEESNKKAEDLVRRNEETLRKVDTDIKDLLRKRDTERAKRLVEELERVVRESLRLLRELLERNRELSKESLKRLEEVVRRNHELLKRIEELIDRDDVKKVLDELRRLVEESKELLKRIHDESEKMVEDSERLLEEVHRRSREVVERVREKIR

SEQ ID NO: 18750 - protein, 179 aa, Artificial Sequence; identical to SEQ ID NO: 18749
  Synthetic sequence.

SEQ ID NO: 18751 - protein, 179 aa, Artificial Sequence
  Synthetic sequence.
SEKDRLSKRAAESDEELERLVRRNAEELDRSNKEIADLLKESKDTLKRAEDEIRRLLAERDTERAKKIVRELEERLKEVEKHDRRSLEENTDVTRKSKERAERVLRENHRVLREVRKLIDEDDVEKVLKELEDVVKKSKELLERIHKESKEMVERSKRNNEKSLEDVRRLIERVLEKLK

SEQ ID NO: 18752 - protein, 179 aa, Artificial Sequence; identical to SEQ ID NO: 18751
  Synthetic sequence.

SEQ ID NO: 18753 - protein, 179 aa, Artificial Sequence
  Synthetic sequence.
DEKRRLKEEAKKSDDELRKLVKDSADRLEDATRRIEELLRENAKRLEEAEKRIREELDKRKRERMEKLLEELRKVVTDSKEAARKVVDDLREMLKRVKEHDRRSLEENHRVLREVEKLIDEEDVEEVLRRLKDLVERSKENNKRSLEEVERLIKEVEERLKRIHDESEKVVRTVEERLK

SEQ ID NO: 18754 - protein, 179 aa, Artificial Sequence; identical to SEQ ID NO: 18753
  Synthetic sequence.

SEQ ID NO: 18755 - protein, 185 aa, Artificial Sequence
  Synthetic sequence.
REAEEIKKRLERVREEVEKELERIHRETDKIAKDVKRELDEIDKESKKVAEEIKKVAEEIKDKEELKRRVDEVTRELERLNEELERIVREVVRRLEALNERLEEIVRRVVETLRRLVEEVVRRTGRGSKVDELKRRVEEVKRDLERKVRENNETIKKVKEDLRREVERNHKTIEDIKRELDERVR

SEQ ID NO: 18756 - protein, 185 aa, Artificial Sequence; identical to SEQ ID NO: 18755
  Synthetic sequence.

SEQ ID NO: 18757 - protein, 185 aa, Artificial Sequence
  Synthetic sequence.
SEAEELLDRIRRVAEEVKRRLEEIHRTTRDIVRRIEELLKEIHERTREIVERIKRVLEKIKDKDTLREEVKRVVKELEKLNKELEDIVRRVTRELERLNEELERIVREVAEDLKRLLEEVRRRTGDGDKVKRLEEEIRKIKRELEKIVRDNNEDIKRAKERLRKINKRNHDEIKKVKDELDETVR

SEQ ID NO: 18758 - protein, 185 aa, Artificial Sequence; identical to SEQ ID NO: 18757
  Synthetic sequence.

SEQ ID NO: 18759 - protein, 185 aa, Artificial Sequence
  Synthetic sequence.
SEAEDLRRRIEEVARRVAEKLKKINRDTERIVRDVKKKLEEIHKRTEEVAEEVKEVLRRIKDKDTLRKVVEEVAEELRDLNRKLEEIIRRVADELRKLNEELKRIVDEVVDELRKLIKEVVDRTGPGDEVEELRKTIEDIRRRLEEEVRRNHDEIRKAEEELRELNRRNHERIKEIKEELDREVT

SEQ ID NO: 18760 - protein, 185 aa, Artificial Sequence; identical to SEQ ID NO: 18759
  Synthetic sequence.

SEQ ID NO: 18761 - protein, 183 aa, Artificial Sequence
  Synthetic sequence.
SEVEKIDKRAKEVEKELEESNRRNRERIKEADERLRDLLRRNKEEIDRARKRLDEIVRRDEKDEVREIVRELDERLKDMNARLKEIVEELRRLLKEINDEDRRIIEELKRLLKKILEDAARLTDKKRLKEVERRMEEIVKTVKKRSEDSHRESDEIVKRVLERLRKVHEETKEIVKRVEDRLR

SEQ ID NO: 18762 - protein, 183 aa, Artificial Sequence; identical to SEQ ID NO: 18761
  Synthetic sequence.

SEQ ID NO: 18763 - protein, 174 aa, Artificial Sequence
  Synthetic sequence.
EEAERIDKKLEDEVREVERELEDVHRKVKEILEDVKRKHKKVHDELKKVIDEVKRKLEERPDERIVRELKEKLRESNERLNRLTEKVKKELADSNKLLEDIVRRLKERLEEVIREVDKIKELEEKVRRIVRKLERRVEKNKDDTRRAVEEAEKLNEDNKRTSEKVEEDLRRTTT

SEQ ID NO: 18764 - protein, 174 aa, Artificial Sequence; identical to SEQ ID NO: 18763
  Synthetic sequence.

SEQ ID NO: 18765 - protein, 174 aa, Artificial Sequence
  Synthetic sequence.
SEAEEIVRELRKAVEDVAREHKRIHEEVRKAAEDVKRKLKEILDRLERVVEEVARALEERGNEEIVETLKRKLEEAIKRARDVLDELRRKLEESNKALNRLSETLEKKLEEVIRRVDKIDELREEAKEVVRDVRRLNEENRKATEDILRELKEIVERLERRAREVVKELKERAR

SEQ ID NO: 18766 - protein, 174 aa, Artificial Sequence; identical to SEQ ID NO: 18765
  Synthetic sequence.

SEQ ID NO: 18767 - protein, 174 aa, Artificial Sequence
  Synthetic sequence.
DEREEIRRRLREDVKRVKRRLEEIHDEVRRLLEEVDRRLRKVHKELKEEVTEVEKRLRERPDKRIVEELRRRLKESIERTRKILETVAKKLRDSNRKLEKVVKDLKKRLDDVIRAVSDVRELKKEIDDVRKELEETVERNKRETERALRKAKEDLDRNREEVKRVVDELEKRTR

SEQ ID NO: 18768 - protein, 174 aa, Artificial Sequence; identical to SEQ ID NO: 18767
  Synthetic sequence.

SEQ ID NO: 18769 - protein, 174 aa, Artificial Sequence
  Synthetic sequence.
SEKDEIRDELEKILRRVEELNRRIRKKLEEIRKEVERLLREIHEKLEEVVKEVEEKLRERPDSRIVKELKDKLRESIKETADVLRKLEKKLRDVIREIRKTNKEVEEKLRDVIRRVDKIEELKRRVEEVLKRARESLRELEEDVRRVLEEARKELERNRERVERVLRRLEETVR

SEQ ID NO: 18770 - protein, 174 aa, Artificial Sequence; identical to SEQ ID NO: 18769
  Synthetic sequence.

SEQ ID NO: 18771 - protein, 179 aa, Artificial Sequence
  Synthetic sequence.
DEVEDLERRLKEVVDRSRRLDEELKRRDKKSVEDVRRKLEEVRKKLEDVARKLADLLRQGRDAKRVLDEIERVVRDVERVLEEILRDVKRSIDEVREVAKASLKLTEEVIRRVRKVAKERGVPLEKLERDVARAREENDRTLKEISKHSEKVLREVADMARKLRKEVKRIEDEIRERAR

SEQ ID NO: 18772 - protein, 179 aa, Artificial Sequence; identical to SEQ ID NO: 18771
  Synthetic sequence.

SEQ ID NO: 18773 - protein, 184 aa, Artificial Sequence
  Synthetic sequence.
KLVEEVKREIEELVRRLEEVLDRVRRENERLAEELKKVVKDVEDNNERIARTVTELLKKVDSKELERLLRKVVEDSRKSVKDLEKLLREFVRRSEESVKRLEDELRKMVETVRRVVEKLERDGVPKEKVDELKRDVDRAEEKVRELIERIKRRSEEVKKRAEELLKKLEDDSRRVKKKLDDDAR

SEQ ID NO: 18774 - protein, 184 aa, Artificial Sequence; identical to SEQ ID NO: 18773
  Synthetic sequence.

SEQ ID NO: 18775 - protein, 184 aa, Artificial Sequence
  Synthetic sequence.
SEVDEVRKEIKRLADEAREVVKEVRKNNEKIADDSRKLNERSIRESKKVTDTVRELLKRVRSRELDRLVKEVVERSNEIVEESERLVREMNKRSDDSVEKLREVLERIVRELERVVEEAARAGVPEERVKELKERVDEVSKELRDLLKKLRDDSERVVEENEKLLRELKERSDRATKELDDASK

SEQ ID NO: 18776 - protein, 184 aa, Artificial Sequence; identical to SEQ ID NO: 18775
  Synthetic sequence.

SEQ ID NO: 18777 - protein, 184 aa, Artificial Sequence
  Synthetic sequence.
KKAEKVDKEIEDLAREVREVLKEVEKDSDRLVKEVEDVLRRVKENNEDIRRRVSELDRRVRSEELRRLVKEVVDRSDESVRRLEELLKRAVKRSDDVVKKLEDELREIVKELRRVVEELERAGVPEESVERLRRKVKEIEDELRELLERLRKKSEDAKRKLRELLERIKRDSERAKRELEERDK

SEQ ID NO: 18778 - protein, 184 aa, Artificial Sequence; identical to SEQ ID NO: 18777
  Synthetic sequence.

SEQ ID NO: 18779 - protein, 184 aa, Artificial Sequence
  Synthetic sequence.
DTAREVKRKVKEIADEVRELIRRVHEETKKTSETVKKLIKEVHDTTEKIVREVRKLADEVDSEELERLVREAVRRLEETNRRLRELVERVVRENEKSSDELRKRVEEVVRRLRKVVKELDDAGVDKKLVEELKREVDRISEELKRLLERNEREVRESKKTLERDLERNHEEIERAKRELDERVR

SEQ ID NO: 18780 - protein, 184 aa, Artificial Sequence; identical to SEQ ID NO: 18779
  Synthetic sequence.

SEQ ID NO: 18781 - protein, 184 aa, Artificial Sequence
  Synthetic sequence.
REVDEVRKRVEKVAEEVRRLIEKVHRETERTSREVEKRIRDVHRRSDEVAREVDDLSRRVDSKELKELVEDVARRLEEINRRLEKLVKEAVDTNRESSERLRKLVREAVEKLKKIVEELDRRGVDKKMVRTLAERVKEISEELKRRLKRNKDEVEESSRRLRELLKRNHDEIRRIKEKLKEETR

SEQ ID NO: 18782 - protein, 184 aa, Artificial Sequence; identical to SEQ ID NO: 18781
  Synthetic sequence.

SEQ ID NO: 18783 - protein, 178 aa, Artificial Sequence
  Synthetic sequence.
EEVDRVKRKLEEVEKRVTEISKRTEELVEEVRKEVERISKRTEEDDRRVAKEVRERLKSGKDLKRLVDEVRRLLEETNRDNKRVIDEVVRELEEINERNKRVIDKVEEELKKIVEEVKRAEKAKEIKEKVDEVIERLRRSNRKLHERIREVEKKLRELNERLHRHSREVIKELEERAR

SEQ ID NO: 18784 - protein, 178 aa, Artificial Sequence; identical to SEQ ID NO: 18783
  Synthetic sequence.

SEQ ID NO: 18785 - protein, 179 aa, Artificial Sequence
  Synthetic sequence.
KEVEDILRDLERLSEESLRRNEEIHRELEELLRRVDEKNREIHKTLEEMVRRALTELRKRPDERILDELRRVLEEVLRLSEESDRELEDVLKKVLELSKESLDRNKKLLDEVRERIRTADEKVVREVDRRVEESRKRLEKLLRENEKRVRDARRRARKLSEENERTVREVEKRAREEVK

SEQ ID NO: 18786 - protein, 179 aa, Artificial Sequence; identical to SEQ ID NO: 18785
  Synthetic sequence.

SEQ ID NO: 18787 - protein, 179 aa, Artificial Sequence
  Synthetic sequence.
DEVEEIKRKLDKVADESRKLDEDIRDKLRRVADEIRRLHEESRKELEDVVREIERLLRERDIKEVLKRLKEMLDRIIRRDEEILKRLREMLKKVIEEIERSIERSRKLLEDVLREAKDVPEKVIKEVRDTVEKILRENEKSLEEVRKTVKRIEEESRELLETSRDEVRRVLEKAEETEK

SEQ ID NO: 18788 - protein, 179 aa, Artificial Sequence; identical to SEQ ID NO: 18787
  Synthetic sequence.

SEQ ID NO: 18789 - protein, 185 aa, Artificial Sequence
  Synthetic sequence.
SVADEIRKDLKRVADEVEERLRRLLEHNKKVRDEVKERVDESKKELKEVEEEVTEKLERIKEKERVKKVIDDVTKRMREIVEKNRRVSEEVKRLSEENVRESRRISDKVRKDLKRILDEIRRAGVDEKVVREIEERIRRVIRRLDEVDKTNEKISRDAARELEESDEELRRRVKEVKDRLDEKTK

SEQ ID NO: 18790 - protein, 185 aa, Artificial Sequence; identical to SEQ ID NO: 18789
  Synthetic sequence.

SEQ ID NO: 18791 - protein, 185 aa, Artificial Sequence
  Synthetic sequence.
DEAEKIKKELDDVAREVERRLKELLDDNRRVAEEVEKRLRDSKRELEEVTRRVRKELERIKNKEDVKRVVDEVVKEAEDILRKNEEVIRRVKDLSRRNVETSKRISEEVKRLLEEILKKAEDDGLDKKLVDKIRDDIRRIARRLDEMNKKNKKLSDELEERLKKSNEEHRRRVEKVKEELEKKVE

SEQ ID NO: 18792 - protein, 185 aa, Artificial Sequence; identical to SEQ ID NO: 18791
  Synthetic sequence.

SEQ ID NO: 18793 - protein, 185 aa, Artificial Sequence
  Synthetic sequence.
SEAEEIEKELREVAKEVRELMREMLKNNKEVAEEVKRRLERSRERLEEVEETVRDLLEKIKDKKTVRDVIRTVKKLLKEILDRNKKVIDEVKELSRENVKRSEDVSRDVLRRLEEILRKVRAAGVDDKVVKKIEDDIREVEKEARKLNRENRELSKKLAEELDRSNDRHRREVERVERELEKAER

SEQ ID NO: 18794 - protein, 185 aa, Artificial Sequence; identical to SEQ ID NO: 18793
  Synthetic sequence.

SEQ ID NO: 18795 - protein, 184 aa, Artificial Sequence
  Synthetic sequence.
SLQERVRDKVRKVKKDLEDLNRRHREEIERVVRELDKSNEDHEREVRRVEKELEELIRRNKERDEIREVVEELRKLLEEVLKENSDVIRELRELLKELHEKNRKVVKELDDLLRDVIDKLEKINDKKFVEDVDRALKRIADEVKRRSEESKKELDDIKKEVEERLRESKEKLKRIVDEARERLR

SEQ ID NO: 18796 - protein, 184 aa, Artificial Sequence; identical to SEQ ID NO: 18795
  Synthetic sequence.

SEQ ID NO: 18797 - protein, 175 aa, Artificial Sequence
  Synthetic sequence.
SELEEVIKRAEDELRDDERENKRVLEKSDRDIKRWEEEVKRVLKKARDELDKLRKEGIDEKVLREVEKIIRDVEEEIKKILEELRRITKKVEDESREILERVRRVIERVRRRANEDKDVVEKLREELEKVLKESRDESKRLKEELDKVNDDARKRLEDLMRKLERVLEEVRRRRK

SEQ ID NO: 18798 - protein, 175 aa, Artificial Sequence; identical to SEQ ID NO: 18797
  Synthetic sequence.

SEQ ID NO: 18799 - protein, 175 aa, Artificial Sequence
  Synthetic sequence.
SELERVIEEIRRALEEDHERNRDVLREAKEELERDKRRNDKVLTDIRKLVKDLERKGAPEDVLRELEEIIDRVLKRSEKILEEVKRVIDKVKRDSERINKEVEEMIKRVEERANEDEETVRRLTEELRKVLDEVTKRSKELSDRLREVLRRSKELSKELEKELRKVIKEADDRVK

SEQ ID NO: 18800 - protein, 175 aa, Artificial Sequence; identical to SEQ ID NO: 18799
  Synthetic sequence.

SEQ ID NO: 18801 - protein, 175 aa, Artificial Sequence
  Synthetic sequence.
SEIERVLKEARDELRKDEEKNRDLLRRAKKVIEEDHKRNRDVLRRVKEELDRLREAGVPEEVLKRVRKALEDVRKESERLNEELRDVLRRVAEASRRILEEVRKIIEDVERRANEDKDALDRLRRELEEVLRRSKEESDRLAEELKRVLREIEERSRRLAKELKEVLDTAKRDKD

SEQ ID NO: 18802 - protein, 175 aa, Artificial Sequence; identical to SEQ ID NO: 18801
  Synthetic sequence.

SEQ ID NO: 18803 - protein, 174 aa, Artificial Sequence
  Synthetic sequence.
SELERVIRENERTIREDMKKNEDVLREWEKLTRDLEDTIRRVLKKNRESLKRLKDKGVPEEVIKELEKVSEEIRRRLEEIIRDDRRVLKEAEKRSRDLLRELKKISEEAVELLRRNVDRRELVKRLRDVDERSDDTSRKLKEELERVIRRTEELIRRVMEDAKRVDDEARKKTD

SEQ ID NO: 18804 - protein, 174 aa, Artificial Sequence; identical to SEQ ID NO: 18803
  Synthetic sequence.

SEQ ID NO: 18805 - protein, 174 aa, Artificial Sequence
  Synthetic sequence.
SKVEEVLRELERRVKEDEDENRKVVRENERTVKEDEDTNRDALRRNEESIDKLRRDGVPEEVIRKLERLSRKIEDDSRKLLEELRELTRRIKKASEDLLRRLRELLERIVRLLERNVDVDTLKRELDEALKRSEEESRRLKEEVTRIDERSKRESDRLVEEAKRLDKEAKDRSD

SEQ ID NO: 18806 - protein, 174 aa, Artificial Sequence; identical to SEQ ID NO: 18805
  Synthetic sequence.

SEQ ID NO: 18807 - protein, 186 aa, Artificial Sequence
  Synthetic sequence.
SELEEVLKKAAEVIKEIEKRLRKVLEDSRRLTKEDEKRNKEVLKKLKEKIDEIEKRARDKGLPEKDVERLKRELDRALEDVERISKELKETNEDVDRKTEDIIRRIKKKLKEVLDKARDIVEKLKDVDEVLRRLDRELKEVLDRVEREVERLKEENDRMNKKSKDDSEKLERDLERVAERLERELK

SEQ ID NO: 18808 - protein, 186 aa, Artificial Sequence; identical to SEQ ID NO: 18807
  Synthetic sequence.

SEQ ID NO: 18809 - protein, 186 aa, Artificial Sequence
  Synthetic sequence.
SEAEKVLKEAREAAKRIEDEARKVLRESRELAKKAEEDDRRALKRAKEAAEKIKRDADRKGLEDKEAKKIEEKLRKALEDLERLSREAKKEAEKVDRKTKKIAEDIKRELEKALRDAEDIAEKLKTADKAIKEAADRLKKVLEDAEKKAREAAEENKRANEEWKKKSKRAAEEAKKVLDEAKKELD

SEQ ID NO: 18810 - protein, 186 aa, Artificial Sequence; identical to SEQ ID NO: 18809
  Synthetic sequence.

SEQ ID NO: 18811 - protein, 175 aa, Artificial Sequence
  Synthetic sequence.
SDKERIKERVKKVHKESAKHIEDVRRRNEEINKRIKEEIDDVERRNREINEDIRRLVRERRVDEKEIRKRLKDVRDETKRIVERIKRELERVLEETEKALEDNDRKAKKVRDELRELNLPERVIEDLERLIEENKRTLTEVIKRHRELLEDWKRRLDEVLKDHERSAREIDEEAR

SEQ ID NO: 18812 - protein, 175 aa, Artificial Sequence; identical to SEQ ID NO: 18811
  Synthetic sequence.

SEQ ID NO: 18813 - protein, 175 aa, Artificial Sequence
  Synthetic sequence.
DEKEEVRRTVEERLKRVEDRVRELEKENEDINRELKERLKKVRRENEEINERLKKLLDENRVDEKRLREELKKVKEKTDRMLEKIAEDAERVLKKTRDELEDIRRRAEKVLEDLRRLNLPEEVIRRVEEEIKRIEKRLRDVIKKHEDSVRKIRTDMERVVRDHERLAKKWEDDAR

SEQ ID NO: 18814 - protein, 175 aa, Artificial Sequence; identical to SEQ ID NO: 18813
  Synthetic sequence.

SEQ ID NO: 18815 - protein, 175 aa, Artificial Sequence
  Synthetic sequence.
DEAKEIEDRVRTEIRDIERKVREARERSKRSDDELKKHSEEVARELEEILRELEEALRRNEVDRRELERRLREALRRAKEVTERNEREVKKNLDELREILKRITDRLKKVLKDLKDLNLDKSVIDEVRKAVEDIARKLKKVLEDNKREIDKDRKRNEEVLRTAREKAEKIKEDAR

SEQ ID NO: 18816 - protein, 175 aa, Artificial Sequence; identical to SEQ ID NO: 18815
  Synthetic sequence.

SEQ ID NO: 18817 - protein, 175 aa, Artificial Sequence
  Synthetic sequence.
DEKEKIKEDVRRVIRRIEEIVKRVDRESERSDRELEKHSRDVERRLREINDRLRRLLEENRVDRREVRKRVEDSLREARRVTEENKKTVDRNLREVKRVIDEIDDEARKVLEELRRANLDERVIEEVKRLIDRIREELERVLEKNARLAKEDEERNERVLTENRKLIEDWEREAK

SEQ ID NO: 18818 - protein, 175 aa, Artificial Sequence; identical to SEQ ID NO: 18817
  Synthetic sequence.

SEQ ID NO: 18819 - protein, 184 aa, Artificial Sequence
  Synthetic sequence.
SKLEEVVRRVDKDARDIRRRNEEVKRRNEKSAREIEKKVKKVLEEFRRLVEEIRKRLEEEGIPDSLIRTLERIATEVLKRIKEVLERLKRILDDSRRLLEEVSERNDRSLRDLKRELEEVSNSTDERVLKELEERVRKVLKDNRDTSKELEERVRRIDEELDKTLRKAKEELRKIIRELEERLR

SEQ ID NO: 18820 - protein, 184 aa, Artificial Sequence; identical to SEQ ID NO: 18819
  Synthetic sequence.

SEQ ID NO: 18821 - protein, 184 aa, Artificial Sequence
  Synthetic sequence.
SELEKVLERVKREAERIEKKNKKVLEENKKSAEEIHRDNERVLREVKDMADKIEDELRKRGIPKSLEKTIRDILERLKDRLKKVNDENRESAERSLKEIKDVSRENRRSIKELLDELREVKRTTDRKVLRDVERRVKKILDDNKRTSDEMKKRLDRLDETNKRTSEKLEEDVRRIIEDLERRVK

SEQ ID NO: 18822 - protein, 184 aa, Artificial Sequence; identical to SEQ ID NO: 18821
  Synthetic sequence.

SEQ ID NO: 18823 - protein, 184 aa, Artificial Sequence
  Synthetic sequence.
SKLEEVLKKLERLAREIERRLRDVIRRNKESADRIRKRNEEVLRKVEDVAREIEDKVRRGGVPKSIIERLRRIAKEIAREIERASRENEKSAKRSAERAEKALRELAKILRDIAEELRRVSNDKDEEALRTLDKRVEDIIKRLKEEVDRVVRDLEELDKENEKSSREVEERLKEIIRELEETLK

SEQ ID NO: 18824 - protein, 184 aa, Artificial Sequence; identical to SEQ ID NO: 18823
  Synthetic sequence.

SEQ ID NO: 18825 - protein, 184 aa, Artificial Sequence
  Synthetic sequence.
SKLEEVLKTLRRLIEEIKKRLKKVKDDNKKSLEDIHRKNKRVLEELEKRLRDIDKKLKDKGIPRTRIEELKKIVEEIRRTVRKVNEDNKRSVDESRRELEDALRELDRILKELEALIRRVKNTTDERVLKEVEERVERIIRELRRRVEELKRRVEELDRRNEKTSDDLEEELKRIDKELKDRTD

SEQ ID NO: 18826 - protein, 184 aa, Artificial Sequence; identical to SEQ ID NO: 18825
  Synthetic sequence.

SEQ ID NO: 18827 - protein, 184 aa, Artificial Sequence
  Synthetic sequence.
SKVEDVVRRVAEVAERIRRRNEEVAEENERSLKEIHDENKEVVERARKMAKRIEDEVRRKGVPKELIKRLEEIVRRVEKRLKEVNEENRKSAEESRELLRRVNKRNDESLKRLLEKLERVKNTTDEEVLKTVADEVREILERNEKTSEELAERVRRLDEENRRTSREVEKRVEEVIEDLKRRLK

SEQ ID NO: 18828 - protein, 184 aa, Artificial Sequence; identical to SEQ ID NO: 18827
  Synthetic sequence.

SEQ ID NO: 18829 - protein, 181 aa, Artificial Sequence
  Synthetic sequence.
SEVDKLEEDLRRIIKEIRRLVEEVKRKSEEIDRELKRLLEEAERTLEEIDRKLEDELRKKGNDEDVRRELKEIVERSETLVREVLKTLREVARRSEELNKDVHRRLKELVEEVRKRLEDLPEDDKVREVKKDVEKKLKELEEELRDITRRNRESLKRLEERLKEVAKKNRKTVDELRKELD

SEQ ID NO: 18830 - protein, 181 aa, Artificial Sequence; identical to SEQ ID NO: 18829
  Synthetic sequence.

SEQ ID NO: 18831 - protein, 181 aa, Artificial Sequence
  Synthetic sequence.
DEVDDLKRRLEKIITEDEKLVKEVKDRSEKLDREIAKLLEDARRALEKLDKELEEILRKKGDDEDVRRELKKIADDSRRLAEKVLKELDDILKKSEEENRRVHEDSERSMREVEKLLRALEEDDKVREVVKRVRDEADKSRRKLEEITRRNRDSLERIKRKLERVLEENDRTLRELEERAR

SEQ ID NO: 18832 - protein, 181 aa, Artificial Sequence; identical to SEQ ID NO: 18831
  Synthetic sequence.

SEQ ID NO: 18833 - protein, 177 aa, Artificial Sequence
  Synthetic sequence.
SELEKVVEDSRRKLDAWDDESRRVAEESRRRLEEWRKRLEEVAKRVEERLRDLKRKAGDREKLREAKKELRRVVERIKKLVDEVEKRSEEILDRNRKLNDKVRKESEKLAEEIKRVDDEELVKKMARELDELNKDLDRLNKESKRELERLNTELAELIKEVERELRELLRKLEEDLR

SEQ ID NO: 18834 - protein, 177 aa, Artificial Sequence; identical to SEQ ID NO: 18833
  Synthetic sequence.

SEQ ID NO: 18835 - protein, 177 aa, Artificial Sequence
  Synthetic sequence.
DSLEDVVRRVKKKLDDNRKDVERVAKESEELLKRWRDRVKKVVRDVERRAEELRRRRGDDKSLRDVEERLRRIVRDLERLIEEVERRSRKILKDLRKLNKDSVDEAERLVEEIKRVTDEELIKTFERTLEELHKTNKKLNEEVKKRLEELNTRLAKLIEDVRKELEKVLKELEDRAR

SEQ ID NO: 18836 - protein, 177 aa, Artificial Sequence; identical to SEQ ID NO: 18835
  Synthetic sequence.

SEQ ID NO: 18837 - protein, 177 aa, Artificial Sequence
  Synthetic sequence.
DELDEVVREVKDRLRENKEEVKRVMDESRRLLERWNEESERVAKKVEEAVRKLTKDKGDDDLLREVKKALKRVLDENRRLNEEVEERSRRIVDRLRRLNEESEKRAEELTKEARRVNREDDIRRITKRLRDLHRENEKLNRDVKKELRELNERLAKLNRDSTRELEELLRKLEEDAR

SEQ ID NO: 18838 - protein, 177 aa, Artificial Sequence; identical to SEQ ID NO: 18837
  Synthetic sequence.

SEQ ID NO: 18839 - protein, 177 aa, Artificial Sequence
  Synthetic sequence.
SELDKVVEESKRLLEEWDRRSKDVAKKVKEMLDRSRKASKEVVKEARDELERLKRETGDVEEVREMEKRIEKIVREDEELNKDSVRRAEEIVRENEELNKEVKKRSKDLVDEARKVTDEKDIREIKERLKRLNETLAELNERSKKRLKRLLDEDKKLNDDSSKELKELLKELEDRTR

SEQ ID NO: 18840 - protein, 177 aa, Artificial Sequence; identical to SEQ ID NO: 18839
  Synthetic sequence.

SEQ ID NO: 18841 - protein, 177 aa, Artificial Sequence
  Synthetic sequence.
RELEDVARRARKKLEDNKRRVEEVAEEVERRLDESRKESDKVVREVEEVLKRLKEERGDVRSLDRVTERAEEIVRDDKRLNKRSKDELRKVLKRLRELNKRSVETIEKLLEEIKRVKNEELVKRMTEELERVHRENEKLNRDVRRELEDILRKDEELNKRSKKRLKDLLDELRRRLT

SEQ ID NO: 18842 - protein, 177 aa, Artificial Sequence; identical to SEQ ID NO: 18841
  Synthetic sequence.

SEQ ID NO: 18843 - protein, 177 aa, Artificial Sequence
  Synthetic sequence.
SELEEVVKKVRTDLDRIDEKSKRVAKEVDRVLKESEDRSKKVAREVEEVLRKLKEEAGEVDELKRVMKELKEIVDRDERLNEESSKRLKEVVKDNERLNEEVRRRAEKLVEEIKRVKDEDLVRRAVETLERLIRELEKLNDESKRRLEEILREDKRLNKESTEELRRLLEELRKTLT

SEQ ID NO: 18844 - protein, 177 aa, Artificial Sequence; identical to SEQ ID NO: 18843
  Synthetic sequence.

SEQ ID NO: 18845 - protein, 181 aa, Artificial Sequence
  Synthetic sequence.
SEVERVAEELKRVLKELEDLDRESEKKLKRLNEELARLIEEVRRRLEEVLRTLEELAKRVKDKETIDRILRRIEEALKKLADEARDILREAKKASEDLARENKKLLDDARETIERLARNLERTREVEEVIRRIDEAIKRIEKHSREVIERSRERVEDWRRKVERVIEEVERRARKLREDTR

SEQ ID NO: 18846 - protein, 181 aa, Artificial Sequence; identical to SEQ ID NO: 18845
  Synthetic sequence.

SEQ ID NO: 18847 - protein, 181 aa, Artificial Sequence
  Synthetic sequence.
SEVEKVAEEAKRVLDELEKLDRDSAKELKDLNDELRKRDKESEDALRKITRDLDELDKRVKDEKTARDIEREIDKRLEEIARTNEELLKTAKKRSKDLARKNKEILERIARALKELADKLRRDKDVEKVIRDLKRELERLAKHSEEVIRTSEELLKRWEDHSRKVIEEVKERARDIKRRTK

SEQ ID NO: 18848 - protein, 181 aa, Artificial Sequence; identical to SEQ ID NO: 18847
  Synthetic sequence.

SEQ ID NO: 18849 - protein, 177 aa, Artificial Sequence
  Synthetic sequence.
SELEKVVKEVEEALERNNRENRRVIRRSRELLKRWREEVEEVVRRLRERAKKIADDVDKREVLERLKEMIRRVEEKLERILEKAERDSRRIEEEIRRLNERLKELVERIKRKMDRVTREEEVRKLEEDLRRILEEIDRESDRLVKRIEDLNRRVAELLKRVEEELEDLARKVEEEAK

SEQ ID NO: 18850 - protein, 177 aa, Artificial Sequence; identical to SEQ ID NO: 18849
  Synthetic sequence.

SEQ ID NO: 18851 - protein, 184 aa, Artificial Sequence
  Synthetic sequence.
SIEEIVEEIERELEKLKRKLDELIKRSEELSRRLAEKTRRSNEEIKREIDKVADDIRKTLSDREKVERIRKKLEEVHERHRKIVKESEDHLKEVNDRLREILRELAERLEEAIKKIRDIVRRTTDEDTIRRVLEEAREEIKKLERDVDKVRKEVEDAHRKNSELNKTVHDEVRKIIDEIRKEVK

SEQ ID NO: 18852 - protein, 184 aa, Artificial Sequence; identical to SEQ ID NO: 18851
  Synthetic sequence.

SEQ ID NO: 18853 - protein, 184 aa, Artificial Sequence
  Synthetic sequence.
SIEEILREIEELIKDLLRKAEELLKESEKRSKELKDEMKRSNEEIRKLIEDLRRRAKDRVEDKDKVKRLEDDLRRVHEEHKKRLDELAKKLEDANRRAREILDKIRRRLERLLEEAEDIVRKVKDEDVIRDLLRRVREDIDRLRKELEKVVRELRRIHEEVRRDLKRVHEEVRKRIEDLEEELK

SEQ ID NO: 18854 - protein, 184 aa, Artificial Sequence; identical to SEQ ID NO: 18853
  Synthetic sequence.

SEQ ID NO: 18855 - protein, 179 aa, Artificial Sequence
  Synthetic sequence.
KEVEDVVRRVRKLIEDNERRNKEVHEEVEKRARENVERNRELLEKIRRTVEEIRRELEELRGDERVVKKVEDDLRRLLEEAKEVLKKSEKNLDELLKKHEKVLRDSEEDLKRVLDELRERGLDKDLLDEVRRLLERVKRRTEESNRRVKKIVDDVKRTSEEILREVEELLRRLIDDARK

SEQ ID NO: 18856 - protein, 179 aa, Artificial Sequence; identical to SEQ ID NO: 18855
  Synthetic sequence.

SEQ ID NO: 18857 - protein, 179 aa, Artificial Sequence
  Synthetic sequence.
DEVEKVFREVKKRIDENREKNRRVHEKVEREARRNSEENRRVHEEVRKTVEDIRRELDEKRGDEKAVREIEKKLKELLEKHKRVVEESRKNLTELLEEHKEVMRDSERDLRRVLKEVEKAGLDEELLRRIEKLAREVRDETRRSNEKVKEIIRRVEKESEDSNREVKRLLDELTRDARR

SEQ ID NO: 18858 - protein, 179 aa, Artificial Sequence; identical to SEQ ID NO: 18857
  Synthetic sequence.

SEQ ID NO: 18859 - protein, 179 aa, Artificial Sequence
  Synthetic sequence.
SEVEDVVRKAREILKRNEDENRRVLEKVREDLKRLTDENDKVVEDVREMVRRIKEMLDRNRGDERVLEEVERKLREVEDRVREAKRRDEEKLKRLEEELRRVVEESRRDLERLLEELKRAGVREELLREVDERIKDVKRKTDEILREVRERIKRNEERTERLRREIEELARRLLEDAER

SEQ ID NO: 18860 - protein, 179 aa, Artificial Sequence; identical to SEQ ID NO: 18859
  Synthetic sequence.

SEQ ID NO: 18861 - protein, 177 aa, Artificial Sequence
  Synthetic sequence.
DEEDLLEKIERILEEVKRRLEDVIRRVRKSNEDIERELKKAVDRSRELLRKVEEDLRRNRVDERLLDRLRKIKDENRKLLETLDRELKKISKEDEDRLREVEKRVEKIMRELRERIRREGADRDVFERLERIARRLTEEIEKALRDSDKLNEELKRKVEEVLRRSEESIRTVLEELR

SEQ ID NO: 18862 - protein, 177 aa, Artificial Sequence; identical to SEQ ID NO: 18861
  Synthetic sequence.

SEQ ID NO: 18863 - protein, 175 aa, Artificial Sequence
  Synthetic sequence.
DEIEKVRKDVDEIIRRLEEELEEVAKRLEDLNREIERILREVKKESDDTIRTIERLRKEGVDRRDIKRISEEDERKLEEVEKTLKRIADKSRELTEDVKRRLKEALDRLEEELKRVNVDESIVKEVRDKLRRLEKRLDDLAKRNEESLRELKRTLEEIIKRSRKENKRIEDEVRK

SEQ ID NO: 18864 - protein, 175 aa, Artificial Sequence; identical to SEQ ID NO: 18863
  Synthetic sequence.

SEQ ID NO: 18865 - protein, 184 aa, Artificial Sequence
  Synthetic sequence.
SEVEEVEKELRELIREDKERLDRLRKELKESIDTNKEKLDRVKEDLERLIEEIREEARRRNIDKETMDRLDEKLRRLKKELEEVIKDSRKKLEELLDELRKVVEENKRRLDEVEKELKEVKKLKDRERLTKLVEKIREVLERSKEHSERVAKKIRDELDKLHKETERVDRKLKTEARRLKEELR

SEQ ID NO: 18866 - protein, 184 aa, Artificial Sequence; identical to SEQ ID NO: 18865
  Synthetic sequence.

SEQ ID NO: 18867 - protein, 184 aa, Artificial Sequence
  Synthetic sequence.
DEVERVEEELKESIDRNDEELRRVRKENRESIEKDRRDLKRVEDDLRRLIKKIDEEVRRRNIDEEDVRRLKEKLDRLLKELRDVVKENADRLEATLRELEEVIKRSREKAKRARDELREVKRDSREEALREVVRKLRKLLKELHEETKRVMEKLRKLDRESEEHTKEVDERIKKTIEDLERELK

SEQ ID NO: 18868 - protein, 184 aa, Artificial Sequence; identical to SEQ ID NO: 18867
  Synthetic sequence.

SEQ ID NO: 18869 - protein, 184 aa, Artificial Sequence
  Synthetic sequence.
SEVDEVRKELRKVIKEDEDTMRKLEEENRKSIEEIRKELEKVEEELERVIRRIEDEIRKRNIDKRIADRLRKELKRLLEELRRVIEDLKRKLDKTREKLKRVADENRREAREVEEELKKVAKEDRREVLETLVRKIREELKRSKEHSKRVADDLRRMDEEIRREVKRVVDKVRELLKRLEDELK

SEQ ID NO: 18870 - protein, 184 aa, Artificial Sequence; identical to SEQ ID NO: 18869
  Synthetic sequence.

SEQ ID NO: 18871 - protein, 184 aa, Artificial Sequence
  Synthetic sequence.
DEVEDVLRRLKELAEEDKTKLKEVEKENKESIKEDRKRLEDVRRELEKLIEEIRREVTERRIDEKEVRKLEEKLKRLAEELEEVVKENERTAEKTERRIREVIKRNEDKLRRLMDELRKMKRSKDEKVLRDVSRRIKEEVEKSKKHSEEVKKELEDADRESKRHTEEVEKKIRELIERLKRETK

SEQ ID NO: 18872 - protein, 184 aa, Artificial Sequence; identical to SEQ ID NO: 18871
  Synthetic sequence.

SEQ ID NO: 18873 - protein, 184 aa, Artificial Sequence
  Synthetic sequence.
DEIDRLREELKRLIDKDKTDLDRVRKENEESIRDDERKLREVEKELRDLIEEIRRKAKERNIEEEIMRRLDEKLKKLERDLEEVKKKNETNARENRKELERVIEKNKEDADRLRRELDEVARDEDRRVLEEVARKIRELIRRSEKHSEDVMEKVRRNDERSKRHTEDVTRKIRTEIEKIDRELE

SEQ ID NO: 18874 - protein, 184 aa, Artificial Sequence; identical to SEQ ID NO: 18873
  Synthetic sequence.

SEQ ID NO: 18875 - protein, 175 aa, Artificial Sequence
  Synthetic sequence.
KEKEDVKKRLDEEAEKNKRTSEEAKRRNRESIRRNKETSKRVKEENRRSFEELDDLLRRGDGRREDLRRLLEANLETNTRVHEENDKSAKDNERTNEKVHRENDESLKEIKKRVREENLDKRVEEELDKLMEEIRRHNRESNEELKRLVEEIRKHNRESNEELKKLLEEIERKTE

SEQ ID NO: 18876 - protein, 175 aa, Artificial Sequence; identical to SEQ ID NO: 18875
  Synthetic sequence.

SEQ ID NO: 18877 - protein, 175 aa, Artificial Sequence
  Synthetic sequence.
DEDKDVEKKLRDIIKRNKETSRDVARRLEEIIKRNKKTSDEVATEVRKLIKEIEDVLRRGDGSREELEKLLEEVRKRLEDVHRENKESLKKVEDELKEVHRRNDESLKRVRERIEKENLDEKVKEELRRLIEEIKEHNERVLRKLRKLVEEIERTNEDIRRELKELVEDIRRKAK

SEQ ID NO: 18878 - protein, 175 aa, Artificial Sequence; identical to SEQ ID NO: 18877
  Synthetic sequence.

SEQ ID NO: 18879 - protein, 175 aa, Artificial Sequence
  Synthetic sequence.
SEKEEVRKRLRDKVEDNKRTSKEVADKLRKIIKENKDTSKKVMEDLRRIIEEADELLRRGDGSEETLRKIAEDLERDLDRVHEENRKSVEDLEEELREVHRENKKSADDIRREVDRENLDDDVRRELDELVKRIAEENKRVEDELRRLVKEIEDHNEEVKRELKELVKRIEEKTR

SEQ ID NO: 18880 - protein, 175 aa, Artificial Sequence; identical to SEQ ID NO: 18879
  Synthetic sequence.

SEQ ID NO: 18881 - protein, 175 aa, Artificial Sequence
  Synthetic sequence.
SEKEEVEREVEERLRDNKRTSDKVVEENRDSVRRNKKTSEDVKRENEESVRRIDEVLKRGDGSEETLDRLAEENRRTNEEVHERNDRSLRKNDETNKRVHEENDRSLREIKKKLDEKNVDEDVKRKAKRMVEEIRERNRKSNEELKKLAEEIRKHNKDSNKKLKELVDEIRRKAK

SEQ ID NO: 18882 - protein, 175 aa, Artificial Sequence; identical to SEQ ID NO: 18881
  Synthetic sequence.

SEQ ID NO: 18883 - protein, 175 aa, Artificial Sequence
  Synthetic sequence.
DEERRVREKLKKIIKDNEDTSRKVREDVKKELDDNRRTSEKVARDNERSIEEIKKALERGDGSEDDLRRLARENEETNRDVHRRNDESLRKIERRLEEVTKRNKESADRAREEVERANLPEEVRRELDKLVKEIKERNDEVIEEARERVKRIREKNERSNRKLKKEAKKIEEEAR

SEQ ID NO: 18884 - protein, 175 aa, Artificial Sequence; identical to SEQ ID NO: 18883
  Synthetic sequence.

SEQ ID NO: 18885 - protein, 175 aa, Artificial Sequence
  Synthetic sequence.
DEDREVERDLKKIIKDNKRTSEEVEKKLRDIIRKNEKTSKEVEKELRDIIRRADELLRRGDGSREDLKRILDELRKKLEEVSKRNKDSVDELRKELKEVHDRNKKSLDEVREKLEREKLPEEVKKDLDRLAEEIKKRNEEVRKDLDDLVRKIEKRNEEVKEELDRLAREIEEKAR

SEQ ID NO: 18886 - protein, 175 aa, Artificial Sequence; identical to SEQ ID NO: 18885
  Synthetic sequence.

SEQ ID NO: 18887 - protein, 175 aa, Artificial Sequence
  Synthetic sequence.
SEEDEVRRRLRRIIEENRRTSEEVRERLRKIVEDLERTSRDVRRKLREIVERIKEVLTRGDGSREDLERILKEIEDRLEEVTRELKRIADEARRTLEKVTEDNRRSLEEVKKEVRKDKLPREVEEELRRLIEEIERRNKEVREELDRLIEKLEDDNRKVHKELRELAKEIKDRAD

SEQ ID NO: 18888 - protein, 175 aa, Artificial Sequence; identical to SEQ ID NO: 18887
  Synthetic sequence.

SEQ ID NO: 18889 - protein, 188 aa, Artificial Sequence
  Synthetic sequence.
RELEEVVKRIRDILREIHERSEKSAEENRRLIEKAEEDSKRSAKRIREIIREIREEVKRIKDKDTLRKLLEDLERELKKLIDDNRKMVEDLRRESKRSIDDNRRLNEEIHERLRRIIEELRRRLRERDVREKLERVAREVEKSNKDNRDHSKRVEEESRELLKKLRKHSEDVAREVKKLLDELREETR

SEQ ID NO: 18890 - protein, 188 aa, Artificial Sequence; identical to SEQ ID NO: 18889
  Synthetic sequence.

SEQ ID NO: 18891 - protein, 188 aa, Artificial Sequence
  Synthetic sequence.
SELEKVVEDIRRLLRKIHEDSKRSVRKNEELVEELKRLSEKSEREIEELLRRIKELLKRIKDKESLKRALEELEERLRRIIEKNRELVDRAEERSRKSVKENEDLNRRIHEELKRVIDDARKKLRDERVKRKLDDVEREVRKSNEDNRKHSDEVRRKSEDMLEKLRRESERVADRVRKVLKELEDERR

SEQ ID NO: 18892 - protein, 188 aa, Artificial Sequence; identical to SEQ ID NO: 18891
  Synthetic sequence.

SEQ ID NO: 18893 - protein, 188 aa, Artificial Sequence
  Synthetic sequence.
SELEKLAKEIEEILREAKERSKESAERIRKLVRDLRELSRESEERIRKIETDVKKKIDDIKDKDTVRRLLEELRKRLEEMIKRNEDLVRELARLLKEMTDRNRRLVEELEREIRKLIEDLRRRLREREVRRKVEDVERRVTKVLKELEDRSREVEEEVERVLRDLKRHSDEVRREVEEVLRRLTERTK

SEQ ID NO: 18894 - protein, 188 aa, Artificial Sequence; identical to SEQ ID NO: 18893
  Synthetic sequence.

SEQ ID NO: 18895 - protein, 175 aa, Artificial Sequence
  Synthetic sequence.
SEREKIAEDIRKLVDESRRNLEDVVRRARELAERVRRNLKRVMETLERLAEEIRRIIESGDRSDRVLRELKKLLDDIDKYLKENHRRLEELVKEIEKYLEDDHRRLRELIEDIRRKLSDDKDLERELKELLDKHKKDLDDVREEIRRMLETHKEELDRVKKRVEDVLREAAERTR

SEQ ID NO: 18896 - protein, 175 aa, Artificial Sequence; identical to SEQ ID NO: 18895
  Synthetic sequence.

SEQ ID NO: 18897 - protein, 175 aa, Artificial Sequence
  Synthetic sequence.
DERERIREEVRKLARESKENLKRTEEDLKRRLEEVKRNLERVDEEVERLVRTVAEIVRKGDKDDEVLRRADELLKRIEDYLKKNNDRLRELIERVERYLERDHRELERLIEEIEDRLRDDEELKKEAKKLLKEHRDKVKEIKEDLKRAHEEHRKRLEEVVEKLKRVLRDLAEKVR

SEQ ID NO: 18898 - protein, 175 aa, Artificial Sequence; identical to SEQ ID NO: 18897
  Synthetic sequence.

SEQ ID NO: 18899 - protein, 175 aa, Artificial Sequence
  Synthetic sequence.
SEREEIVKTLRELVKRVKENLKRVTEEARKLADESRRNLERVAEEIRKIAEEVKRIVERGDRSSRVLEEIERVVREIEKYLKEDHDRLRTLIKRIKDYLEENNRRLEELLKDIKDKLSDDKDLEKELEDVHREHKRRLDEVVREMEDLLRKHEDDLRKVKREAEKMLKELTETTK

SEQ ID NO: 18900 - protein, 175 aa, Artificial Sequence; identical to SEQ ID NO: 18899
  Synthetic sequence.

SEQ ID NO: 18901 - protein, 175 aa, Artificial Sequence
  Synthetic sequence.
SEREEIAERAERLSREVKKKLEDIRREIEELAKRVLDNLRRVLRDVERLIEEVKDIIRRGRRSSEVLKRLEDELRRIEKYLRENNERLKRLIDTIRDLLRRLHEEHRRLLEDIKRKLSDDKKLKDDLDRADEELERRARKVDEDLKELHERHRRLLEDVRRELERVIKELKEETE

SEQ ID NO: 18902 - protein, 175 aa, Artificial Sequence; identical to SEQ ID NO: 18901
  Synthetic sequence.

SEQ ID NO: 18903 - protein, 175 aa, Artificial Sequence
  Synthetic sequence.
SDRERIAKRARELSERVKEKLEEILKEVRKISKDMKKRLEDILREAEELSRRIKEIVESGDSSDEVLKEHRDLLREIKEKLERLHEDHRRVLEEIKKRLEELHKDHKRLLDDVDDKLRDDDELRKELEEVDDELRRKIEEIKKELETMDKELRDRAKEIEKRLEDSNREVEERRR

SEQ ID NO: 18904 - protein, 175 aa, Artificial Sequence; identical to SEQ ID NO: 18903
  Synthetic sequence.

SEQ ID NO: 18905 - protein, 175 aa, Artificial Sequence
  Synthetic sequence.
SEREEIAKTVRKLSREMKETLKKITEEARRLSEEVKRALKKIVDDLRELMKDVKRIVESGDRSDKVLRDARELVKRIVERLEELHERHRKLIEEIKKKLEDLHRTHRRLIEDVERKLKDDKDLKKELEDVDRELADTIRRVEEELKKVNEELRKRVEDVREEAERALRELEERVR

SEQ ID NO: 18906 - protein, 175 aa, Artificial Sequence; identical to SEQ ID NO: 18905
  Synthetic sequence.

SEQ ID NO: 18907 - protein, 175 aa, Artificial Sequence
  Synthetic sequence.
DERERIAEELKKLTEEIRRRVEDVMREAERLAEEIKRKLEDVLEEVRRLSDRIREIIESGDRSDEVLRRHRKLLERIREELKKILEELRRLVREIKEKLKELHERHKRLLDDVDRKLSDDDDLRREAEKVNRKVREDLKRIEDRMRELLKEVEDLLRKIEEEARKSNKELEDRTR

SEQ ID NO: 18908 - protein, 175 aa, Artificial Sequence; identical to SEQ ID NO: 18907
  Synthetic sequence.

SEQ ID NO: 18909 - protein, 178 aa, Artificial Sequence
  Synthetic sequence.
SEAEKAREDVERAAKESKDKLDEIRKEVEKAARESREEAKRNEKDIKDAAKKLRELARDKKADEKVARRAEKIVEDNERSAKEAADRSEETAKRARDKLRKAAEDSKRTAEKARRDAEKRGADRDVLEELRKIAEDDKRRVDKVARELRELAKRDKEEAKKVHDENKKSAKEAEDELR

SEQ ID NO: 18910 - protein, 178 aa, Artificial Sequence; identical to SEQ ID NO: 18909
  Synthetic sequence.

SEQ ID NO: 18911 - protein, 178 aa, Artificial Sequence
  Synthetic sequence.
SSDETLRRELEKAVEESRRLLEENRKTIEDMVRESKRLLDRNREEIKKLVEELKKLLRDNNLPKEVADDVREIVRRNEESVEKLIRDSKETVDRDRKSLEDVARESEETVRKLREDVDRRGVDRDVLREIRELLKRDKERLKEVHKRNRESAKRDKDRVKDVHRKNRDSARRVKERLR

SEQ ID NO: 18912 - protein, 178 aa, Artificial Sequence; identical to SEQ ID NO: 18911
  Synthetic sequence.

SEQ ID NO: 18913 - protein, 178 aa, Artificial Sequence
  Synthetic sequence.
SSDETARKEIEDMVRESKKLLEEIREELDRVVKRLRRELEENEKDIKRLVKRLRDLLRENNLPDEVERRIEKIVRENEKSVKDVAKEVEDIVRELRRLIEEAERRSEKTVRELREKLRREGVDRDVLREIRELAKRDKDTVKKVMEEIRDRLRKLDERIKEVHERNRRSLKDVEDKVR

SEQ ID NO: 18914 - protein, 178 aa, Artificial Sequence; identical to SEQ ID NO: 18913
  Synthetic sequence.

SEQ ID NO: 18915 - protein, 178 aa, Artificial Sequence
  Synthetic sequence.
DEDREAKRRLDEAVKESRDRLEEIRKEVEKMVRENEELNRRNEEEIRKAVEELRELLRRQKLPEDVVRKIEKIVEDNRESVKRNVDESRKIVKELRDLLKKLFEESEETVRELEDRLRKRGVDRDVLREIEEELTKDRKRVKEVLEELRRIAKRLKERDEESHERNRRSLDKLKKEVK

SEQ ID NO: 18916 - protein, 178 aa, Artificial Sequence; identical to SEQ ID NO: 18915
  Synthetic sequence.

SEQ ID NO: 18917 - protein, 178 aa, Artificial Sequence
  Synthetic sequence.
SSEDEARKEVDKMAKESEELLRRNEETIRRLVRENEEKNERNRREIERVVRELDRLLKERKLDRTVERKIREIVTRNKKSVDDNKKRSEDIVREDEESVDELVKDSKRTLDELRKKIKREGVDRDVLRELREIAERDKKKVEDVHRENRDSARRLKEEDDDSHRRNRKSMKEVKEDVE

SEQ ID NO: 18918 - protein, 178 aa, Artificial Sequence; identical to SEQ ID NO: 18917
  Synthetic sequence.

SEQ ID NO: 18919 - protein, 186 aa, Artificial Sequence
  Synthetic sequence.
REIEEVAKRLRKLVKELKERSKESKDRSRKLMTELKKLSKDSLRELRRLLDELRKILKDRRDSEETVKEVEERLKELLERNKRDSERVAREDKKLNDDNREESKKAAEELKKIVKELEDRNRGKRDVKKKLDEIRREVKKVIEEDKRLNDESEKDSRRLIREDEDENRRIKEEIDRAVEELRRRRK

SEQ ID NO: 18920 - protein, 186 aa, Artificial Sequence; identical to SEQ ID NO: 18919
  Synthetic sequence.

SEQ ID NO: 18921 - protein, 186 aa, Artificial Sequence
  Synthetic sequence.
SDIERVLEELRRLVERLKRETERFAKELRDLARRVKEMSKRSEEELRELATRLKDTLRRRKESKERVEEVKKRLREIIKRNKETSKRVAEELKRIVKESKDLSEEVARRLEEIIKRLEDRNRGKRDVEEKLRRIKRELREVIKEDEKRNREIEREVDKVIRELEKLNKRIEDEVRKLEEELERRLK

SEQ ID NO: 18922 - protein, 186 aa, Artificial Sequence; identical to SEQ ID NO: 18921
  Synthetic sequence.

SEQ ID NO: 18923 - protein, 186 aa, Artificial Sequence
  Synthetic sequence.
SDIERMRDRLRKLVEEAREKSDRSREELEKLVRELRRKTEKFLKELRDLARRLKETLKRRKDLADEVRKVIKELKEIIDESKKVSKKVADELKKLLEENREKSREVEETLRKLVKDLEDRNRGKRDVKEKLDRIRKEVEEVARDLKRKNDEIEEEIKKVIRDDERRNEEIEKEVRKMAEELRRTLK

SEQ ID NO: 18924 - protein, 186 aa, Artificial Sequence; identical to SEQ ID NO: 18923
  Synthetic sequence.

SEQ ID NO: 18925 - protein, 186 aa, Artificial Sequence
  Synthetic sequence.
SDIERVRKELRELLERVARRSEKSMRDDKKSMDDLKKEIREVEEELRRLATEVKKTLKDRRDSEDRVRKAIEDLERIIEELEKRVRRVEERNERTVEENKKESEKVAEDLKRIIDKLEERNRGKRDVKKKLEEIEREIREAIKDLRRKNREIERTNREVIKELREELKRIDTEVKKLVKELRETSK

SEQ ID NO: 18926 - protein, 186 aa, Artificial Sequence; identical to SEQ ID NO: 18925
  Synthetic sequence.

SEQ ID NO: 18927 - protein, 185 aa, Artificial Sequence
  Synthetic sequence.
SELEELERDLERELEEDKRRNEEVMERNERRLRKLKEDVDRVVKELEDLLRKLEKILREEKDKDTIRKILEEIEDEARKILEKVKRLIETIKRESEESNKRLRDENRESEERLERILRKVREDGAPESELERLDRRLKKLIKESRETVDEIEERSERAIRDLERKLKELEERLRKKIKELRDETR

SEQ ID NO: 18928 - protein, 185 aa, Artificial Sequence; identical to SEQ ID NO: 18927
  Synthetic sequence.

SEQ ID NO: 18929 - protein, 175 aa, Artificial Sequence
  Synthetic sequence.
DETKKVEDDLRRVDTESKKHLDDVHKESKRVADELRKKLEDVHRRSEEMVRRLRRLLEENRTDKRELERALDEVLRESEKVVEEIRRLLEKVLRDSERAMRENRRLLEKVKKEVEDVKIREEVKKRIDDALRENERRAEENRREIERVLKELEDRVDENRRRIEEVRKELRDRAT

SEQ ID NO: 18930 - protein, 175 aa, Artificial Sequence; identical to SEQ ID NO: 18929
  Synthetic sequence.

SEQ ID NO: 18931 - protein, 175 aa, Artificial Sequence
  Synthetic sequence.
DETREVDERLKEADRRSKKHLDDVHKTSKKVLDELRRKIEELERRVRKVVKELEELLRENRVEEEELKRRAEEVEREIDRIVKEVKDLLEEVKKRSDEVAKENEERLKKVKKDLDDNNIPEDVRRKVDKIIKENRKMLEDNKRTIEEVLRELKERADEIKERVKKVLKKLEEDRR

SEQ ID NO: 18932 - protein, 175 aa, Artificial Sequence; identical to SEQ ID NO: 18931
  Synthetic sequence.

SEQ ID NO: 18933 - protein, 175 aa, Artificial Sequence
  Synthetic sequence.
DEEEKVERDVERVDKESKEHLDRVHEETRDINRRSEEHLRRVHRDSEDVARRLRDAVRRRTVDERDVERALREVRKKSEDVVRKNEEELKRALEKSKEVVEKNERELRELLDRLEKLNIDEKVKRRVEEAIKRNRDEARRDEEEVKKAIKRNREEADRNRREIEKVVEELRRRAT

SEQ ID NO: 18934 - protein, 175 aa, Artificial Sequence; identical to SEQ ID NO: 18933
  Synthetic sequence.

SEQ ID NO: 18935 - protein, 177 aa, Artificial Sequence
  Synthetic sequence.
SEKEEVKRRVDEITKRARKKLEDVHRRSEKIDRDSREHLERVHKRTKEILDELRDELRKRRDEDVARRIEDIATKLRRESEEVAKRNEDLLDELRKESEEVSRDLERLLKELRKELDAFNVDEDLRRRLEKVFRELKETLDRNREEIDRMVKRNRKTLRDNKEEIDRAVREARERLK

SEQ ID NO: 18936 - protein, 177 aa, Artificial Sequence; identical to SEQ ID NO: 18935
  Synthetic sequence.

SEQ ID NO: 18937 - protein, 177 aa, Artificial Sequence
  Synthetic sequence.
REDEEVLKDLKRIVDELRKKLKELHDRSEEIDKRSKKHLDDARRRVEEIMRRIEKRLREERSDKVRETVERLAREVKKEIDDVKRRNERLLRELKKESEKVSREIEEILRRIEEKLERKNVDDKVRKDLKDVAKEMRDRLEENERRIREAAKRNRTELERIERELKEFKDRLDETAR

SEQ ID NO: 18938 - protein, 177 aa, Artificial Sequence; identical to SEQ ID NO: 18937
  Synthetic sequence.

SEQ ID NO: 18939 - protein, 177 aa, Artificial Sequence
  Synthetic sequence.
SEVEKVMEEAKRIVTELEEKIRELERKVKKIDEDSRRHLKEVHDRTAEIAKTLRDILRKERSEEVAKEIERLLTELEKESKDVARRNEDLLRRLEEEIRRVVEEIRKLLEELRKRLDDKNVDDKIRREIEEAVERLETEARRLRREVEEAVRRNREMLKRNEKEIKDVAKELRDRLR

SEQ ID NO: 18940 - protein, 177 aa, Artificial Sequence; identical to SEQ ID NO: 18939
  Synthetic sequence.

SEQ ID NO: 18941 - protein, 182 aa, Artificial Sequence
  Synthetic sequence.
REDDRIRDEIRKLVEDNRRLLREILERLKTLADRLREINKKSNDDNERSADELREVLKKVRSEEVKRLVERVVEENRDSNRKDREISKKVVRELEELIERLREESKRSAEELERLIEDVVRKKGRDLEEVRREVEKAIRDSKEKLDELEERVRRMIEESEKLVEDNHRRIEEVEREMEEALR

SEQ ID NO: 18942 - protein, 182 aa, Artificial Sequence; identical to SEQ ID NO: 18941
  Synthetic sequence.

SEQ ID NO: 18943 - protein, 182 aa, Artificial Sequence
  Synthetic sequence.
KDEEEIKKAIEELVKRNEDIVEEIKRRSDKLADDLRDINRRSNEDNDRSLKTLEELLRRVDSKDVKELVERVIKRNTDSNREDEERSKEVVRRDEKLNEDLRRISEDSARKLEDLIRKIVERSGRDLKEVRDRVRRAIEKSKEDLDKSEDDSRKVIEESKRLVEENHRRIRKAVRKAEEATR

SEQ ID NO: 18944 - protein, 182 aa, Artificial Sequence; identical to SEQ ID NO: 18943
  Synthetic sequence.

SEQ ID NO: 18945 - protein, 176 aa, Artificial Sequence
  Synthetic sequence.
SEEEEARKKLKEAADRNRKVNEDAKKKAEDAARKNKKANEELAKKLKDAAEELKRVSRDEREEALREAAKKAKKIAEDAKREAKKVAEETAKIAKEIEDELRKALEESKEIAKRLEDEGAAEEIKERAKEVLERHKRSAEKIKEEAKRVLDEHRKRARDWEEEARRVLKEAEEEAR

SEQ ID NO: 18946 - protein, 176 aa, Artificial Sequence; identical to SEQ ID NO: 18945
  Synthetic sequence.

SEQ ID NO: 18947 - protein, 176 aa, Artificial Sequence
  Synthetic sequence.
REEEEVRKEVKKLKKENEDVNDKVRRDLEELLERNRKVNKELEDKIRDAKRRADEMLRVEDKDVLRRVLEEIRRLIEELKKELEEVLRRSREIIEKIREDLERVLRESKKKIDELRRRGVTEEIEEELRKVLKEHKELVERWKREAEEVLEESKRLIDKWKEDLERVLEDFRRKAE

SEQ ID NO: 18948 - protein, 176 aa, Artificial Sequence; identical to SEQ ID NO: 18947
  Synthetic sequence.

SEQ ID NO: 18949 - protein, 175 aa, Artificial Sequence
  Synthetic sequence.
SEAEEIEKRLKEVLDRHDKSAREIKDRLRKVIEEHRKLVEEWEKEARDVVKELKDENSELKDVLRELERILREIVKRLEDVLRKTEKILKEIERRLEEVKRRTKEILDEIKELLRRGEDTRRLRERLRKMEEDNRKINKEIRDEVKELEKENREINKRVEEELKRVRDELKRTAD

SEQ ID NO: 18950 - protein, 175 aa, Artificial Sequence; identical to SEQ ID NO: 18949
  Synthetic sequence.

SEQ ID NO: 18951 - protein, 175 aa, Artificial Sequence
  Synthetic sequence.
DEVEDIKRELEEVVKEHEKSVEDDERKNEDVVRRHDELVKKWEEDLRRVIEKLKRDNKDAREVLEELKEILDRLKKEADEALERTRRMTERNKKTAEDVRRDTERILREIDELVRRGRDERDLRRRVKDLKRRNKEMNERSKKHSDEVKEENKRINEEVEKKLRDVKEKLDRDIK

SEQ ID NO: 18952 - protein, 175 aa, Artificial Sequence; identical to SEQ ID NO: 18951
  Synthetic sequence.

SEQ ID NO: 18953 - protein, 182 aa, Artificial Sequence
  Synthetic sequence.
SELEKLIKEVEDLAKEVADKLRKSNKELRELVRKIAKALEETNREIEKVVRRVKRLLESGDRSSKLLKELEEIIRRAAKAHKDILDELEELVKTAARAHERILEELERLAKEIEDKLRERGLDKSKLKKIKEDLKRIADEIRKIVEDSKRDLERVADEARKIVEKSKEDLKRAKEEAEKETK

SEQ ID NO: 18954 - protein, 182 aa, Artificial Sequence; identical to SEQ ID NO: 18953
  Synthetic sequence.

SEQ ID NO: 18955 - protein, 182 aa, Artificial Sequence
  Synthetic sequence.
DELDELTKRARELVERNRRHIERSNRELKRLVKEVLDRNRENHKTVEELVKTVLKLAKDGDKSDELLRRLEKLIRESEEHLERSHEELDRLIRKADKDHEKNTRDHRRLVEKIDDDLRREGVDRSDVERVRKELKDSTDDIKRLVDKSREDLKRAKEKDEKSVRDNRERLRRVLRRLEEEVR

SEQ ID NO: 18956 - protein, 182 aa, Artificial Sequence; identical to SEQ ID NO: 18955
  Synthetic sequence.

SEQ ID NO: 18957 - protein, 182 aa, Artificial Sequence
  Synthetic sequence.
SELEKLTKEVRDDVRRVMERLKRSNDDIRRLAEEVIRRNDESRKKLEKLVEEVKDLFRRGDKSDKLLREAERLIEEARKEHEKLLRELRELVKRVTRKHEEILREVEELVERIKRSLEEKGLDDSKVREIERELDEVRKRLEDLVRKSKEDLDRVREELERLVEKSKRDLDKARRDLDEARR

SEQ ID NO: 18958 - protein, 182 aa, Artificial Sequence; identical to SEQ ID NO: 18957
  Synthetic sequence.

SEQ ID NO: 18959 - protein, 182 aa, Artificial Sequence
  Synthetic sequence.
DELEELEKKVREDVRRVKEKMERSHRETEKLARDVKKRLEDTNREIKKLVKEVEDILRRGDKLDEVLRRLEELIRKVLKDHEDILRELAELVERVERRNEEILREAEKLVRDIERELERNNLDKSKVEKVRRDLDEARKRLEELDRRNRKRLEEVRKEIREIVEKSKEDLKRAKDRARETVR

SEQ ID NO: 18960 - protein, 182 aa, Artificial Sequence; identical to SEQ ID NO: 18959
  Synthetic sequence.

SEQ ID NO: 18961 - protein, 182 aa, Artificial Sequence
  Synthetic sequence.
SEAEALIEEVKTLVRRNKEHAKRSHEKTEKLVRDVADALRKTNDEARKLVEEVRRILESGDKASRVLKRLEDLARELARAHKEILRTLEELVRRAKRDNERNLDEHRKLIEEIERRLEKDGVDKSKLERLKRELTRSAEELRELDKRNEDELRRAAKRIRDIVRKSEEDLKKVRDDAREKTR

SEQ ID NO: 18962 - protein, 182 aa, Artificial Sequence; identical to SEQ ID NO: 18961
  Synthetic sequence.

SEQ ID NO: 18963 - protein, 182 aa, Artificial Sequence
  Synthetic sequence.
KDVEEVRKELDEIARRVTEEIKRVHDETARIVDRLRERLEKVTRDNRRSVRELEKELERNKEKAERVKEIVTRNRETTKRVKDEVRKIIRELERKSEELEKRVREIEEKLKELLKRLAERGVPEKKLREAKKRLDELAERLKRLIDRNREEIKRVAREADERIRENEKEVEEVEERLDRKIK

SEQ ID NO: 18964 - protein, 182 aa, Artificial Sequence; identical to SEQ ID NO: 18963
  Synthetic sequence.

SEQ ID NO: 18965 - protein, 182 aa, Artificial Sequence
  Synthetic sequence.
KDAEKVVEDLERKADAVMRKLEDVSRRHREIAKRIKDRLEKVHRDNEKSVEDLKRILKRNRESEEEVRRIVEENRRSSDELRKEVEKIVKEMEDTSREVAKDVEKIVRELREELKRLRERGVPEEIVRRAEKKVEDFERRLRKLIEDNKREVDKVEKELRDTIRRNEERIREAVEELKRTSD

SEQ ID NO: 18966 - protein, 182 aa, Artificial Sequence; identical to SEQ ID NO: 18965
  Synthetic sequence.

SEQ ID NO: 18967 - protein, 182 aa, Artificial Sequence
  Synthetic sequence.
EDVRRVVEELRKIAEDAKEKARRVHERDRERVRKVEEDAKKVHEENEESVTRLERLLDRRRESDKDVRKIVEDNERSSKEVERRLEEIVRRSRKHSTDVEEDLKRIVEELERKLRELATRGIPEDDVRRIREEVEKVRKDLKDIVKRNKEANDEVEKRLRDIVRRNRERIEEMRRRLEEKKR

SEQ ID NO: 18968 - protein, 182 aa, Artificial Sequence; identical to SEQ ID NO: 18967
  Synthetic sequence.

SEQ ID NO: 18969 - protein, 182 aa, Artificial Sequence
  Synthetic sequence.
EDVKRVVKELEDIAEEVRRRLEKVNRENRESMKRLEEELRKVHEENRESIERLKRTLKDRRESKEEVRKIITEDKKTSEELKRRVEEISERNKDTSRRLEEDVKRIIDKAREDLERLARRGIPEEIVKEAKERVDKVKDDLRRLIEENERDIRRMDRKLEDEIRRNDEELRRVVREAEETVR

SEQ ID NO: 18970 - protein, 182 aa, Artificial Sequence; identical to SEQ ID NO: 18969
  Synthetic sequence.

SEQ ID NO: 18971 - protein, 182 aa, Artificial Sequence
  Synthetic sequence.
SDVERVRRELREIAETVKERLREVNERNRKSVRDVEEIVKKVHEEDKDLARKVEEILERNREADEKVKKIVRESEETSKELERRLREIIKDNERTSKELEEEVRKITRELEKKLEDLARRGIPKERVDDIKREVDKAREDLRRLIEENKRDIKEVVERLEKLIKDNRDDNDRLRRRLEEKSR

SEQ ID NO: 18972 - protein, 182 aa, Artificial Sequence; identical to SEQ ID NO: 18971
  Synthetic sequence.

SEQ ID NO: 18973 - protein, 182 aa, Artificial Sequence
  Synthetic sequence.
SELEKVEKELKRIVDEVKKELKRVHEDDERLVRELEESLKKVTEDDRRLARELEDTLRKRRESEREVERIIDESRKTSEDLEKEVEDIVRTSEETSKKMEKRVRDIVRKLEETLRRLREAGIPEEDARRAEERVRRVVKELKELIERNKKRNKEAVERLRRLIEENKRENREVEKRARDTAR

SEQ ID NO: 18974 - protein, 182 aa, Artificial Sequence; identical to SEQ ID NO: 18973
  Synthetic sequence.

SEQ ID NO: 18975 - protein, 182 aa, Artificial Sequence
  Synthetic sequence.
KDAEEVLERLKKIAEEVAKELRDVDEENRRLLKRWAEILEEVTREDERLARELEERLERRREASEEVREIERRSRETSEELERTVRDVLRKDRKSSKELEERVREIIKRAREELKRLAERGVPEEKLRRAKEEVDRAEKELRELIKRNKDNLERAVRELEKLIEENERRNREVEKRLEDRER

SEQ ID NO: 18976 - protein, 182 aa, Artificial Sequence; identical to SEQ ID NO: 18975
  Synthetic sequence.

SEQ ID NO: 18977 - protein, 182 aa, Artificial Sequence
  Synthetic sequence.
KDVEDVVRRLEEIAKRVKERLKEVDKRNKDKAREWLKEVKEVHERNEKLAEEVRRTLKDNREKSEKVRKITEESKKSSDTVRKRLEDLSRDDKRSSEELRREVEKIVRELRDILRRLRERGIPEEIVREAEKRVREMERELRELIERNKRNVEEMDRRLEELIKENEERNKRVEEDLRRKTK

SEQ ID NO: 18978 - protein, 182 aa, Artificial Sequence; identical to SEQ ID NO: 18977
  Synthetic sequence.

SEQ ID NO: 18979 - protein, 181 aa, Artificial Sequence
  Synthetic sequence.
DEVEEAKRRLTELVDRLRKTLEKVSREDRELEERVRKITKDSHDTTEEILKRLKRELEKGVDKEEVERVREELEEITKRNEDESRRVIEESEESTKRLEEEVERVEREVRRLLEELRRRGVDEKDLRELEERVRRAVKKLRDDLRRNKKESEEVKKKLEDENKKNRDRVAEAEEELRRRTT

SEQ ID NO: 18980 - protein, 181 aa, Artificial Sequence; identical to SEQ ID NO: 18979
  Synthetic sequence.

SEQ ID NO: 18981 - protein, 181 aa, Artificial Sequence
  Synthetic sequence.
DEVREMLRTLDEIARRLKKRTKESIDTDRRLVKKLREETDKSIEDDKKLVKEVEELLDGGADEKIVREVIKRSRDLNRENKERSRKVIKESRELNKRNSEETKRVIEELRELLRKLKDDGVEERKLRELEKRIRKAEEELRRDNERSKKETEDVERDLERKNEESERRTREAEKRLKERSD

SEQ ID NO: 18982 - protein, 181 aa, Artificial Sequence; identical to SEQ ID NO: 18981
  Synthetic sequence.

SEQ ID NO: 18983 - protein, 181 aa, Artificial Sequence
  Synthetic sequence.
SEVEEVLKRLRDIARELEKLIEEVIRRDRKLVEELKRRSERSIETDRRLVKRLKEMLDGGADSKDVKRVIERSRELNDENTRESERVIEESERLNRELEERIKEVTERLRRLLKELRDRGADEEKVRRAEEEIREVERRLRKLLRDSKEETKEVVKELRRLNEESKKETEKVVREAEKRTK

SEQ ID NO: 18984 - protein, 181 aa, Artificial Sequence; identical to SEQ ID NO: 18983
  Synthetic sequence.

SEQ ID NO: 18985 - protein, 181 aa, Artificial Sequence
  Synthetic sequence.
KDAEEVVRRLTKLVEDLKRKIEEVIREDKELVDRVRDTSRKSDETLEKLVREVKKLLREGATSEILEKVIRELEEILKKNTEDSKDAIRKSRELNERLARDIERVIRELREIVKRLAERGVEEEKLKRLEDRVREAEKELRELLERSEDTTRRAERELEELNRRLEDKIRRVVEELKEESR

SEQ ID NO: 18986 - protein, 181 aa, Artificial Sequence; identical to SEQ ID NO: 18985
  Synthetic sequence.

SEQ ID NO: 18987 - protein, 181 aa, Artificial Sequence
  Synthetic sequence.
SEVEDVLRRLERLVRELEKETKRSLEENEKLARRLKKKLEDVVRDNKRLVDEVKELLKEGADERTLREIEKRSDDTLEELKRDVDRVIKESKETLEDNSRKTKEMIDRLRELVKRLRERGAEEEKLRRLEKLVRDAARRLKELNDRLRKRSKEVKEELERILRELKERSDRAKEDLRRAAK

SEQ ID NO: 18988 - protein, 181 aa, Artificial Sequence; identical to SEQ ID NO: 18987
  Synthetic sequence.

SEQ ID NO: 18989 - protein, 188 aa, Artificial Sequence
  Synthetic sequence.
SELEKVEKDLEKLIRDDEEENKRVLEELERLVREDKEKNKRVHDETRKLEDTLRRILEKSKDKDTIRKILKEIEDRLDDLNRKLHEKNRESTERLKRLIDELRRTNKRSVEELERLLKELAERLDKEEAKEKLRRLKERIREAEEKSRKSLRDIEETLKKVKRESEETDRRNRDTLRRAKKRLKDETR

SEQ ID NO: 18990 - protein, 188 aa, Artificial Sequence; identical to SEQ ID NO: 18989
  Synthetic sequence.

SEQ ID NO: 18991 - protein, 188 aa, Artificial Sequence
  Synthetic sequence.
DEVEEVKKTIRDLLRRNKEISRETLERLKKLVDENRERNKKVHDETKKLTEEIKKILEEIKDKDTLREILREIKERLKELNKRLHETNKRSREELEKILRENHEISKESVRRARKLLEDLRRRLDKEEAEKELRKLEKEVKDAKEESERSDRRLEKEIRDVERDSERSDRENRDEIRRVAEELDERSR

SEQ ID NO: 18992 - protein, 188 aa, Artificial Sequence; identical to SEQ ID NO: 18991
  Synthetic sequence.

SEQ ID NO: 18993 - protein, 188 aa, Artificial Sequence
  Synthetic sequence.
SEAEKVLRDLEELVRENEEKSERSLRELEKLVRDNEEKNKEVVKRIKDLAERIRRILEEIKDKDTLEKILRKIDDDARRLLERLERINRESDERLRRLNKRNEDLSRESVKRMEELIRDLERKLDDEDAKRKLEEIRKTLEEVKRRSEDSNRELRRRLEEVKRRSEKSLRDLEELVRRIKKELDDRSR

SEQ ID NO: 18994 - protein, 188 aa, Artificial Sequence; identical to SEQ ID NO: 18993
  Synthetic sequence.

SEQ ID NO: 18995 - protein, 185 aa, Artificial Sequence
  Synthetic sequence.
SEADKLREDLERRVREIEKRSRDSDKRLEELLEEIRRRSKRTLDELERRLREVEEELEREKDKETVDRLLKEVEERLRKILEDNKRLIEDITEKLRKILEENERLIREAVKELERLLEDLERKGVDKKKVDRVRDEVRKVKRKLEEEHKKLERKVREARKELEKSHRDLNREVKKAKERLDRKRD

SEQ ID NO: 18996 - protein, 185 aa, Artificial Sequence; identical to SEQ ID NO: 18995
  Synthetic sequence.

SEQ ID NO: 18997 - protein, 185 aa, Artificial Sequence
  Synthetic sequence.
DEVEKLRKELEDLAEKIKRESEKTLRELKKLADEIRKLSEDTLRRLKELLDRVEELLRETKDKETVRRLLEKVREELRKISEENRELIERLARRLDEIAKRNKELIERIARRADELLKRLKDKGVEERKVRELEKTVEKIKRELEKSHEDLNREVEKIKRDLERSHKELNELVKRAEERLRRETK

SEQ ID NO: 18998 - protein, 185 aa, Artificial Sequence; identical to SEQ ID NO: 18997
  Synthetic sequence.

SEQ ID NO: 18999 - protein, 185 aa, Artificial Sequence
  Synthetic sequence.
SRVEELKRRLEELIERIDRESKRTLKELKDLAREIKELSERTLRELERLAKEVKEELDRIKDKDTVRRVLEEAERMLKEISERNKRLIEDIARKADEIHKRNRELIEDIRRKLEEILRRLRTEGVDEEKVKELEERVRRVDEELERSNERLRREVKKIKEELKESHERLNKRVEEIRRELRERSR

SEQ ID NO: 19000 - protein, 185 aa, Artificial Sequence; identical to SEQ ID NO: 18999
  Synthetic sequence.

SEQ ID NO: 19001 - protein, 185 aa, Artificial Sequence
  Synthetic sequence.
DEAERLEEEIRRLAEEIKRLSKESLERVEKLLEEVRRESKRTLEDLERLVRDVEDKLRKIKDEDTVRELLKRVEDELRRILEENKKVIDDVEKELREINEENRRLIEDAARKLDTLLRDLERKGVDEEKVRRLKKRIDEIKEELKKSNEDLHRRIEEAKRELEELHERLNRDVERVKEKLRRDAK

SEQ ID NO: 19002 - protein, 185 aa, Artificial Sequence; identical to SEQ ID NO: 19001
  Synthetic sequence.

SEQ ID NO: 19003 - protein, 185 aa, Artificial Sequence
  Synthetic sequence.
RELEELLKTLEELLKKIEEESRRSLEELKRLVDDIRRKSEESLERLERLAERVKEVLDREKDKETVDRLLKEVARRADRINEENRELIDRARKELDRILRENAELIRKIVEELRRLLEKLKKDGAPKEKIDRLEKRVRDAKKRLEDLHRELNKRVEDVKRDLEESNKRLHDTVREIKKELRERTR

SEQ ID NO: 19004 - protein, 185 aa, Artificial Sequence; identical to SEQ ID NO: 19003
  Synthetic sequence.

SEQ ID NO: 19005 - protein, 185 aa, Artificial Sequence
  Synthetic sequence.
DEVRELEERIDRILKKIEDESRRTLEEIKKIAREVEKRSEDTLRELDDLVRRVEELLERIRDKETVDRLLKKAKKDLEDIHRRNREVIERAARELDRMLEENKRLIDKIIEELKRMLDELRKRGVDEKDVRRLEKKIREAEKRLRESNERLEKTIRDIKKRLEKLNKELKDRVDEVVKRLRDKTE

SEQ ID NO: 19006 - protein, 185 aa, Artificial Sequence; identical to SEQ ID NO: 19005
  Synthetic sequence.

SEQ ID NO: 19007 - protein, 185 aa, Artificial Sequence
  Synthetic sequence.
SELEELLERLKRRADEIRKESEKTLEELDRDARRIEKESRETLEELKKRLDDVRRALEETKDKETVRRLLEKVAEELKRISDRNERLIREAAKKLDKIHDRDRRLVEKAREELKKLLEELEREGVDKKKIDDLRRKVEEIEKDLKRSNDELRKRVKEIKDRLKELHDKLNEDVKRARKELEERRK

SEQ ID NO: 19008 - protein, 185 aa, Artificial Sequence; identical to SEQ ID NO: 19007
  Synthetic sequence.

SEQ ID NO: 19009 - protein, 185 aa, Artificial Sequence
  Synthetic sequence.
SEAEELLERLDRRLRRVEETSKRTLDELKRLLEDIERKSRKSLKELEDLVRKVKDMLRREKDRETVRRLLEEAREVLREINERNRKLVEDIRRLLEEIHRRDKELVERVRRELEKLLRDLERKGVDEKKIRDLERRVEEAARRLEKSNRDLAEEVERAERRLDRSNRELRRRVEKVLKELEDTER

SEQ ID NO: 19010 - protein, 185 aa, Artificial Sequence; identical to SEQ ID NO: 19009
  Synthetic sequence.

SEQ ID NO: 19011 - protein, 185 aa, Artificial Sequence
  Synthetic sequence.
SELEELEKRLEDLAREIKRRSRESLKELEELVKRIEETSKRTLDELKRLLDEVVKELRRIKDKETVRRLVEEVEKRLEEIHKEDEKLVREATERLRRINEENKRIVKEAVDELRRLLKELRKRGVPEEDIRRLEERVEKIREDLERLNRELHETVKRVKKRLEDSNRRLKEEVRKAKRRLDEELK

SEQ ID NO: 19012 - protein, 185 aa, Artificial Sequence; identical to SEQ ID NO: 19011
  Synthetic sequence.

SEQ ID NO: 19013 - protein, 185 aa, Artificial Sequence
  Synthetic sequence.
SEAEELTERIRKILKEIRELSEKSLRELRELVKTITELSKESVERLKRRVEEVKEELRRIKDKETVRKRLEDVERELERINKENRRLVEEAERRLREINKRNEKLVRDIKRELERMLRDLRRKGVDESKVRELEERIRRAEEELKKRNEDLHREVRKVLKELRDSNKELEKEVKRVKKELRDESR

SEQ ID NO: 19014 - protein, 185 aa, Artificial Sequence; identical to SEQ ID NO: 19013
  Synthetic sequence.

SEQ ID NO: 19015 - protein, 185 aa, Artificial Sequence
  Synthetic sequence.
SELEKLAEDLERLAEEIKRESDRSLEELRELAERIKRESRKTLEDVKKLLKEVKEVLDREKDKETVERLVRDVEKKLREINKRNRELVEKIARDMRRINEENRRLIEEIRRLAEELLKRLKDEGVDDKKIEDLRRRVEEIIKRLEKSNRDLRKEVEDIKRELEKLNKELHDTIREAKERLDRTTK

SEQ ID NO: 19016 - protein, 185 aa, Artificial Sequence; identical to SEQ ID NO: 19015
  Synthetic sequence.

SEQ ID NO: 19017 - protein, 186 aa, Artificial Sequence
  Synthetic sequence.
REVEELLKELEKVVRENEKKIEDLHKRNEDVVRKIEKDHRDSEKELKEVADRVRELLERKPNIDELLKRILEELKRIAEEVEKRNEEIIEELKERVRKSREDAKRSLEEHERIIRELERRLEERGVREDDVRRLKKRAEESLKKIEDDLRRDEDRLRRVIEKSKRLVDKLREELERVLREIEKRIR

SEQ ID NO: 19018 - protein, 186 aa, Artificial Sequence; identical to SEQ ID NO: 19017
  Synthetic sequence.

SEQ ID NO: 19019 - protein, 186 aa, Artificial Sequence
  Synthetic sequence.
SEAEKLKEDLDRVVEKVKEDLKRLHDENRRVAEKNERVIEELHRRNREVTKELEKRLEEKKDDKEELERIIREAEEIVKKSLKRLKESLEEHRKIIEDSKRELRKILERLKKIIEELDDRLRKRGVEEEKVKRLRDAVRKVLKEIEEELERDERAVAKTLRKIEELLKRDKKELDKVRKRLEERLR

SEQ ID NO: 19020 - protein, 186 aa, Artificial Sequence; identical to SEQ ID NO: 19019
  Synthetic sequence.

SEQ ID NO: 19021 - protein, 186 aa, Artificial Sequence
  Synthetic sequence.
SEAEKIEEELRRAAETAKKRHEDSERELEEAAKTAEERAKRIHDRNERAAEEAKKRAEDDKDADELAKRILEELERIARKSEEDLKRILEELRKIAEDAEKRNREINEELKEIAKRAEDRLRKRGAEEEKATRIKREADEARKESKKLAEKLKKRADEARRKLEEEAKRDKERADRAAKEIEDRAR

SEQ ID NO: 19022 - protein, 186 aa, Artificial Sequence; identical to SEQ ID NO: 19021
  Synthetic sequence.

SEQ ID NO: 19023 - protein, 186 aa, Artificial Sequence
  Synthetic sequence.
SEVEKLKEDLKRVVERVKRDHERSLKRLEDVAREVEKRIRDLHERSKDVMRRLKDLIDKKKDDTELLERIIRDAARIVKESKDRLREILRDLEKIIEDLKRENEEINRDLRRIVKELKERLDERGVEEDELRKLAEDIKRAEDESRKLVERLKKKAEEVRRKIKKLLEENEEELKRILDRLREAAK

SEQ ID NO: 19024 - protein, 186 aa, Artificial Sequence; identical to SEQ ID NO: 19023
  Synthetic sequence.

SEQ ID NO: 19025 - protein, 186 aa, Artificial Sequence
  Synthetic sequence.
SEVEELLERLKKVADDIRREIEKLHKRTKEVADEVRKRHEDSRRELEKVADEVRDRIEKDKDADELLERILRELREIIKRLRERNERINRELRRIAEESERELKRILDEARKIVKELRDRAERRGVDSKALKRLSDEIKKIEDEIRKLLEDNRREVEEAEKESRKLVEELERRAKEVEEEIKRARD

SEQ ID NO: 19026 - protein, 186 aa, Artificial Sequence; identical to SEQ ID NO: 19025
  Synthetic sequence.

SEQ ID NO: 19027 - protein, 186 aa, Artificial Sequence
  Synthetic sequence.
SEVEKILEDLKRVVDEVRKRHKESLDRNKKVADEVRELHERSDKELEDVVREVKDKLEKNKTDKKLLEDIRRELREIVDRVRRDNERINRELKKISDKLDKENEDINRELREIAERVRDKLRKDGIDSKDVKRIEDELRKANEESRRLVEELRKHSEDVNRESRKLVEDLERKLRKAEKDIEDDAR

SEQ ID NO: 19028 - protein, 186 aa, Artificial Sequence; identical to SEQ ID NO: 19027
  Synthetic sequence.

SEQ ID NO: 19029 - protein, 186 aa, Artificial Sequence
  Synthetic sequence.
SEVEDLLRRLKEVVEEVERLIKKLHKETKEVVDEVRRLHEKSLRELKKAADDARDALRRNKDITELLDTIIRDARRILEELARRNEEINEKLKRIADRSAKRLEEILERLRRIIEELKDELRKRGVEEEKVRRLAEEVKRALDRIKELIKRNRDELKRANEESKRLVERLREEAERILRDLRRKLD

SEQ ID NO: 19030 - protein, 186 aa, Artificial Sequence; identical to SEQ ID NO: 19029
  Synthetic sequence.

SEQ ID NO: 19031 - protein, 186 aa, Artificial Sequence
  Synthetic sequence.
SEVEKIKKDLEKVADEVRRLHKESLDRLKKVVREVEERLKRLHEESEKVAKDVRRKVEEKKDDKDRLKKILDELREIIERSIRAFKKILDELEEIIKRLREENEEINRRLKEIAEEVEDRLRKRGVDEREVKKIKDDLDRVNEESRRLVEKLERDVTRVRKKIKEELKKNADRLKEVEEDIKRRAK

SEQ ID NO: 19032 - protein, 186 aa, Artificial Sequence; identical to SEQ ID NO: 19031
  Synthetic sequence.

SEQ ID NO: 19033 - protein, 186 aa, Artificial Sequence
  Synthetic sequence.
SEVEELERELKEVVDRVRKLHRESLERNREVVRKVDEDIKKLHRESEEVAKEVEKLIEEVKDDTDKLRKILERLREIAERSRRTLTEILKRLEKISRELLEENKKINEELKRILEDLIRRLRERGVDERDLKRLEDEARKANKESRDLVREIERHSREAMKRIEEELRRNKERLERVLKKIEDKAR

SEQ ID NO: 19034 - protein, 186 aa, Artificial Sequence; identical to SEQ ID NO: 19033
  Synthetic sequence.

SEQ ID NO: 19035 - protein, 186 aa, Artificial Sequence
  Synthetic sequence.
SEVEKLLEDLKRVAREVEKLLEDLHRRTDEVMKRNEDDIRRLHEESDRVVKRVKDEIEKKKDDTDRLREILRRLEEIAKKSDEDLRRSLDEHDKIVKKSEEDMERILRELRKIIEDLERRLRERGVDERDLKRLKDEAKRIEDKIRELLERNREKARRTKEKIKKLVERNRRELEKVLDEIRRRIK

SEQ ID NO: 19036 - protein, 186 aa, Artificial Sequence; identical to SEQ ID NO: 19035
  Synthetic sequence.

SEQ ID NO: 19037 - protein, 178 aa, Artificial Sequence
  Synthetic sequence.
KEVEDVEKRNREVHRRIEKLIEENERRLKEVRDRIRKLVREIEDLNRRVREEVDRRNAPEEVRKELEEVTERSRRMARDIERLLDKATKESRDNVREVKADLKRVTEETRRLAEELKDVEEVLRDLLRRNEEVVKRVEDNLRRDTERLEKVAKDVEKKLREVLKRNKEMVDEVRKKTK

SEQ ID NO: 19038 - protein, 178 aa, Artificial Sequence; identical to SEQ ID NO: 19037
  Synthetic sequence.

SEQ ID NO: 19039 - protein, 175 aa, Artificial Sequence
  Synthetic sequence.
SEEEDVLRKLEKIVTDLRETLKRMHEDSERIVEESRKHARKVHEDSKKIVRELKKVLDEKRVDRREVERTVRDVIRRSEEVFERNRDLLRRLKEKSEEIARRIEKKLKEVKDRLEEARVPEEVRRRVEEIRREIERELKRNRERLEEVERENRKLLRENKEELDKVEKDLRDTAE

SEQ ID NO: 19040 - protein, 175 aa, Artificial Sequence; identical to SEQ ID NO: 19039
  Synthetic sequence.

SEQ ID NO: 19041 - protein, 180 aa, Artificial Sequence
  Synthetic sequence.
DDIKRLEDEVRKAAEENKDEVRKNREELKRIKDEIDKLVKDVEETIRRAEDEIRKRVKDKETLERMEKLLREVKKEVDEVVKELDELLRRLEEKSRRVVEENKKLLDTIRKRLKDVSNTEDKRVMEKVLRELKEIVDRSRDHLRRVHEDSKRIADELRRKIEELLKRIKKVVDELREAIR

SEQ ID NO: 19042 - protein, 180 aa, Artificial Sequence; identical to SEQ ID NO: 19041
  Synthetic sequence.

SEQ ID NO: 19043 - protein, 184 aa, Artificial Sequence
  Synthetic sequence.
DDLRRIEKELKRLADRARKINRESDERIKKLEEEIRRINEDSLRRDRDLARRLREMLKRVRSREVEERLKRITDRSRELNEENERRNRRVEERLEKLLKENEDENEKVIRDLERLVEELIRKEGDTREVKKLKEDLDRVKRELEKLNEEIRDRIRRVKEELKRLNDRSKKHTKEVEEEVERRKK

SEQ ID NO: 19044 - protein, 184 aa, Artificial Sequence; identical to SEQ ID NO: 19043
  Synthetic sequence.

SEQ ID NO: 19045 - protein, 184 aa, Artificial Sequence
  Synthetic sequence.
SEAEDILRRIKRLADENRRILKEILDRIKELADRVRKINEDSLRTLRKLAEELRRVAEKVRSEEVVRRLERIIRELRRLLEENKRRNEEIIRELRRLLDELRRRSEDTVRKIRKLLEDLIRKKGRSEKAERLEREVRKIEKESREMLKRIEDEIRKVEEDLRRLNEELERDVRRVEEEVKRAAD

SEQ ID NO: 19046 - protein, 184 aa, Artificial Sequence; identical to SEQ ID NO: 19045
  Synthetic sequence.

SEQ ID NO: 19047 - protein, 184 aa, Artificial Sequence
  Synthetic sequence.
DELDDIRRRLEKLEEEAERINRESEKRDRELARRIREINKRSKEEDRRLAKEVDEILRRVRSEEVKDLLRRITEESKKLNEENSRRNEEVDKESKRLNEENEKTNRDMIRKLRELLKDLIDKKGRTEAVEELRKKIEEVEKKLRRLNEKSKKHTKDVRDELRRLNEDSKRHTDEVKDRLEEATR

SEQ ID NO: 19048 - protein, 184 aa, Artificial Sequence; identical to SEQ ID NO: 19047
  Synthetic sequence.

SEQ ID NO: 19049 - protein, 184 aa, Artificial Sequence
  Synthetic sequence.
DELRKIREDLKRLATEAREINKRSDEDIKRLTDDVRRINKESLERLKKLADDLRDALRKVRSKDVKRTLEEIIRRARKLVEDDKRTNRKIIEELKELLDRNRRINERIARELERLLEDLIRKKGRTEAVKELEEEIRKVKEELKKLNKEIEDKIRDVERELRETNKRLEDEVRRVEEEVRRATK

SEQ ID NO: 19050 - protein, 184 aa, Artificial Sequence; identical to SEQ ID NO: 19049
  Synthetic sequence.

SEQ ID NO: 19051 - protein, 184 aa, Artificial Sequence
  Synthetic sequence.
DDAERILDEIRRLTEELREINKESLKKVERLAERIREINKDSLRRDKELADRLRRMLEEVRGEEVKEILRRVDKESEDLNRRNSEINKRVTDEIRKLVEDNSRRNREAEKELKKLMDDLIRKTGRTEKVERIERTIRKVARELEKLNEDIRKRVDEVEEELKKLNKESEDHTRRVREEVRRRTQ

SEQ ID NO: 19052 - protein, 184 aa, Artificial Sequence; identical to SEQ ID NO: 19051
  Synthetic sequence.

SEQ ID NO: 19053 - protein, 184 aa, Artificial Sequence
  Synthetic sequence.
SELETVEERLKRLEEEIRRLLEKVDRDLDRLADEVRKKNKRSHERNKEIEDRIDKLLKDGKDDETVRRVAEELRRTLRRNEEENRRVAEELERILRELRKVVEDIKKRLEDLLKELKDRVDKEELKKMLRKLEERVKEVTRELEDLLKKAEEKVRRVKDELRRSNKKDEDRLREVEEKLREDSR

SEQ ID NO: 19054 - protein, 184 aa, Artificial Sequence; identical to SEQ ID NO: 19053
  Synthetic sequence.

SEQ ID NO: 19055 - protein, 184 aa, Artificial Sequence
  Synthetic sequence.
SELEEVRKRAKDIADEDRELNRRVHEENKRLADDVRRKNEKSHRDNERIATELRELLRDGKDDRVVRRVEEELKRTLEKNKRDNDRVVEDLKRTLDRLKELNDRSVEKLERLLKELEDRVDKEELKKLLDELRKRVEDVKEESKRSLDRDRRELERVKKELDDSNDEDRKRIEEVIKEVRDRSK

SEQ ID NO: 19056 - protein, 184 aa, Artificial Sequence; identical to SEQ ID NO: 19055
  Synthetic sequence.

SEQ ID NO: 19057 - protein, 178 aa, Artificial Sequence
  Synthetic sequence.
DEEREVKERLKELIERLRRLHEESLRELKRIADELRRLHEESHKRNEDIARELERLLAEVKDKKVVEELVKRIIERLEKSLEDDRDLSRRAIEELKRLLDEDRKLSEDAKKRLKDLLDTVPRIDELERRVRKVEEESKKLHEEIRKRIEEIERESRKLHEDDRRRIEEVLKRIKDAVR

SEQ ID NO: 19058 - protein, 178 aa, Artificial Sequence; identical to SEQ ID NO: 19057
  Synthetic sequence.

SEQ ID NO: 19059 - protein, 178 aa, Artificial Sequence
  Synthetic sequence.
SDEDRLREEAKKVADELRKLHEESHKRNKEIADELRKLHKKSHDDNKRIADEITELLKRTKDKRTLEKLIEEARKKLEESLRRDAEISKKIAEDLERSLREDAKISEDIRRRLKKLLEEVDKIEELRDRLRRVEEESRELHKRDREEVERIRRESEKLHREDREDVKRIEKKLRDDAR

SEQ ID NO: 19060 - protein, 178 aa, Artificial Sequence; identical to SEQ ID NO: 19059
  Synthetic sequence.

SEQ ID NO: 19061 - protein, 183 aa, Artificial Sequence
  Synthetic sequence.
DEAEKVLEELRRRAEKVLREVKKVLEDHKRLADELRKELKRVSDENRDSLRRLLEEIDRNKELKESVKKILDENRESSERLEDTVRKILKESKDRTKELEDKLETILEDLRRKLEDVERRGVLDEDLLRRLRELLDEIRKELRDLIRKLRELNDRVERDLRRIIRENRELVRRAEKELEDRTR

SEQ ID NO: 19062 - protein, 183 aa, Artificial Sequence; identical to SEQ ID NO: 19061
  Synthetic sequence.

SEQ ID NO: 19063 - protein, 183 aa, Artificial Sequence
  Synthetic sequence.
DEAEEVLERIKDLARKNEEKNRRVLEEHEKLIRESEERDEKSSRDNKRSVDEIRDIIRRKRESKDELKKILDDNKRSSEENMRRVKRINDESKKRTDELEEESRRVLEKVEKEVEDLARSGLVEEEKIKRIRDELARWAEKIKKTIDELRKLNKEAHDRNRKTIKENEDLVREAKEDLERKTT

SEQ ID NO: 19064 - protein, 183 aa, Artificial Sequence; identical to SEQ ID NO: 19063
  Synthetic sequence.

SEQ ID NO: 19065 - protein, 185 aa, Artificial Sequence
  Synthetic sequence.
SEAEEVLKEIKKLADELRKKNRESVEKVRESSKRLKDEIRKVLEDIKRLAEKLREILREMKDKDTIRKTIEDITEKLKELLDRLRERIEKAKRDHERLVERNRRENDKIRKDLERLLEELRKRGVDEKLLRELEKLIRDIKRELDRSDEKLEELVRRSAKELDDLLDTLREIIERIKRDLDEKLR

SEQ ID NO: 19066 - protein, 185 aa, Artificial Sequence; identical to SEQ ID NO: 19065
  Synthetic sequence.

SEQ ID NO: 19067 - protein, 185 aa, Artificial Sequence
  Synthetic sequence.
REAEEVLKRIKELADEIRKRNRESLERIRKSSEDLKRENEDSIRRVRELIDTLRRRLEKEKDKKTIEEIVKEIDKRLKELLDRNRRRNEEAVKEHEELLKENRKENEEILRDAERLLRDLERKGVPKELVDRIRDLIRRIKDELKESDDRIKELIDKSKEDLDKSDEDLKREIDKAREELAKAIK

SEQ ID NO: 19068 - protein, 185 aa, Artificial Sequence; identical to SEQ ID NO: 19067
  Synthetic sequence.

SEQ ID NO: 19069 - protein, 182 aa, Artificial Sequence
  Synthetic sequence.
DEVEELLKEVEELAREIVERLEKNLRDTKKLIDEIEEYARRNEERTRKLIEEAERLARRGDKSDDLKREVEKLLKESEDNVERLIRELEKLLEESRRNVKRIIDELRKRLDDVRRRLEERRADEELERRLRRLLEELERRLKRLEDEHRRLVEEVRDKLRKIEETHREIVERVRRTLDEEKR

SEQ ID NO: 19070 - protein, 182 aa, Artificial Sequence; identical to SEQ ID NO: 19069
  Synthetic sequence.

SEQ ID NO: 19071 - protein, 182 aa, Artificial Sequence
  Synthetic sequence.
DDARRLLEEVKELLERSKRHLTKNLEDTRRLIKELLDYARRNLEDTRRLIEEVLDLLKRGRRSDELMRRLERLLRESEENVKRLIKALRDLLKESKENVDRNIKRSEELLRRVEELADRRRLPEEVKETLKRLLDEIRRENEKVARDHKKLVDDVERELEDIERRHKELVDRARKVAEDEKK

SEQ ID NO: 19072 - protein, 182 aa, Artificial Sequence; identical to SEQ ID NO: 19071
  Synthetic sequence.

SEQ ID NO: 19073 - protein, 182 aa, Artificial Sequence
  Synthetic sequence.
SDAERILDEVRKLVEDSKRHLDENLKRTAELSKRSKEYAEENLDRTRRLAKEAADIARRGDKADEVLTRLEELLERSERNVRRLIEENEELLRESEENVRRNIKESEELLRKVERLIDESRLPEKVKEDLKRLLDEIRKENKRAEDAHRDLARRSREELEKAERKHKELVDRIRKALEEIKK

SEQ ID NO: 19074 - protein, 182 aa, Artificial Sequence; identical to SEQ ID NO: 19073
  Synthetic sequence.

SEQ ID NO: 19075 - protein, 182 aa, Artificial Sequence
  Synthetic sequence.
DEVRKLLKDVRELAREIERRLEENLRRSEELLKRIEDYLRKNLEDTRRLIEEVKELADRGDKVDKLLEDVERLLRESEENVERLIKELEKLLRDSEESVDRIIRELEDLLRKVEKRADDNNLEEEFKDRLRRLMKRIKERLEDVKRRHKELVKKARKSLEEVKRRHRKLVEDVRRTLEEEKR

SEQ ID NO: 19076 - protein, 182 aa, Artificial Sequence; identical to SEQ ID NO: 19075
  Synthetic sequence.

SEQ ID NO: 19077 - protein, 182 aa, Artificial Sequence
  Synthetic sequence.
DEARKILEDLKRLAEESIRHLEENLRRSEKLVEDVERYAEENLERTKKLVRDVDEIIRRGDNVDKVAKELRKLLKESEDNVKRLIEELERLLRESEESVDRNITKSEEILRRVEELVDKNRLPEEVKKRLEDLAREIRKANEDVKRRHKKLVDDVRKRLKEIEKKHRDLVRKIEEKLRDARK

SEQ ID NO: 19078 - protein, 182 aa, Artificial Sequence; identical to SEQ ID NO: 19077
  Synthetic sequence.

SEQ ID NO: 19079 - protein, 182 aa, Artificial Sequence
  Synthetic sequence.
SEAEELLKTVRDLVEKSRKHLKENLKRSEELSRKSKEYADKNLERTKRLVKTVADILDRGDRTDEVIKELRRLLKESLDNVRRLIETNRRLLEESKKSVKRNIDESERLLREAEEKLRRDRVDKKLEDELRRLVEEAKRENDEVRREHKRLVEDSERKLEKIERDHRELVDRVEKEMREKKR

SEQ ID NO: 19080 - protein, 182 aa, Artificial Sequence; identical to SEQ ID NO: 19079
  Synthetic sequence.

SEQ ID NO: 19081 - protein, 182 aa, Artificial Sequence
  Synthetic sequence.
SDVERILEDLDRVVKESKRHLEENLRRSEKLTREVEEELKRNLKESEELVKRVEDIARNGDRVDEVLERLKELLKRSERTVEKLIDDLRRLLDESRESVDKNIKESEEILRRVEEDLERRNASEDAKRRLRELVEKVKEDNKKVKEEHDDLVRKVERRLEEIRKRHEELVRRIRRRLEEEKR

SEQ ID NO: 19082 - protein, 182 aa, Artificial Sequence; identical to SEQ ID NO: 19081
  Synthetic sequence.

SEQ ID NO: 19083 - protein, 182 aa, Artificial Sequence
  Synthetic sequence.
SDVEELLRRLEELLKESEKHLTENLRRSEKLVRDSKRHLDENLKRSKDLAREVVRLAEKGDRVDRLKEDVERRLRKSEETVRRNIEESERLLRESEKSVKDNIRESEKLLRDVEKKLDDRNIDRKVKERARELVERIKRRNEKVERDHEELAREVRERNKEVEKRHRDLVEELRRRLDERKR

SEQ ID NO: 19084 - protein, 182 aa, Artificial Sequence; identical to SEQ ID NO: 19083
  Synthetic sequence.

SEQ ID NO: 19085 - protein, 182 aa, Artificial Sequence
  Synthetic sequence.
SEAEELLERVKKLTDESLRYLEENLDRLRKLVKESEDHLKDNLRKSEKRVREVIDLARRGDTTDELTERVEELLKRSEETVRDNIRKSERLLRESKENVERLIRDNERLLREVDEELKRRNLDKDMEDKLRRLVEESRRALEEVLKRHEDLVEEVRKSNDKVRKEHEELVKRVRDALREIKR

SEQ ID NO: 19086 - protein, 182 aa, Artificial Sequence; identical to SEQ ID NO: 19085
  Synthetic sequence.

SEQ ID NO: 19087 - protein, 181 aa, Artificial Sequence
  Synthetic sequence.
SVEERLEKLLKEAEERLRESEDRTRKLVEEVRRELEKLKKRSKELADRVREELRKFPKSEDLDRILKELEEVVKRVEDTHEESRRRIEDVVRKVEKKHEESRRELKRVADEVRKRLEEKKTDEEELEKILDTLRRIAEKLVRKNEDILRRLKEIVKKVIRENEEILRRLEEIAKELAKRLE

SEQ ID NO: 19088 - protein, 181 aa, Artificial Sequence; identical to SEQ ID NO: 19087
  Synthetic sequence.

SEQ ID NO: 19089 - protein, 181 aa, Artificial Sequence
  Synthetic sequence.
SLDEEAKRVVEEVRKRLRESKERSREIVERARRELERLKEESKRLADRIREEVKKFRDDEELERILRELEEVLKDVERKHRESKKEIEDVVERIKEEHEKSERELEEVIKRIDEALERNKDDTELVKRLLDDLRRIIRELEEKNRALNETLRKIVEEAIKKNREILEELREEVDRVRKRLK

SEQ ID NO: 19090 - protein, 181 aa, Artificial Sequence; identical to SEQ ID NO: 19089
  Synthetic sequence.

SEQ ID NO: 19091 - protein, 175 aa, Artificial Sequence
  Synthetic sequence.
SEVEKVLREAREILKKNKRENEEVHKKSKEIAERNREKNEKVHRDSRKIIEELKELADRGKDARELDEAVKRLADENRRVNEDSERDIKRLAEENRRVNDESRKDIERLVRKLEKDGVDEDEARKLVKEVRETLEDSARRDEKLIEDLKRTLDESKKEDDKLIEELERRLREAER

SEQ ID NO: 19092 - protein, 175 aa, Artificial Sequence; identical to SEQ ID NO: 19091
  Synthetic sequence.

SEQ ID NO: 19093 - protein, 175 aa, Artificial Sequence
  Synthetic sequence.
SEVEKVLREAEEIAKKNEEDNRRVNDRSEKIIEENERRNRKVHKESEDIVRDLERLAAEGKDARDLERKARELVKRNKEVNDTSRRDLERLVKENRDVNKESREDIERLVKELEKAGVDEEEVRKLVEKLERLLEKSKRDDEESIKKARELLRRSEEADKKLIREAEEAIRTRKK

SEQ ID NO: 19094 - protein, 175 aa, Artificial Sequence; identical to SEQ ID NO: 19093
  Synthetic sequence.

SEQ ID NO: 19095 - protein, 186 aa, Artificial Sequence
  Synthetic sequence.
SRLEELLKKAKKLVEDVEDTNRKMLEKLRKLADDLRRINKRVLDELERLARELEDIARKIRDKDTLKDILRRMEDELRRLLKKLEEDNRRIIEELRRLLKEIHDTNREVLERLKELLRRVKEEVKEAEEVLRELKKLLDEAKKKLEEIDKRLEDELRKIEDDLRRSNERVRRLLEEVRRRIKEETD

SEQ ID NO: 19096 - protein, 186 aa, Artificial Sequence; identical to SEQ ID NO: 19095
  Synthetic sequence.

SEQ ID NO: 19097 - protein, 186 aa, Artificial Sequence
  Synthetic sequence.
DELEEMLKRLEKLARDLDRINKEVLRRVEEEVRKLEEENEEVLRTLRRLAEEVERILDEIEDKKTLEKIIRDIEEELRRLLRTIHERNKKALDELRELLERLRRTNEEIKKTLRKLIEDIREEVKEAKEVLDKLEKLLEDIARELEKSNRRLEELLKEVERRLREMDERLRKELEEVKRRLEEKRR

SEQ ID NO: 19098 - protein, 186 aa, Artificial Sequence; identical to SEQ ID NO: 19097
  Synthetic sequence.

SEQ ID NO: 19099 - protein, 186 aa, Artificial Sequence
  Synthetic sequence.
SRVEKVLEELKELMKELDDSNRRVLEELERLVRENTRRNEEVLRRVRELAERLKDELDKIKDKDTLDKRLKEIEKELRKLVEDLRRLNEETIKTLEKLLREVREENERVIEELKRLLRELKEEVKEAEELLRRAKELLKRIKERLEESDRRLKRLLDEARKRSEDIIRALEKLLRDVKRELEEKLR

SEQ ID NO: 19100 - protein, 186 aa, Artificial Sequence; identical to SEQ ID NO: 19099
  Synthetic sequence.

SEQ ID NO: 19101 - protein, 186 aa, Artificial Sequence
  Synthetic sequence.
KDAERLFEDLRRLVDENREKNEKVLREIEERVERLERENEKVLRDLEDLIRRVREEIDRTKDKETLRRIIEEILRRLAELVKTLRERNKRVLEELEKLLRKVRELNKETIRRLEELLERMRERVKEAEEMLRELKKLLDRAREESRRIIEELERTLEKVKERLDRTDKEIEELLKRAEEELREKER

SEQ ID NO: 19102 - protein, 186 aa, Artificial Sequence; identical to SEQ ID NO: 19101
  Synthetic sequence.

SEQ ID NO: 19103 - protein, 186 aa, Artificial Sequence
  Synthetic sequence.
DDLERLLKEVKERIDEVKRRNEEVLKRLRELVKRNKEKNDRVLREAEKLMKKLRDIVRKIKDKDTLRRILEEIKKRLKELLDTVRELNKRTIEELEKLLRDLDRENKRIREELEKLLRDIKEKVKEAEEVLRRLRELLRTAERELEESNRRAEELLKDARRKSEEIIRRLERLLEEVDRDIKRALK

SEQ ID NO: 19104 - protein, 186 aa, Artificial Sequence; identical to SEQ ID NO: 19103
  Synthetic sequence.

SEQ ID NO: 19105 - protein, 185 aa, Artificial Sequence
  Synthetic sequence.
DDVRELLRTLRKISEDTLRRVEEINRKLERLSRETLKRVEDINRKVKELMEEVLKELDRIKDKKTLKDVIREAKKRLDETLERLERVIRESEKRARDTLRELEKVIEDSRKTVEELKKELERRGVEEDALRELKRLVDDNETKLRRLRDTHRELLERNRTELEKLKRTHKKLVDEAEEELRKKDK

SEQ ID NO: 19106 - protein, 185 aa, Artificial Sequence; identical to SEQ ID NO: 19105
  Synthetic sequence.

SEQ ID NO: 19107 - protein, 185 aa, Artificial Sequence
  Synthetic sequence.
SDVERLLEKLRDLSRRTVRELERINEEVREIIKTLKKELDRTNKELRDIIEEIKKELDKIKDKRTLEKIVDRLDKELKRSLEEDRKVVEDAKRLLDDTLRKLEEVIRRSKELLERILRELERRGVDEKLLDELRRLLEENEKTLEDVRRTHEELVKRAKRELEKNIEEHERLVRDVKEKLERKIR

SEQ ID NO: 19108 - protein, 185 aa, Artificial Sequence; identical to SEQ ID NO: 19107
  Synthetic sequence.

SEQ ID NO: 19109 - protein, 185 aa, Artificial Sequence
  Synthetic sequence.
SDAEELLKEAREVSKRTKDTLDEINKDVKRISEETKKRLKKTNEEIKEIADRLRKELERIKDKKTLEDVVREVERRLEDSLRRDRKIVEESRRRLKETLDRLEKVIRDSERRLKEILEELERRGVSEDILRELKKLVDDNRKTLKEVLETHEELLRDNSRKLERNVERHAKLVRDIKEELKETTR

SEQ ID NO: 19110 - protein, 185 aa, Artificial Sequence; identical to SEQ ID NO: 19109
  Synthetic sequence.

SEQ ID NO: 19111 - protein, 185 aa, Artificial Sequence
  Synthetic sequence.
SDAERLLKEVEEIARRLEKKMRETNKEVDRIVKEIEDDARRLNKELREIAERIKDELDKIKDKDTLRELVRRIKKELDRTLKELEDVIKRLKDLLKETLDRDKELVDRAARRLEKILEDLERRGVDEKVLKELKRRLEEIKKKLDDNLRRHKKKVDDVARELEKIVKTHRDLVEEIRRRLRKKEE

SEQ ID NO: 19112 - protein, 185 aa, Artificial Sequence; identical to SEQ ID NO: 19111
  Synthetic sequence.

SEQ ID NO: 19113 - protein, 185 aa, Artificial Sequence
  Synthetic sequence.
SDAERLLEELKRISEETKRRLAETNKKVKKIMKELTETLTETNKKLKKIIDDLRDRIDKIKDKETLRRVLDEADKRLRKSLREDEELVRRAEKRLRDTLREDERIVRESEKRLRELLERLERRGVEERVLKELRRLLERNREELRRNKEKHKELVERIKRRLEENKERHKRLVDEARKELKEKEK

SEQ ID NO: 19114 - protein, 185 aa, Artificial Sequence; identical to SEQ ID NO: 19113
  Synthetic sequence.

SEQ ID NO: 19115 - protein, 185 aa, Artificial Sequence
  Synthetic sequence.
KDAEELLKTLERLSRETKRRLERTNRELKEISKETEKDLERTNRKLKEIIDRLREELDKIKDKRTLEKLMTEAKKTLKKSLEEDRDIVRKSDEKARRTLEEDKRIVEESEKRVKKLLDDLRRRGVSEEMLRELRRLVEENKKRLRENIRRHERLLEENRRKLEKNIRDHERRLEKADKDLEDKRR

SEQ ID NO: 19116 - protein, 185 aa, Artificial Sequence; identical to SEQ ID NO: 19115
  Synthetic sequence.

SEQ ID NO: 19117 - protein, 185 aa, Artificial Sequence
  Synthetic sequence.
KDAERLLEEARRIVKEADDILRELDEEVRRIVEKIKRDAERTNEEIREIAKRIRDEIERIKDEKALEKLLEDLRRKLEESLRKDERLVKEAARLLKETLEDLERVIKELADLLERILREIEKRGVSEDVLRELRKLVEDVKRRLKEVADHHRELVRRAEEELKKNRDEHERLVREIEKELRKARE

SEQ ID NO: 19118 - protein, 185 aa, Artificial Sequence; identical to SEQ ID NO: 19117
  Synthetic sequence.

SEQ ID NO: 19119 - protein, 185 aa, Artificial Sequence
  Synthetic sequence.
DEAERLLERVKELMERLTEEARRTNETLREIVERAERRLRELDERVRKIAEEIRRRLEKIRDKDTLRKLVEEIEKLLRDSLRELEKVLKELKDLLDRTLREDERLVREAEETLKELLRELEERGVDEKVLTKLRKLLEDIRRRLEKNLKDHEELVRRVEEKLKRVREHHEELVRRIKEELDKAEK

SEQ ID NO: 19120 - protein, 185 aa, Artificial Sequence; identical to SEQ ID NO: 19119
  Synthetic sequence.

SEQ ID NO: 19121 - protein, 187 aa, Artificial Sequence
  Synthetic sequence.
RDAEELLRTMEEITRRVKKELEDLLRTDEELSERVKEEARKLDEKLKELARDVTEKARDIKKGPEEKLRRIVEKLRRELEESRRELEKLIRESKKLNEDTKREIDKIIDDLRRLIERIERELDERNVDDEVKKELKRLIEEVRDRLKKVKDTLEKLIKENEDELRKVEEHHEKLLREIEETLERMRK

SEQ ID NO: 19122 - protein, 187 aa, Artificial Sequence; identical to SEQ ID NO: 19121
  Synthetic sequence.

SEQ ID NO: 19123 - protein, 187 aa, Artificial Sequence
  Synthetic sequence.
EEAERLLKKAEDLSRDTARKAKELLEEDEKLVRDAEKKARELDRELEKLAEEAARAATRAKKDDKRKLDKIAKEAKELADRSLERLRKLAEDLERLNEETLRRLEELIKENKERADRALEELEKDNAPEEARKRAEDLIRESEKRARDAKRRAKELIDRSRKSAKEAKEHHEKLIKEARDELEKAKK

SEQ ID NO: 19124 - protein, 187 aa, Artificial Sequence; identical to SEQ ID NO: 19123
  Synthetic sequence.

SEQ ID NO: 19125 - protein, 187 aa, Artificial Sequence
  Synthetic sequence.
DEAEKLLRELEKLSRETEKRVREIIKKDRDLSEEVRRRAERLDDELRKLVEDAERELRRIKSDDETKLDEIVRELERLLEESLRRLEELVKELDRLNKETLEELETLVRENRKLAKEVKDRLDEQNVDDKVRKRLEELIRESDERLKELTKELRKLIEDNRRELEKIIRHHKRRVDEVRKRMTELRR

SEQ ID NO: 19126 - protein, 187 aa, Artificial Sequence; identical to SEQ ID NO: 19125
  Synthetic sequence.

SEQ ID NO: 19127 - protein, 182 aa, Artificial Sequence
  Synthetic sequence.
SEVEDLLRRLEEIVKRNDDELRADEERTRKIIKENKETLDRLLEDLKRILRELEKIVRDKGNDRDVVRELRKIVREAEEKLEEVTRRSRESLKDLHRRNRESIRRSEESVEKIKRDVRRLELSEEAKRRAEEKLKRLEERSREIERRLKKLNEELKRISDEVEKTAREILERIKRRIEEEER

SEQ ID NO: 19128 - protein, 182 aa, Artificial Sequence; identical to SEQ ID NO: 19127
  Synthetic sequence.

SEQ ID NO: 19129 - protein, 182 aa, Artificial Sequence
  Synthetic sequence.
SRVEKLLDDVRKILEDNERRLRDDMRRTEEIIRKNKRDLERLKERHEEIVKRLDEIIKKEGTDERVVTELRELLRRVHEELKEVIRRSEKSLEELHRTNERSIRKSEKSLEDLRETLERLDLSEDARREAERLLKEVEDTSREAEKRLRELNEELERRSRKVEEELKKSDEELKRRIEEAER

SEQ ID NO: 19130 - protein, 182 aa, Artificial Sequence; identical to SEQ ID NO: 19129
  Synthetic sequence.

SEQ ID NO: 19131 - protein, 183 aa, Artificial Sequence
  Synthetic sequence.
SIEDRLRKIVRDLEKVLRDLKREHDDVVRELEKRLRDIEERHRELVEELKKRIEEIERERDTEDVRRLKEEAERLLEEARRNLKRLEEEVRRLLKRSAETVKELVERVKKMLDEVKTKLRKIDKEKDLEELLKELEDIIREVRKRAKENLDRTRKLIKDIEDYLKKNLDRVRKLIEDITRALK

SEQ ID NO: 19132 - protein, 183 aa, Artificial Sequence; identical to SEQ ID NO: 19131
  Synthetic sequence.

SEQ ID NO: 19133 - protein, 183 aa, Artificial Sequence
  Synthetic sequence.
SIEERLREVERRLREDLKRLEKAHRDIVRDIERTLRKVEEDHRRVKEKLKRTIEDVERRRDTEDVRRLVETAKKLLEDSDRTVERLRRELERILDEVRRNVEKLKRDVKKRLDEVRRRLEDIRDEKELEKLLRDLKRIIDEVRKYATRNLEELKRVLKRVKEEAEKNLERTERLIEEIRRRAE

SEQ ID NO: 19134 - protein, 183 aa, Artificial Sequence; identical to SEQ ID NO: 19133
  Synthetic sequence.

SEQ ID NO: 19135 - protein, 183 aa, Artificial Sequence
  Synthetic sequence.
SIEETLREIVKDLERVLEEIERRHREIKKELEDILRELKKRHEDVVREAEKELRDAKRRRDTEDVRRLIKTLEDLLRESEENVKKLREEVKKTLKESEDNVRRLKDEVRKLLKEVEDKLKDIDKREELKRLLDELKKLIDRVREEAKKNLDRSKKMIEDVERYARENLRRTKELIDDVKEKLR

SEQ ID NO: 19136 - protein, 183 aa, Artificial Sequence; identical to SEQ ID NO: 19135
  Synthetic sequence.

SEQ ID NO: 19137 - protein, 183 aa, Artificial Sequence
  Synthetic sequence.
KIEEEVDKVRRTLEKELKEIDERHKRIVEKLREELKEAEKRHEELVKRAKEELDDVKRREDSERVRELIKELKKLLDESRENMKKLREDVEELLRRSDKSLEDLRRKVEEDLERVRRRAEEIRDEDLLRKLLEELDRIRKEVRERLKRNLDRLKKLIDEVREYLERNLRRTKKLIDRVREDAR

SEQ ID NO: 19138 - protein, 183 aa, Artificial Sequence; identical to SEQ ID NO: 19137
  Synthetic sequence.

SEQ ID NO: 19139 - protein, 183 aa, Artificial Sequence
  Synthetic sequence.
DVEEELRELIERLKEVLDRLREESKRVIKELRDTLRELEERSRDIIRKLEETLRDVARKSTDKDKLDEVREKIDRLRRENKEVNDDLRKKIEDIEKRNRDVNRDLERKVRELEKELRDMSRNKDDEFLRRVLERAKKIVRKLEEDARRVLEETEDLIRRLREKAERVHEKTKKIIKEITEELK

SEQ ID NO: 19140 - protein, 183 aa, Artificial Sequence; identical to SEQ ID NO: 19139
  Synthetic sequence.

SEQ ID NO: 19141 - protein, 183 aa, Artificial Sequence
  Synthetic sequence.
SVEDALRKLIEELKRVLKKLEDDSRRIIEELRKVLKDLEDRSRKVIEEIKDDLRKIAEKSTDEDKLRKLEEKVRRLMRRNERVNRELKKKVEKLEKENEDVNRELKKKVDELVKELREVSRDRREEVAKRLLDKARDIVRTLKEEAERVHERSRRIIEELRREAEEVLEETRDILRRLREEAK

SEQ ID NO: 19142 - protein, 183 aa, Artificial Sequence; identical to SEQ ID NO: 19141
  Synthetic sequence.

SEQ ID NO: 19143 - protein, 183 aa, Artificial Sequence
  Synthetic sequence.
SELEKVLEKLKDLLRKVREKNERVLREVEERTRRVKRDLERVLKEAKDILRKAKKLADDGKVSERSLREILKKLKERLDRVIKKWEDISRKVSEDLEEVIKDDKRTVDEAKEELKRVLDKVDKKEEIARRIKKVLDDWKRVSEESKRRIEELLKRDKEELEKIKRAAKKVIDELKRLLEEAER

SEQ ID NO: 19144 - protein, 183 aa, Artificial Sequence; identical to SEQ ID NO: 19143
  Synthetic sequence.

SEQ ID NO: 19145 - protein, 185 aa, Artificial Sequence
  Synthetic sequence.
SRAEEILKRLEELIKRLKEENDRVLEENKRLIEELEKKNRDALRRIEELLKELKDIARRIEDKDTLRKILEDVRRTIEELVKEIEKENERVRRESKKLSEELRKKNKDVNEEAKKLVDDLRRDEGDEDLEEKLRRLLDELRKISEEVEERSERSNKELEDVSEDSKRKLRKILEDLRDLLRRTEK

SEQ ID NO: 19146 - protein, 185 aa, Artificial Sequence; identical to SEQ ID NO: 19145
  Synthetic sequence.

SEQ ID NO: 19147 - protein, 185 aa, Artificial Sequence
  Synthetic sequence.
SRAERILEEMERLIEEVRKENERVLRENRRLIKELKEENERILRELKRLIKEAKEIVERIRDKDTLRKILREVLKRLKELLDELKETNERVLRESEELSKDLRRKNEEALRRLRKLVKDLRDDEGDEEVDERLERLLKTAEDDSRRSDKRSEDSNRELRKVSEDSRKRLEELLKDAERKLREDEK

SEQ ID NO: 19148 - protein, 185 aa, Artificial Sequence; identical to SEQ ID NO: 19147
  Synthetic sequence.

SEQ ID NO: 19149 - protein, 185 aa, Artificial Sequence
  Synthetic sequence.
DDVDRILEELKRLVEENRKRNEDIERELEKLIKEVEDSNRTMLERMEDLIRELRDIVRRIKDKDTLDEILRRIREELRRLLEELKKENERALEELKRLLDELKRTNKRSLEELKKLLDDLRRREGDEDAERRLKELLEDAKRVSDEVLRRLTELLKKAKDVSDESRERLRRLLEDLERDLKRERT

SEQ ID NO: 19150 - protein, 185 aa, Artificial Sequence; identical to SEQ ID NO: 19149
  Synthetic sequence.

SEQ ID NO: 19151 - protein, 185 aa, Artificial Sequence
  Synthetic sequence.
SDAERLLRELERLVEENRRRNKKVLDDNERLVEKLEKSNRRALEELKELVDRLEDIARRIKDKDTLREILKRIEDELEKLLRRLEEENKEVRRESEELSKRLDDINRRSLEELDRIVKDLERREGGERVREELERLLEEAKRDSDEVRERSKKSNKKLEDVSRKSKKDLRDLLKKARDILKETER

SEQ ID NO: 19152 - protein, 185 aa, Artificial Sequence; identical to SEQ ID NO: 19151
  Synthetic sequence.

SEQ ID NO: 19153 - protein, 185 aa, Artificial Sequence
  Synthetic sequence.
SDAEEVLKELERLIREVEERNKDILRKAKELVRDNERKNREVMERLKKLIEDLKKIAKEIEDKDTLRKILEEILRRLKKLLEDAERTNEESLKELRRLLEELRKRNKTILDELRRLLRELKEREGGEEVEKRLKDLLREAEEVSRRSEERLRELLKELEDVSREVKRRLERILEELKRILDEVEK

SEQ ID NO: 19154 - protein, 185 aa, Artificial Sequence; identical to SEQ ID NO: 19153
  Synthetic sequence.

SEQ ID NO: 19155 - protein, 176 aa, Artificial Sequence
  Synthetic sequence.
DEVEELTERLKRVLEDNRRTAEEVKERTRRVIDKVRRDYEELEKRLKKILKEIEDLSRENRTDSRELEKTVREVEKELRREDKRLKDEIDRVREENEDMNKKSRDHVEEVARELEKRGIDEDTVRRLIKEAKDDNDRMEEENRRLIRELEEVSKRAHKRLRELIRRIEELLRREET

SEQ ID NO: 19156 - protein, 176 aa, Artificial Sequence; identical to SEQ ID NO: 19155
  Synthetic sequence.

SEQ ID NO: 19157 - protein, 181 aa, Artificial Sequence
  Synthetic sequence.
SAEEEVRKIKREIEKVLRESEREIERVEKEIRDVLRKSEREIERVKREVDKVLEEVRRAGIEEEKLRELEREAREVIKRLRRIVEESAKHLEKVVRELKEALKRSAEHLKKVIDDLKKALDDNGRLEDLLREVKKAIEKNEKDNRDVLREVEEKIRRDEKRNKEVLEDAKRKIEELKKRAD

SEQ ID NO: 19158 - protein, 181 aa, Artificial Sequence; identical to SEQ ID NO: 19157
  Synthetic sequence.

SEQ ID NO: 19159 - protein, 181 aa, Artificial Sequence
  Synthetic sequence.
SAEDAIREVERKAREVLKRSKEEIDKVVKKAEEILKRSKDEVKKVADEIRRILEEVRRAGADEKKLRDLARELEEAIRKLDEIVRRSEKHLRDVVRKLEEVLKKSAEDIKRVVRELREAAKRKRRLEDVLRRIEKIIRDNAEENKRVLEEAEEVLKKDEKDNRDVLEELKKILEELKRKAD

SEQ ID NO: 19160 - protein, 181 aa, Artificial Sequence; identical to SEQ ID NO: 19159
  Synthetic sequence.

SEQ ID NO: 19161 - protein, 181 aa, Artificial Sequence
  Synthetic sequence.
SVEEAVKRLADEIRKVLERSKEELERVAKEAEDVLRRSREELKKVADEVRKVLDDVRRAGLDEKKVRELAEELKELIERLKKIVEESAENIKKVIKDLRDIVKRSAEKLEKVIRELEKALRDKKPLEDALRRLKEIIDENKRENEEVLKRAREIIEENKKRNKEVLDEAKEIIDRVREKAR

SEQ ID NO: 19162 - protein, 181 aa, Artificial Sequence; identical to SEQ ID NO: 19161
  Synthetic sequence.

SEQ ID NO: 19163 - protein, 181 aa, Artificial Sequence
  Synthetic sequence.
SAEDAIRKIAEDAKKLLEDSRRELRRVVEKVKRLLEKSKEDLDRVAEEVKKVLEEADRAGLDKEKLKRLKEEIEEVIKRLKEIVERSEKKLRDVIKKLEDIVRESAKNLKEVIDKLKKLADDKKRLEDAVREVREVLKKNKEDNDRVLREAEEVLKRNEEENRKVLEEAKRIIDELKKRID

SEQ ID NO: 19164 - protein, 181 aa, Artificial Sequence; identical to SEQ ID NO: 19163
  Synthetic sequence.

SEQ ID NO: 19165 - protein, 186 aa, Artificial Sequence
  Synthetic sequence.
SVREELTRVKKRARDVLERSREEAERVAKRAEEVNRESEREIERVLEEVERILEDIREKVKEERAEEILRTLAKEVEDLKRELREVLRRSKEETEKLIKKLEEVLKRSEDDIRRLARELDEADRAKDEEAVRDVLRKVREIIRRNRKENEEVLRDVERLIRELEERNRRVLKKAKEILKRIRDKAE

SEQ ID NO: 19166 - protein, 186 aa, Artificial Sequence; identical to SEQ ID NO: 19165
  Synthetic sequence.

SEQ ID NO: 19167 - protein, 186 aa, Artificial Sequence
  Synthetic sequence.
SVEEELEKVKRKAEKLLEDSDREIKRVTKKAEKVLEDSRKAVEEVEKEVKEVLDEIRANVREEDLKRILEELTEKIKRLTDRLREVLKDSERNVRELKKELERMLEESKKDIEELVRELEEVSRVSDEKKAREVLKKVEDRIEENRRRNEEVLEKAEKIIEDNRRKNKTELDKVKEIIRRIREEAR

SEQ ID NO: 19168 - protein, 186 aa, Artificial Sequence; identical to SEQ ID NO: 19167
  Synthetic sequence.

SEQ ID NO: 19169 - protein, 184 aa, Artificial Sequence
  Synthetic sequence.
SAEDALRKLKEDSKRVNDESRREAERLKREIEKINEDSDREVEKVKKKIEELLEKVERDGVDKKDVDRLRERVEEIKRRLEEVRRDSKRLVEEMRKTLEEVLERSRKISEDIARRLDRVKDEVKDERELKRVLEEVERLIEKVKTDNKRVLDEIRKILEEIERKNRKVLKEVEDLLKTMEDEAR

SEQ ID NO: 19170 - protein, 184 aa, Artificial Sequence; identical to SEQ ID NO: 19169
  Synthetic sequence.

SEQ ID NO: 19171 - protein, 184 aa, Artificial Sequence
  Synthetic sequence.
SLEEAVREVERKAKKVNDDSREEVKKVKKESKDVNKKSEDDARRVVEEIKKILKRIAEKGVDEEILKRLEDTVRKIEKELRDVLKESRDKTKEIEERLDKVLKESEEMVDEIRKRLEEVTRRVKDERLAKKVLDEVEKIIEDIKRRNEEVLRRVREDIKRVEEENKKVLKRVKERVEEMRRRAD

SEQ ID NO: 19172 - protein, 184 aa, Artificial Sequence; identical to SEQ ID NO: 19171
  Synthetic sequence.

SEQ ID NO: 19173 - protein, 184 aa, Artificial Sequence
  Synthetic sequence.
EMEDEARKVIKKIKEVNRRSREESEKLSRKSERVNRESKRASEELREEIRRVLEEIRRKGVDEKILTDLERIIEEAERENKRVNEKSEEITRRIRERNERVNRRSEKEVEDIKRRLEEVKRRVKDRRKMKTVLDEVEKEIRRIEEENKKVLKESEDLIREVEKENREVLERTKRIIDEARKRAD

SEQ ID NO: 19174 - protein, 184 aa, Artificial Sequence; identical to SEQ ID NO: 19173
  Synthetic sequence.

SEQ ID NO: 19175 - protein, 184 aa, Artificial Sequence
  Synthetic sequence.
SVDEAVKEVEDRLRKVNEESTRESKKVVDKARDVNRKSEEASRELEDRIEKVLTDIRRKGVDEKKLKKLRDIVREAKKRNDEVNKESRDIVRELTDKNRRVNEESKRESDDLKRRLEEVSRKVKDERLAKRVLDEAKRILDEVKEKNRRVLEDSERIIKEVEDRNRRVLEETRRIIEELRKEAD

SEQ ID NO: 19176 - protein, 184 aa, Artificial Sequence; identical to SEQ ID NO: 19175
  Synthetic sequence.

SEQ ID NO: 19177 - protein, 184 aa, Artificial Sequence
  Synthetic sequence.
SVEEMVKELIRKLREVNKRSADELDRVRKRMKKLNDDSRKAVKEVREKIERLLDAARRRGVREEDLKRLKEEVDKAEEELRRVLRKSEEIVKELEKRARKVLEDSKEDSRRIEEELKEVERRVRDERLAEEVLRRVEKKIEDIRRRNEKVLRELEKILREVSEENERVLRDLERKLRKLAEDDR

SEQ ID NO: 19178 - protein, 184 aa, Artificial Sequence; identical to SEQ ID NO: 19177
  Synthetic sequence.

SEQ ID NO: 19179 - protein, 184 aa, Artificial Sequence
  Synthetic sequence.
SVEDEIRKVKDELRRVNEKSTRDSKRVRDRMETVNRESEKRARDVKKRIKEVLDKIRERGVDEEKLERLREIVERIEEELDRVLEESKKLVKDVEETNRRVNRDSERESERIMTELDKVKDDVKDKRLADDVLRKVRDEIRKIEEDNREVLRRSEDILRKIKERNKKVLDDVRRKIDKARRDAE

SEQ ID NO: 19180 - protein, 184 aa, Artificial Sequence; identical to SEQ ID NO: 19179
  Synthetic sequence.

SEQ ID NO: 19181 - protein, 177 aa, Artificial Sequence
  Synthetic sequence.
KAEEAAERIKKKLEDILKRAKEESEKILDKLREVLERSKRKHEELIRRAEEVLKDIARKGVSEEILERLRKIVEELKKKSEEDIKRVEDILRRNAELHEEVLRRVEDIVKELEDRIRKDGVDRDVLTELEKIIKELEKRAKEVLDTSRKSIEDLERRNEESLKRLTDDLKRAKEEAD

SEQ ID NO: 19182 - protein, 177 aa, Artificial Sequence; identical to SEQ ID NO: 19181
  Synthetic sequence.

SEQ ID NO: 19183 - protein, 181 aa, Artificial Sequence
  Synthetic sequence.
SEVEEVLKRLEELLRDSERKVEEMERRLKEIIDRLREEAKRVLDESKESSKRLDELAKKGIDRKDLRENHERNKDLVRRLEKLLEKVLKELEDLARKLREMLKRSNEELKRLVDRLRERRDREEADRALRDLERKHEKRVREVDDRLKKIEDELKRVVEEIRKRLEDLKEENRRIVDRTAT

SEQ ID NO: 19184 - protein, 181 aa, Artificial Sequence; identical to SEQ ID NO: 19183
  Synthetic sequence.

SEQ ID NO: 19185 - protein, 181 aa, Artificial Sequence
  Synthetic sequence.
SDVDEVLKRSEDSTRRLRERAERMLEELERLIRESKRTADEVLKRSRESSKRLDEEVRAGVDRESLKRNHEENRELAEELRRRLKESNDRLRELVRRVEEELRENHRRNEELVKELLRRRDEEEVRKELERLRRENEKVVREAKKRLEDIIRKHEKIVKEIKEALDKLLEDNKRIVDRTSK

SEQ ID NO: 19186 - protein, 181 aa, Artificial Sequence; identical to SEQ ID NO: 19185
  Synthetic sequence.

SEQ ID NO: 19187 - protein, 183 aa, Artificial Sequence
  Synthetic sequence.
DELEDVLRKAKELIKRDRDEVRRVLEELKRSTEDLRRKVRDVERRLKELIDELDDIARKIKDKETLRRLLREIEERLKRLAEELRRLLKKALEEHEKLVRDLDKKNKDSLRKLEELLRDIVRRAGRRLKELEKIKKELEDVIRETRERLKKVLDETREDIKDVDRRLRKLEEEIRRKVEEDER

SEQ ID NO: 19188 - protein, 183 aa, Artificial Sequence; identical to SEQ ID NO: 19187
  Synthetic sequence.

SEQ ID NO: 19189 - protein, 183 aa, Artificial Sequence
  Synthetic sequence.
SELEEIIERIKRLIEEDRETVKEVLERLRRLSDEDRKEVKRVLREIKELIKELEDLRRRIKDEETLRRLLEDIRRRLEELVRRLEEKNRRSHEEHKKLAEELRKKNDDSMRKIERLVEKAVEDAGRPLEELERLKEEAKRVIKRTRDELEKILRENRELIDRSRKELRDLEKELRDVVRESER

SEQ ID NO: 19190 - protein, 183 aa, Artificial Sequence; identical to SEQ ID NO: 19189
  Synthetic sequence.

SEQ ID NO: 19191 - protein, 187 aa, Artificial Sequence
  Synthetic sequence.
SVREELEKLVRELRRLLEKSKRDTDRLSEEMEELNRRAEELIRTIERRLRELLRKIRENVDKEELKRILEELEETVRRVIEKAKKVLEESKRHSDEVRRRLEEINRRIEKKIRDLERELEKVERELKTEKLVEELKRRAKKVIRELEELSRRATEEVKRVLKENEDLVREVEKDLEEILKRIKDRAD

SEQ ID NO: 19192 - protein, 187 aa, Artificial Sequence; identical to SEQ ID NO: 19191
  Synthetic sequence.

SEQ ID NO: 19193 - protein, 187 aa, Artificial Sequence
  Synthetic sequence.
SLEEELKKLEEEVRRLLEKSKEDTDRLKKEIEDLNKKAEDDVREIRKELEKLLRDIARNVDEERMRKKLEELRERVRELEEKVREVLKTSKENSKRLIEDLKRINDELEKIVRDVTRELDEVAKRLTTEELAKRLSDKFRRILEKLEEDSKRALDKAREILKRNEELLRELLEELRRILEEIERRAR

SEQ ID NO: 19194 - protein, 187 aa, Artificial Sequence; identical to SEQ ID NO: 19193
  Synthetic sequence.

SEQ ID NO: 19195 - protein, 187 aa, Artificial Sequence
  Synthetic sequence.
KAKEELDRLRKEARDLLEDSKTKTKRLVEEMDKVNEDSKRESKKLLDELEKLLRDIEKRVREEELRKTLKELEDTVRRLEEELRKIDKESEENSRRLDERLKKINKELEDEIRKLDERLKRVEDKLKDDKLVEKLREEVERILERVKELSKKAIDEVKEVIKRNRDLSKRVIERAKEILRRIEEKAR

SEQ ID NO: 19196 - protein, 187 aa, Artificial Sequence; identical to SEQ ID NO: 19195
  Synthetic sequence.

SEQ ID NO: 19197 - protein, 182 aa, Artificial Sequence
  Synthetic sequence.
SVEDELRRIEEEMKRLNEKVERDSRRVLKEVEDLNREIKKRSDDLEREIRRLLEEVKRRKSKDEEKLRRIKELVERLKEENRKMNEDSKRSTDRLREENKKVNEDSKRSSEEIKRRADDVRKRNGDIRELLKELRKILDDNRETARKVLEDSKRIIERNKREAEKLERRSRKILKDIEDEAR

SEQ ID NO: 19198 - protein, 182 aa, Artificial Sequence; identical to SEQ ID NO: 19197
  Synthetic sequence.

SEQ ID NO: 19199 - protein, 182 aa, Artificial Sequence
  Synthetic sequence.
SVEEELRRLEKRIEELVREIERRLRELKKEVEELNERIKRASDEILDRIRRLLEEVRRRKREAEKVLREIEELIRRLKRENEEVNRDSKRSTEKLERDLRRVLEELKRTVEELKKRLREVERRNGDVRDVLREVERIIRELEERARDLLRRIREIIRRNEEKLERLLRRSKEILKEIEERAK

SEQ ID NO: 19200 - protein, 182 aa, Artificial Sequence; identical to SEQ ID NO: 19199
  Synthetic sequence.

SEQ ID NO: 19201 - protein, 179 aa, Artificial Sequence
  Synthetic sequence.
STERKLEELEKEAEKDLKEVEDRLKELNDHHDKRVKEVEDRLRRANKHHRDRLEDIRRRNISEELDKKLKDTLRELKRTTDRLRRILEKSKRDLERTTERLKRILDKIRRELKELSDKVKDRDTDEVLKRLKDLIKELRDEVRKVLTEHREIDKRVEEEVKRVLDEHREIDKRLDEETK

SEQ ID NO: 19202 - protein, 179 aa, Artificial Sequence; identical to SEQ ID NO: 19201
  Synthetic sequence.

SEQ ID NO: 19203 - protein, 179 aa, Artificial Sequence
  Synthetic sequence.
SSKEKIERLREKLEDLVRRVRKRLRELNEHHKELVKRIEDTLRELLRHHDELLKEAERRNIDKKLLDRLRETKERLKRLAEELRKILKESLDELRRTTEELERILEEILRRLEDLIRKMDERDTEDVLRRIEELIERLKREVDRVEREHERIDEEVRKRAEDIERRARDIDREVKETTR

SEQ ID NO: 19204 - protein, 179 aa, Artificial Sequence; identical to SEQ ID NO: 19203
  Synthetic sequence.

SEQ ID NO: 19205 - protein, 179 aa, Artificial Sequence
  Synthetic sequence.
SVRETLERMLRHHAELVERVRRELRKLNKHHRDEVKRVEERLDELRKHHEELLRRAEKDNVSEDLLREAERTKRELEKLVRDLREILKRSLETLEETTRRLEKRLDESLEELKKLIKDVDERDAKKVVEDLRRINERVKDEVRRALREHERIDKEVREIVEEIERRAEKIDEELKRTID

SEQ ID NO: 19206 - protein, 179 aa, Artificial Sequence; identical to SEQ ID NO: 19205
  Synthetic sequence.

SEQ ID NO: 19207 - protein, 179 aa, Artificial Sequence
  Synthetic sequence.
SVEEALTEIKKRLDKKVEDIERELKKLLDHHKELVDDVRRKLEELNRHHDRLLDEIRKDNSSEELEEKLKKTKDDLRRTTEELERRLEKSLDRLRKLVETLRRILERIKKELKELIDRVKDRDKDEVLKRLEDLIRELDRRVKEIEKRAEEIDRELEDRVRKVLDEHRKIDERAARETD

SEQ ID NO: 19208 - protein, 179 aa, Artificial Sequence; identical to SEQ ID NO: 19207
  Synthetic sequence.

SEQ ID NO: 19209 - protein, 179 aa, Artificial Sequence
  Synthetic sequence.
ETKERLDEILKHHEEEVKKVRKRLDELLRHHEELVKEVDKRLKEMNDHHRRLLDEADKDNIDKKLKDKLDETRDELRRTTERVKKRLKESLETLRKLVEDLRRELDKSREELKRLIDEVKDRDKDDVLRRLEDINRRLEERVRKAERRLEEIDEKAERITEKVKREHEDIDRRVEDIKR

SEQ ID NO: 19210 - protein, 179 aa, Artificial Sequence; identical to SEQ ID NO: 19209
  Synthetic sequence.

SEQ ID NO: 19211 - protein, 179 aa, Artificial Sequence
  Synthetic sequence.
SVKERLDEVRRHHEDEVRRVDEKLKEILRHHEEEVRRVDKELKELLDHHKELLDDAERRNISEELRKRLEDTEERLRELAKELREILKRSLEELKKLLDELRRILEESLRELEKLIRDVKDKDAEEVKKRLDDINKRVEEIVREIEERLRRIDEKLKEIVRKAAEDIRRIDKEVEDEIR

SEQ ID NO: 19212 - protein, 179 aa, Artificial Sequence; identical to SEQ ID NO: 19211
  Synthetic sequence.

SEQ ID NO: 19213 - protein, 184 aa, Artificial Sequence
  Synthetic sequence.
SLEELLKKIEERLRDLSRKVAEELKRILDELRELSERAKDLNRRVNETLRKLVEDITRRDKDTEELKEILREVEDRARKISERDKELNEEVNKEVTEIVRRLEKLNEESKRKVEKLREELKRVDSEEDVKKVLDELEKLLKDNEELNRRVRKELKDLLETLRKLNERSKEELDKLIKELEDRAR

SEQ ID NO: 19214 - protein, 184 aa, Artificial Sequence; identical to SEQ ID NO: 19213
  Synthetic sequence.

SEQ ID NO: 19215 - protein, 185 aa, Artificial Sequence
  Synthetic sequence.
REVEEILRKLKEITDRTRDLSRRNEEELRRIIRELEEMSKRNKREVEEIIKEAKELAKRTKDKKELEDIVREIKKKVDDSKEKDKELVKRIRERIEESRKRDKRIADESRRLVEEVAEELERKGVDEKAREDLDRLRRENEELIERSERINKKIKEELERVIKRSEDLNKKLEEDLEKLIRDETR

SEQ ID NO: 19216 - protein, 185 aa, Artificial Sequence; identical to SEQ ID NO: 19215
  Synthetic sequence.

SEQ ID NO: 19217 - protein, 185 aa, Artificial Sequence
  Synthetic sequence.
EEVERILTKAERVTRETERLSRENEKELKKITDETRRLSEKNIEDIERIIEEMERLARTTKDERELEEIARRIEEEIRKSIERDKEIARESRELLKESKKKDKKIMDDSRRLVEELRRELEEKGVDEDARRELKRLEEENRRLLEESEERNRRIEERNEELIEESERRNRELEKRLRDLIKETRD

SEQ ID NO: 19218 - protein, 185 aa, Artificial Sequence; identical to SEQ ID NO: 19217
  Synthetic sequence.

SEQ ID NO: 19219 - protein, 182 aa, Artificial Sequence
  Synthetic sequence.
SAEDSIRRAEEEARRLIKRAEEEAEKSARRHKELNERARKRAKESAEEAEKLIREAARSGRVDKKELDKAAEEAKRAIEDSERDLERAAKEDRESIEESKKDLERAAKELREVIEDLKRAAKEGADARDLEEKAKKALEKAERIARKNAEDNERNLEKSKRIAERNAKKNEEALREIAKKAN

SEQ ID NO: 19220 - protein, 182 aa, Artificial Sequence; identical to SEQ ID NO: 19219
  Synthetic sequence.

SEQ ID NO: 19221 - protein, 182 aa, Artificial Sequence
  Synthetic sequence.
SAREDIERLVKELKELVERAREAIKRSAEEHKKLNKELKDRIKEVVERLKKLIDDARRDGRVDEKRLRDVVREVARVLRDAEERVKELHKRDRDSIDRSRRDLDRLVKELKDVIDDLRDLLRRGVPAEELLKKAKRVIEKAEKILRENKEENERNLATSEKIARDIEDKLRKVLKRIADEIR

SEQ ID NO: 19222 - protein, 182 aa, Artificial Sequence; identical to SEQ ID NO: 19221
  Synthetic sequence.

SEQ ID NO: 19223 - protein, 181 aa, Artificial Sequence
  Synthetic sequence.
SAEDKLREVEKHHEKLVRDIRRKLEKNLRDHAEKVDRVRKKLEEAERRLKELVDRVRKDNVSEELLETIERLLEELKRLLRELERLLKKTLDEDREILERAERELKRTLDELRKIVEDVRRRGRDDERVDRDLERLDREVEEIARRLTRLMEESNKRLEDIVRTIEERIKEILERLKRTAK

SEQ ID NO: 19224 - protein, 181 aa, Artificial Sequence; identical to SEQ ID NO: 19223
  Synthetic sequence.

SEQ ID NO: 19225 - protein, 179 aa, Artificial Sequence
  Synthetic sequence.
SDVEKIIKDLEKVIDDNRRTNEKAIRDAEDIIRRSEEHSRKVIEKLKKIIKEVKEEAERLKGDERVVKELEDELRKVKKEWEDVSKENRDTNRRVLEELKKILEDSKRHLDKALKKVRDDGVDEEEVRRVEEEIKKLLEDSRRLLRRIEEESRRLDEEDERLMKEIDDEIRELLERIRR

SEQ ID NO: 19226 - protein, 179 aa, Artificial Sequence; identical to SEQ ID NO: 19225
  Synthetic sequence.

SEQ ID NO: 19227 - protein, 179 aa, Artificial Sequence
  Synthetic sequence.
KEVEDIVDEARKRIDTVRKESKRVVEEVERRIEENKRRNEEVIKRVREDIDRVRKEADKLKGDDKVVKKLEDDLRKVLEDLKRIVDESAKHLKDLTRKWEEISKRLKDRLEEVIRELERRGVDREELERLRREVEKLEEDDRRLLEELEKRARELLERSKKLLDEIRREMEELLKRIRT

SEQ ID NO: 19228 - protein, 179 aa, Artificial Sequence; identical to SEQ ID NO: 19227
  Synthetic sequence.

SEQ ID NO: 19229 - protein, 179 aa, Artificial Sequence
  Synthetic sequence.
KEVEDIIREVEKRIRDSERHSKEVLDRAEEVIDDNRRKNEEVIKEAEEIIDRIRREADRLKGDEKVVRELEERLRRALEKLRRILKESTKHLKKLIEDWKRRSEEDERRNRDVLRELERRGVDKDLLKEVEERSRRVIEKDRELLKRLEDKVRKLVEDSRRMVKRIEEEIRKLLEDIRR

SEQ ID NO: 19230 - protein, 179 aa, Artificial Sequence; identical to SEQ ID NO: 19229
  Synthetic sequence.

SEQ ID NO: 19231 - protein, 183 aa, Artificial Sequence
  Synthetic sequence.
SELEKIIEDIKRLIDELRKLVEDVERRNRKLSEDDKRLVEEVLKRLDELIRRLREIAKKIKDKDTLRKILRDILEELKKLLETLRRLNEDSLEKSKRSVEELRRLLRRIKEELKRLLEEAATRAGRKVERLDELRERLKRLEDEVRRRLEELERENRKIIEETEEALRRIEEKARKELEEVDR

SEQ ID NO: 19232 - protein, 183 aa, Artificial Sequence; identical to SEQ ID NO: 19231
  Synthetic sequence.

SEQ ID NO: 19233 - protein, 183 aa, Artificial Sequence
  Synthetic sequence.
SELDDIIRKIEELIRDDERKVRKAVRENEDLSRRDEERVRKVIDEARKLLKRLEEIAREIKDKDTLREILEEIKKRLEELVKTLKDTNRKSKRDSERSVEEVRKTNEKSRRDLERLAKELADREGRKSEKLDELRKRLEDLIRETEKELRRLERENDEIEKRTEDLLRRLREELRRIVEEVER

SEQ ID NO: 19234 - protein, 183 aa, Artificial Sequence; identical to SEQ ID NO: 19233
  Synthetic sequence.

SEQ ID NO: 19235 - protein, 183 aa, Artificial Sequence
  Synthetic sequence.
DDLERIIEEIERLIRTLEELVRDALRKSKRLLEENKKLNEEVLRRIKDLIRRLEEIARRIEDKKTLEDILKEIEDRIKELAERARRINEKSLRDNKELVKDVRRKVEEIKRRIEELVEEIVRRAGRKLEELDKLREELKRLVDRVEEMLRKSEEDTERIIRKSEEDLERLERDLKRLVEEVRR

SEQ ID NO: 19236 - protein, 183 aa, Artificial Sequence; identical to SEQ ID NO: 19235
  Synthetic sequence.

SEQ ID NO: 19237 - protein, 183 aa, Artificial Sequence
  Synthetic sequence.
KELEDIIREAEKLIEENSRKNKEMLDRSKELIERNERKNRDVIRRLEELIEDLRRIAEEIKDKDTLRKILREILEELKELAKRLRDTNRESEKRNRDLVKRIREENEKSKRDLKRLIDDAVRRAGRKSEELDRLRKKLEDNIRESEKELRRSEEETKKLIDDSERELERIERRARELLERVRR

SEQ ID NO: 19238 - protein, 183 aa, Artificial Sequence; identical to SEQ ID NO: 19237
  Synthetic sequence.

SEQ ID NO: 19239 - protein, 186 aa, Artificial Sequence
  Synthetic sequence.
SDVEDLLRKIKKILREIAEESKRTVRENEELTDRVKKKIREIVERIRRIIKELEERLRRIKDKRDLERVLRDAERRIRELIETAERLLEEVKERSKRSVERNEELLDKIRKEIEDLVRTLRERAKNVKDVEDKLRELERELKKIEDDSRRLLKRLEEENRTLVKEVRERLKRLEDDVRKLKEDVTT

SEQ ID NO: 19240 - protein, 186 aa, Artificial Sequence; identical to SEQ ID NO: 19239
  Synthetic sequence.

SEQ ID NO: 19241 - protein, 186 aa, Artificial Sequence
  Synthetic sequence.
DEVDKLVEEIKKIIEDVRRESDKTVRDNEELTKKLAEDSKRSLDEIKKLIEELRKEIERIKDKETLDRVLREATKRLKDLVDENERLLRDAKRKSDESVKRNEEVLRRVRKEIDDLVRELRERAKTSEEVERKLKKLKEELERLVEESRRKLEELKKRNEELVRRSREELDKLRREVKETLERVKR

SEQ ID NO: 19242 - protein, 186 aa, Artificial Sequence; identical to SEQ ID NO: 19241
  Synthetic sequence.

SEQ ID NO: 19243 - protein, 186 aa, Artificial Sequence
  Synthetic sequence.
SDAEEILKEIERLIREVEKTSRRTVEEDERVTEEVRKKSEKSVRDIEELLKEIKRELEEIKDKDTLDKLLRDIRETLRKIVEDNRKLLEDVKRESEKTVRDNKEILRRVKEELRKLVEKLRRRADKSERVERKLEELKRRLEELEKESERELDRLRKENEDLVRRSEEELRRLRRELEEIVREARE

SEQ ID NO: 19244 - protein, 186 aa, Artificial Sequence; identical to SEQ ID NO: 19243
  Synthetic sequence.

SEQ ID NO: 19245 - protein, 172 aa, Artificial Sequence
  Synthetic sequence.
SEAEKVLKEVEDIIREVEEENRRLIREIEEEIRRVKEEVERLLRKSEKDIKEVEESPKSKDLERRLEEVDEELKREIERIERELDKVLRELEERSRESVERLRRVLKEVRERNGMDEKLLREIERRMRELEKTSRKLLKEIKKKAKELKEKAEEVLRRSRKRTEELVDRLRK

SEQ ID NO: 19246 - protein, 172 aa, Artificial Sequence; identical to SEQ ID NO: 19245
  Synthetic sequence.

SEQ ID NO: 19247 - protein, 183 aa, Artificial Sequence
  Synthetic sequence.
DVEDLIRELRKRLDELRKESEELLRRSKRKHEKLLTDSRKLLRDIEREARKLLEDVKRKGASESTVEKIKRDLDRLIKELEKVHRDSRRKSKEDLDRLKRVHDESKKKIDELRKELDEMSRVKDREMIETLIRKAKEIIDRLREENRRAVRRSDETLRRLKEENDKVITDVKRKIKELRDEVK

SEQ ID NO: 19248 - protein, 183 aa, Artificial Sequence; identical to SEQ ID NO: 19247
  Synthetic sequence.

SEQ ID NO: 19249 - protein, 183 aa, Artificial Sequence
  Synthetic sequence.
SIDEEITRLEEESRRDEEESKRLLEKSRDDHRRLLERSEKLLRELEKRARDLLEDVKRKGASKSTVEKLREDIERVLDKLRKVHERSRRKSEEDIRRLEEVHERSKRKHEKLRRELEDVRRVSDEEMVRRVIEKYERAVERSTEENRDAFRRSEETIRELAKENEDAIREVKEIIDKLREDVR

SEQ ID NO: 19250 - protein, 183 aa, Artificial Sequence; identical to SEQ ID NO: 19249
  Synthetic sequence.

SEQ ID NO: 19251 - protein, 183 aa, Artificial Sequence
  Synthetic sequence.
DVEELIKELERRLRKLLEDSRRLLEESRREHKKLIDDSRRLLDELRRRLERLLEKVRRRGASESKVERIERRLRDLLRRLREVHERSKENSKRDIERLERVHDESRKEIKELLDELREMSKMSRREVIEAVIRKAEDIIRRLRRKNEKAVEESRENIKEIKRENKRVIDEAREIIKRLEEELE

SEQ ID NO: 19252 - protein, 183 aa, Artificial Sequence; identical to SEQ ID NO: 19251
  Synthetic sequence.

SEQ ID NO: 19253 - protein, 183 aa, Artificial Sequence
  Synthetic sequence.
SVEDLLRRLEEESRKDLDDSRRLLDESRKRHEDLLRKSEELLRELEERLRRLLEKVKKKGLDDSDVKRLEKKARDLLKELREAHKRSRDNSERDIRDLERVHRESEKRHRDLRKKLEDVRRSRREDVIRKLIEDYERLVKESTDRNRRAVEKSRENLKRLDKENRDVIEKARRIIEELEKEVK

SEQ ID NO: 19254 - protein, 183 aa, Artificial Sequence; identical to SEQ ID NO: 19253
  Synthetic sequence.

SEQ ID NO: 19255 - protein, 183 aa, Artificial Sequence
  Synthetic sequence.
SVDELIEELRRRLEKLLREAEELLKESRKRHEELKKRSKELLDELEREVERVLEELRRKGVSDDKVKRVEDRLTELIRDLRRAHKESEKNSRDDIRRLEEVLKKLEKKIRDLERELEEMRRSKDEEVIERVIRKADEIIKRLKKELREVVERSKENIKKLEEENRRVIKKAREELRKIEEEIR

SEQ ID NO: 19256 - protein, 183 aa, Artificial Sequence; identical to SEQ ID NO: 19255
  Synthetic sequence.

SEQ ID NO: 19257 - protein, 179 aa, Artificial Sequence
  Synthetic sequence.
SEVDEVLKTLKELIERLRERVKEVLKRLEKLLKELEDLSRETVRELRETNDDLRRKAEKTRDKDTLRELVKRVLDENKKIITRNRDTVRRAMERIEDLIRELERTVEKIRRDIERIIRELIRKREAAEKVRRDVDRLRKEVEEMLERVKRKLDELRKDSDRLAREVEDSTRKIERDVEK

SEQ ID NO: 19258 - protein, 179 aa, Artificial Sequence; identical to SEQ ID NO: 19257
  Synthetic sequence.

SEQ ID NO: 19259 - protein, 180 aa, Artificial Sequence
  Synthetic sequence.
SELEEMVKKVKEIIDRARERIRELIERHKELDRESRKRIEDIIREARELNKDVKRVIKEIKKEEEEKLKKILEDLKRLSDEVKRRLERILEENRKLVRESEKRLEDVLKELKELLRDVERKARVDEALEELKRRVKRLEEKLREDIKRLRENNERIREDVERLAEELDRHTRKLMEEVKK

SEQ ID NO: 19260 - protein, 180 aa, Artificial Sequence; identical to SEQ ID NO: 19259
  Synthetic sequence.

SEQ ID NO: 19261 - protein, 180 aa, Artificial Sequence
  Synthetic sequence.
SELEDIVEKAKKIIEDVRRRIEKLIRDDKRLNDESKKTIEELIRKARKLNEEAERIIRKIKEDDEKKLREILKRLRELSEEIIKRLREVLDRDRRLNKKTVDDARRILRELKELLKEVEKRIRVRELLEKLRRDVEELEREVRELLERLKENSKRIEDEVRELMKELKRHTEELEREAER

SEQ ID NO: 19262 - protein, 180 aa, Artificial Sequence; identical to SEQ ID NO: 19261
  Synthetic sequence.

SEQ ID NO: 19263 - protein, 180 aa, Artificial Sequence
  Synthetic sequence.
RELEEIVERAKEIIRRVAEKIKKLIEEAERLDRDSKRKIDELIEKVKKLNEDVRRTIEEIKEDDRKTLREILETLKDLSRRAIEEARRILEENKKLSKEIEDRVREVLRELKKLVDDIRREMKVEEMLRRLTELLKELADEVKKLLDRLKENNEKIREDVERLLRELEEHTKKLEEDVTR

SEQ ID NO: 19264 - protein, 180 aa, Artificial Sequence; identical to SEQ ID NO: 19263
  Synthetic sequence.

SEQ ID NO: 19265 - protein, 179 aa, Artificial Sequence
  Synthetic sequence.
SEEERVLKELEDVLREHKRKADESSRKLEEVHRRHRKRMEESKRELEEVHKEAKDRITKNRDDTKLLEDIIRTLRKINKDVARRNEESIRELKEINKRVLDENKKSREELEEILRRVIERVGETEELEDVERKARELEERNKKLLKDSEEATEELRRENEEMLEESKRRTEKLEREVRT

SEQ ID NO: 19266 - protein, 179 aa, Artificial Sequence; identical to SEQ ID NO: 19265
  Synthetic sequence.

SEQ ID NO: 19267 - protein, 175 aa, Artificial Sequence
  Synthetic sequence.
DKVREVLRESEKLLEDWDRELKEVLKDFKRTLDELEERLRDVLRKNKKSLEDLKRRGLDDRVVRKVEEEHRRVAEEIKRLVREAEKLLEDVKRELERLKREAEEENKRVRDKVRKDGDADDRIMRELRELNRRLDESVKEIRDRLRRILDKLRKMIEKLKKELEDTDRELEERVR

SEQ ID NO: 19268 - protein, 175 aa, Artificial Sequence; identical to SEQ ID NO: 19267
  Synthetic sequence.

SEQ ID NO: 19269 - protein, 175 aa, Artificial Sequence
  Synthetic sequence.
SKAEEVLKTSEKLLEEWRRRVKEVEDRNEETIKRLKEELDRALKENEESLRELEKRGLDEEVKRRVEERHRKIEEEIEELRKKLREKHKKVKRDIERLVKKMKDDNEEVKKRVDKRGDLDDRISEELKKLNEELERELRKLSEELKEVDREAKEEIRRLVEELREIDKRLEEETK

SEQ ID NO: 19270 - protein, 175 aa, Artificial Sequence; identical to SEQ ID NO: 19269
  Synthetic sequence.

SEQ ID NO: 19271 - protein, 175 aa, Artificial Sequence
  Synthetic sequence.
SEAEKVLTDFRDALEKDRERNERVLRENEETIRRDKEENERVLRENDKSLKELRKRGLDERVADKVRKDHEKVKRDTERLVRELRRVHEKVRKETERLIREMRKALEDVRDDVRRRGSADDRIKKTLERLLRESKKASEKLKDDLRKLDKRSKEESRRLTERLREIDEELRRRVD

SEQ ID NO: 19272 - protein, 175 aa, Artificial Sequence; identical to SEQ ID NO: 19271
  Synthetic sequence.

SEQ ID NO: 19273 - protein, 175 aa, Artificial Sequence
  Synthetic sequence.
SEAEDVLRRFEEELRRDDEKNERVLRRNEETNRRDDETNRDVLRRNKESLDKLRKRGLDEEVVKRLREVHERVREETKKLNREHKKAHEDVKRDTEDLKRRMEDELRRVEDEVRKRGSADKRIKDELRKLLKRSEERSEELRRRLEDLDRRSKETSDKLREELERLDRDVERKVN

SEQ ID NO: 19274 - protein, 175 aa, Artificial Sequence; identical to SEQ ID NO: 19273
  Synthetic sequence.

SEQ ID NO: 19275 - protein, 175 aa, Artificial Sequence
  Synthetic sequence.
SEAEKVEDDVRRVLETDEKKNRDVLDTNRRTIEEDRKRNEEVLRKARKMLEDLKRRGLDKDVVKRVEEVLERVKRETERLTRELRKFHEEVRKETEDLKREIEKLLRDLRRDVERRGSADERLRETLEELLRRSDERSRRIMEDLKRLDTDSKRVSEELKRRLEELLKDLERKVR

SEQ ID NO: 19276 - protein, 175 aa, Artificial Sequence; identical to SEQ ID NO: 19275
  Synthetic sequence.

SEQ ID NO: 19277 - protein, 185 aa, Artificial Sequence
  Synthetic sequence.
SEVDEITKELEESLKDLDRVVRELREKIKKIDKELAETVDKLTEEAKEILKTLRDIIRRGNNTEEVSREAEELLKELKKRLEELEREVERLHEELRKEIEELEREAEKRNKDVKEKIDRGNLDKKLKEKVDRVHKRHKDRLDEIKRKLKKVLEDNRETLERIKRKLRKVLEDLKRMLDELERELR

SEQ ID NO: 19278 - protein, 185 aa, Artificial Sequence; identical to SEQ ID NO: 19277
  Synthetic sequence.

SEQ ID NO: 19279 - protein, 176 aa, Artificial Sequence
  Synthetic sequence.
KETEDLVRRLRKVLKELEERVRTLMRDNERVNKEIADKIRRLREKLREEDERVDEVVKRREVDEKDLKRRADESREELKKVLKDLEDTVKRLEEKNDKVRRELKKIVDELRRELEREVKEAREVLREMDERVKELEERLERVLRKSKTDADRWRRELKRVLEEHDKTVKEIREKTR

SEQ ID NO: 19280 - protein, 176 aa, Artificial Sequence; identical to SEQ ID NO: 19279
  Synthetic sequence.

SEQ ID NO: 19281 - protein, 178 aa, Artificial Sequence
  Synthetic sequence.
KEKDEVVKRYEDRIKEIRERLKEVVTEHEDRLRKWRKDLEEVVERNRRSIKKIDEEVKRRGVPEKVKRELREIEKRSEEIIKKVREELEDLARKSRERIKRVEEEHDKNTDKARKDITKEGVDEDVVRKLDEDLKRNEDHLEEVRKELERLNEEIEKLIRDLLEILRRIDKELRDKLE

SEQ ID NO: 19282 - protein, 178 aa, Artificial Sequence; identical to SEQ ID NO: 19281
  Synthetic sequence.

SEQ ID NO: 19283 - protein, 178 aa, Artificial Sequence
  Synthetic sequence.
DEEKDVTRRVREVIKRLEEELEEVVRRHRESLKRLKERLEEVVRRNRKSIREIEKEVKDAGLPDEVKRRLDEIKKESEKRIDDARRREEEVEKDSERRIKEVEDRLKRKAERIEKAREERGVDEDVDRELARMLEELRDLLRRLAEELKRIDEELEKELRDVARELEKIDRDMREELR

SEQ ID NO: 19284 - protein, 178 aa, Artificial Sequence; identical to SEQ ID NO: 19283
  Synthetic sequence.

SEQ ID NO: 19285 - protein, 178 aa, Artificial Sequence
  Synthetic sequence.
DERKEVEERYRREIERIKTKLKEVVKRHEDSLKKIEDDLEEVRRDNERSIKEIREEVRKKGAPEKVEEDLRRIEEKSRRDIKRMEEDLKRMTEESRREIEDVERRHRENEERVEREIEKRGIDEDVDRELKEDLERNERHLEEVTRRLRKIDKDLKEKLKRLEEELKKIDREARERLR

SEQ ID NO: 19286 - protein, 178 aa, Artificial Sequence; identical to SEQ ID NO: 19285
  Synthetic sequence.

SEQ ID NO: 19287 - protein, 181 aa, Artificial Sequence
  Synthetic sequence.
KEIEDVKRRLEELDRRIKELVDRVRRKLEEVDTRAEKELRDVRRRLEELLERLEELIRRGTSEETLRRLAKEIRKIADEARKKLKKIKDDLKKEHDRVREKLEELARRSRKVLKEVRDRTGEVKELRDVIKENEDTLRRLKEEVEKVTKENEETLRRIERELDKVERDVERRIRELEEERR

SEQ ID NO: 19288 - protein, 181 aa, Artificial Sequence; identical to SEQ ID NO: 19287
  Synthetic sequence.

SEQ ID NO: 19289 - protein, 177 aa, Artificial Sequence
  Synthetic sequence.
SEVEKVLEDNKRSIDRLEEELRKVTRTSRELLKEWAKRLEDVLRDVKRAVDELETRGVDEKTLRELRKRLTDIEREIRKKLEEAEKKLRESERDVEDTLRRLREKSRRITEEARKGGDSDEIRKLKEELKRLDEEAARILETIMRRNKDLNDRLREIIETLKKRLKDLLKEVEDRAR

SEQ ID NO: 19290 - protein, 177 aa, Artificial Sequence; identical to SEQ ID NO: 19289
  Synthetic sequence.

SEQ ID NO: 19291 - protein, 178 aa, Artificial Sequence
  Synthetic sequence.
DAEKLREDVERTLRRLRKELKDSIKRNREELERLERKLRKSIKETEDEVRKLEEKLERRLKDDEEVRRRAEELAKRLKELNEDVKRKADRLKEESERLDEELEKRLRDLEREVKKLEKDQDVDDDVRRLVEKIEREVRKLIEDHKKKSEDIVRTVEKLIEDHKRRVDRISEEVEEELR

SEQ ID NO: 19292 - protein, 178 aa, Artificial Sequence; identical to SEQ ID NO: 19291
  Synthetic sequence.

SEQ ID NO: 19293 - protein, 178 aa, Artificial Sequence
  Synthetic sequence.
SKEDLKRKVKKILEDVERELRRSIEDTERLLREVEKRLEDSVRENRRKLREVEEKLRRRLKDKREVMEKLRKIVTESEELDKDVKRKVEELERRARELNRELKEKLEELKKEAEELDRREDVDRRVDELVKEIEERARKLIKEHRDRVRELLRELEELIERHKELSERILKELEELLK

SEQ ID NO: 19294 - protein, 178 aa, Artificial Sequence; identical to SEQ ID NO: 19293
  Synthetic sequence.

SEQ ID NO: 19295 - protein, 174 aa, Artificial Sequence
  Synthetic sequence.
SEKEEIARRLEKVHREHREELKRLEDRLREVLKRNRETIEDIRRKLEEVLRRLRERLVDDEEVLRELTEEAEELERRVRRRHEELERLVEELKRKADKINKDLERLIRELKERLDDGDEEKLRRDVERIVKEAEDTLRELERVVRELEKEVRETDKRLDERVKELEEKVRRAAK

SEQ ID NO: 19296 - protein, 174 aa, Artificial Sequence; identical to SEQ ID NO: 19295
  Synthetic sequence.

SEQ ID NO: 19297 - protein, 178 aa, Artificial Sequence
  Synthetic sequence.
SEEEDARRLLEEVERALREIKKRLKELLERHRRAVEELKKRAEDLLDEHRRAIERIADERGDRDTIADKVRKEIERSHTELKKLEEEIERISRDADRRVKEIAREAEELLRELEERLERKRVSEEIKRRLKELAKDLRRAIKEVKERLKESHDELKRAIEDVKRKLEELDEKLKRDED

SEQ ID NO: 19298 - protein, 178 aa, Artificial Sequence; identical to SEQ ID NO: 19297
  Synthetic sequence.

SEQ ID NO: 19299 - protein, 172 aa, Artificial Sequence
  Synthetic sequence.
SERERVERSVEELIRRYREVLEESERRNRKLLKRYEDALKKSREDNKRLLDELRRANRGPEEFLERMERESRRIIRELEKNLERLKRESEDILRKLDKNMKDIERELKKLRDDDLPREDAERLLERIERHLRRSEKTSEELNRRLEDHARRSIEESKKLNEELERKLRELER

SEQ ID NO: 19300 - protein, 172 aa, Artificial Sequence; identical to SEQ ID NO: 19299
  Synthetic sequence.

SEQ ID NO: 19301 - protein, 182 aa, Artificial Sequence
  Synthetic sequence.
SSEETLRDINRKISKAIEEIEREAREIDRELRKAVEDLKREAEEIDERVREVIERIGTRDEDLKRLEEEIERLHRELEKKARDLARKARELHRRLEEKIRELADRLRRLSEEAEKRDGRDTEVKKVLDKNEELLKRWEDRLREVLERNRKTLREIERELEEVLRKNRESIKKLKRELEEASR

SEQ ID NO: 19302 - protein, 182 aa, Artificial Sequence; identical to SEQ ID NO: 19301
  Synthetic sequence.

SEQ ID NO: 19303 - protein, 182 aa, Artificial Sequence
  Synthetic sequence.
SSEEDLKRIDDELDKMVKDIERKIRRIDTELERVVKELKEDIERSLERLREVVERIGTREEDLTRLDKEAKDINKRLEEEARRLVDEAKKLHKRIEEEIRELEKRMEDLHKRVRDEVGDDRDVRRVLDENRKTLEDLKRKLKEVLDRNRETLKRIEKELREVHEKHNRALDELRKELEDRRR

SEQ ID NO: 19304 - protein, 182 aa, Artificial Sequence; identical to SEQ ID NO: 19303
  Synthetic sequence.

SEQ ID NO: 19305 - protein, 182 aa, Artificial Sequence
  Synthetic sequence.
SVEEEAEDILRRLDKTVRDLEREAEKIDEDLERVVRKLEEELRRSLEELRKVVEEIGSTEKDLKRLTEEAERKNKELRDRAEELADRARKLHEELRKKLEELLKRARELLKDLERRSGRDRDVTRVLRKAERVLKEIEEKLRDVLRRNRETLKRIEDELERVHRDHNRKLKRLKEELDERRR

SEQ ID NO: 19306 - protein, 182 aa, Artificial Sequence; identical to SEQ ID NO: 19305
  Synthetic sequence.

SEQ ID NO: 19307 - protein, 175 aa, Artificial Sequence
  Synthetic sequence.
DEDRDVEEKIKKIIKAAEDVNKESEERITELKKRLREIHERSERLIRRIEEEAKKKNRSRDVKRELERLERELRRLNEESERRLDELTKELRKENDEMLRRLKELTKRLRDVLRRGELDKKKLDEIIERLRKLLEDLEERNRRVIKELEDLIKENEELNRKVIRDLEKLVEDAER

SEQ ID NO: 19308 - protein, 175 aa, Artificial Sequence; identical to SEQ ID NO: 19307
  Synthetic sequence.

SEQ ID NO: 19309 - protein, 185 aa, Artificial Sequence
  Synthetic sequence.
DEEDEVRKRVEESERESRKLLTDVKREADRLKEHDKRLLDEVKKLLDKIREDLKKLPSEDEEKRKRLKELLDRIEKELRDLAKEVKERNERLDEELERLADEARKLHEEVKRRLDDLRRKSKDVDREELKRELDRIIEELKELNKRLEERLRELIRDWERVSRELAERLKRIIDKARRLLEEVAR

SEQ ID NO: 19310 - protein, 185 aa, Artificial Sequence; identical to SEQ ID NO: 19309
  Synthetic sequence.

SEQ ID NO: 19311 - protein, 176 aa, Artificial Sequence
  Synthetic sequence.
DEVEELLKELKDLSRESVRELRRLDEELKDLSRRSLKRLTDLDEELRREVEERRKENSKDDRVEEEVEEALKKSEEDLDRIIKEHRDAVRDSRRRLRRVLERHEEELDRLRREVEREGVGDERLKKLADDSRKRLRDVERHHEKLVEDSERRLKTIKDHHKKAVEDIRRDLRETKR

SEQ ID NO: 19312 - protein, 176 aa, Artificial Sequence; identical to SEQ ID NO: 19311
  Synthetic sequence.

SEQ ID NO: 19313 - protein, 175 aa, Artificial Sequence
  Synthetic sequence.
SEIDEVLKEIKRIIDELRERNRKHNEEVKDRIRRLEEELRKDLKDLKEIVERLAKSNVDREELDRILEELRKRVKEVEERLEEIRRDLERSHEELDRENRRVHKELKERLDRTNVRGEAADRARELEKELKDISDTSRKSNEELRKRLEEIKDRVRKEIEKLLRELEEIVKEKRR

SEQ ID NO: 19314 - protein, 175 aa, Artificial Sequence; identical to SEQ ID NO: 19313
  Synthetic sequence.

SEQ ID NO: 19315 - protein, 179 aa, Artificial Sequence
  Synthetic sequence.
DEEKETIKRHRESVREAERRLRDTLRRNRELVERLKRTLEDILRKHEKLVEELEEMAKRGEVDEDTLREVEKRSKDLEERLREILEKVREESERLTEELKKESEKHERDSRRLTEDLRRRSSDPEELKESHKDLKKIHEDAERRVRESHTDLRRIIEKVKEDLERSHRKLKRIADETRK

SEQ ID NO: 19316 - protein, 179 aa, Artificial Sequence; identical to SEQ ID NO: 19315
  Synthetic sequence.

SEQ ID NO: 19317 - protein, 179 aa, Artificial Sequence
  Synthetic sequence.
SEMEEVLERDERKVRELEREIEKNLRDHKDEVRRLREDLERVLREDEKLVRELRKKNSKDDRLAKEARERNKKLNDEVRKKLEDVRRKSERNKEEHKRRLDEVRRDNKRLNDDLKDRNISEELEDRMRRSSKRLEEVLRESEERLKRSDEDLRRVIDEIRRRLEESTRRLEETIKELKD

SEQ ID NO: 19318 - protein, 179 aa, Artificial Sequence; identical to SEQ ID NO: 19317
  Synthetic sequence.

SEQ ID NO: 19319 - protein, 182 aa, Artificial Sequence
  Synthetic sequence.
SEREEVLKDIRRLLDEVRRRIEDLLEKLRRLNEEVKEKVKESEKRLRDLMRKAKELMKRGLDEDTLRKVLKEVEDRLRENHKELKRVEEESRRALEDIRRKLKKVTDDLRKRLREIAEELERRGIRDEDIKRLIEELEKLLKEAKEKAEDLTREHDDTLKKIRERHKEIIKDIEDKLDTDRQ

SEQ ID NO: 19320 - protein, 182 aa, Artificial Sequence; identical to SEQ ID NO: 19319
  Synthetic sequence.

SEQ ID NO: 19321 - protein, 182 aa, Artificial Sequence
  Synthetic sequence.
DEEEELKKKLKAILEDLKREMREHEEKLRRSLERVARTAERHKETIKRIIDRLRKEAEDVPKDRRAEERLEEIRRELKKKDEDTERRSRKNEKELKDLNDETDKRLKDIEEEVKRTIKRLKDESDTSEEVKRIAEDIKRVLEEIRKRSREILEEVKRLHKKIKDDSRKLLKDLEKLVREIRK

SEQ ID NO: 19322 - protein, 182 aa, Artificial Sequence; identical to SEQ ID NO: 19321
  Synthetic sequence.

SEQ ID NO: 19323 - protein, 172 aa, Artificial Sequence
  Synthetic sequence.
SVEDEARRLEEKLRELTKRAREALEESNRRHRKSVEEVRRSLKKNHEKLEELARRVSRIDERRVREIKRRHEELLERLKDELDKSEEEHERLIEELERLLEEARREVERLRREREVDERLLKELEDLIEEVERELRRVLTESKRLNEELRKRVKEIEERSEELIERLDREVR

SEQ ID NO: 19324 - protein, 172 aa, Artificial Sequence; identical to SEQ ID NO: 19323
  Synthetic sequence.

SEQ ID NO: 19325 - protein, 172 aa, Artificial Sequence
  Synthetic sequence.
SMDESMETLTRELEDLLRKVEKKLRDSNEHHRELLEEVKRRVEENHKELDELLRRASRVPEEVLKKIRRDHDELRKELDKLLRDSERRHRELLEELKRRLEEVKRRLDKLRKDEDVTEELLTKIRKLIRDVEETVREAERESRALDERLERTVRDVEEKSKRLIEELRRRAD

SEQ ID NO: 19326 - protein, 172 aa, Artificial Sequence; identical to SEQ ID NO: 19325
  Synthetic sequence.

SEQ ID NO: 19327 - protein, 178 aa, Artificial Sequence
  Synthetic sequence.
DAEEEIRRIDKHHEENVRKAEEDIRRLIEHHKENVERVDRELRKIIREVEEVIRRVKELDERKVREVEDRLRRIKEEADRLSKESTDRLREIKKELERISEESKKELDKLRRKAREVRDERLVRELIRRLERTDEEHHKKVRRILEELKRIDEEHHRLVRRILKALKDIIKRLREEVK

SEQ ID NO: 19328 - protein, 178 aa, Artificial Sequence; identical to SEQ ID NO: 19327
  Synthetic sequence.

SEQ ID NO: 19329 - protein, 178 aa, Artificial Sequence
  Synthetic sequence.
SLEEEIEKIERHHRKLVEEARRELKRLEDKLEKLNRDSRKRLKELAERLKKLIDEIKKLDEELVKEVKRRLEELSKDLERKHRKVKKEVKELIDDAERILRESERELERLTEKLKEVRDERVARRVLDELRRLNEKLRRMVEELVKEIERLIKKVKDDSEDVMRKLKELLKRLEDRAR

SEQ ID NO: 19330 - protein, 178 aa, Artificial Sequence; identical to SEQ ID NO: 19329
  Synthetic sequence.

SEQ ID NO: 19331 - protein, 179 aa, Artificial Sequence
  Synthetic sequence.
REKEELLERLKKVLERTERVIRDLERRLREVLERSRKLAEDLVERLERSLKTLEKLAREGRVEERLLKRNHDELRKLLEDAKDKLRRINEELEKLLRDVKRELDRINEELKRLIDDATRRTGEREELREIYKRHEDLLRTAEERLRKVYDDHRDLLRKIDEDLKRLKERHEELLREIRR

SEQ ID NO: 19332 - protein, 179 aa, Artificial Sequence; identical to SEQ ID NO: 19331
  Synthetic sequence.

SEQ ID NO: 19333 - protein, 180 aa, Artificial Sequence
  Synthetic sequence.
EEKDRLKKRLEELNREHEELVRRISERVRRLLEKAEREIRTLKKRLDELNKELEEIIRRDNARDEVIKRVERIHEELEKELKELLDRLRDEMRRLEEELKRLNDEMRERHDRLRKEVKDVDEKVKKELEDVERHSRDSSRRVKEELERLKEELDRRLRKVKEDLERVKRHSKKLVDDAKR

SEQ ID NO: 19334 - protein, 180 aa, Artificial Sequence; identical to SEQ ID NO: 19333
  Synthetic sequence.

SEQ ID NO: 19335 - protein, 180 aa, Artificial Sequence
  Synthetic sequence.
SEREDLRRELEELLREHEEVVKEVKRRLEELLREHEEIVRELTERLKTINEDLKRVIKRDKASDETARELEKRHKKLEDEVRRSNERMRRTLEKLRKDLEDKNRDLERKLRRLEKDAKDISEEAEKELRDVAKRLRESSREVRETVRDVADKLRESSKKLEEELRRVKKHSKKLLDEAKK

SEQ ID NO: 19336 - protein, 180 aa, Artificial Sequence; identical to SEQ ID NO: 19335
  Synthetic sequence.

SEQ ID NO: 19337 - protein, 185 aa, Artificial Sequence
  Synthetic sequence.
SLEDLLRKVEEDAKRSIEKLEKDLKRVEDKHRELVERVKRRLDDVRRKLEEIIRDAERKGTSDEVREFLKEVERRVEKIADELRRKLERNHEELRRLADELRKKSEEVTRRLRDIMRKLREENTTDERVVREVLDELRKLLDDHNKKVKTVLDELKRSLDKLREEVKKVEDKLEEILKTLKETVR

SEQ ID NO: 19338 - protein, 185 aa, Artificial Sequence; identical to SEQ ID NO: 19337
  Synthetic sequence.

SEQ ID NO: 19339 - protein, 181 aa, Artificial Sequence
  Synthetic sequence.
SLEELIREIEKELDDLLREHEDLLRKIKEEIERLIREARELIKRLEEENEELRRNLRTDKETLERLEKRSEELKDENRKNLRKVEETLKRLEEKLRKHNEDLRREIEKLKKELRDAAREGMSEEEVKREIDRVRRVIEELRESVERLREEVRETLRRLKEHVKKDVEDHKETVKEVERRTR

SEQ ID NO: 19340 - protein, 181 aa, Artificial Sequence; identical to SEQ ID NO: 19339
  Synthetic sequence.

SEQ ID NO: 19341 - protein, 177 aa, Artificial Sequence
  Synthetic sequence.
DTEDLIREIRRRLEESVRENKELLDRLRERLEESIKRNEDLLKRHRENSKRIADRVRSDEELERVKKEAERLHKESRDKDRDLRKKVEDLARRSEELDKELRKRLKDLERELREAKKTRELVKEMIDRLRDLLRRHKEESKRLVEEVKKLLDRHREESERLVRELDKMNKDLEDRAR

SEQ ID NO: 19342 - protein, 177 aa, Artificial Sequence; identical to SEQ ID NO: 19341
  Synthetic sequence.

SEQ ID NO: 19343 - protein, 173 aa, Artificial Sequence
  Synthetic sequence.
DTKELLDELRKRLEDSARRVEELEKRVKDELERLKKRSEELLDEIRKRMKDVRDRGLVSEEVLRRLEELLRRVTEKVKRLNEELERKTREIRKKLRESVEELRRRLEDAERLKERLDKDELVRRLDETLKDHDRKLKELVDEAKELLRRYEEESKRLKRELDEILRRVREEAK

SEQ ID NO: 19344 - protein, 173 aa, Artificial Sequence; identical to SEQ ID NO: 19343
  Synthetic sequence.

SEQ ID NO: 19345 - protein, 178 aa, Artificial Sequence
  Synthetic sequence.
REIEEVRKKVEKILRDYDKVVKDIVEKVRRILEEYRRKSEKLTREIEEILRRLREVIKRDLRKEELDELKERVRELLDRLRDKLRKLNEELRKLLRDLEDEIRRLDEKLKELIRDLERKARDEDSLREIRKEARRLHEKSKKLLDEIRKRAEDLERETKKLLDDIKRELEDVVRELEK

SEQ ID NO: 19346 - protein, 178 aa, Artificial Sequence; identical to SEQ ID NO: 19345
  Synthetic sequence.

SEQ ID NO: 19347 - protein, 172 aa, Artificial Sequence
  Synthetic sequence.
RELEELLKRAEEVIKELKKSIDTMKEENDRLITELAKRVEDLKKRNDDVLERLKKDNIDEKTLEKIIRKLRRENEEAMKTLKKLVDDIRKRNDEHNKELKKLARDLREDLKRKVKSEEVLKEIDKRLKELEKEHEKVNRESEKRLEELLRRVEKVNRDSERELERLREERET

SEQ ID NO: 19348 - protein, 172 aa, Artificial Sequence; identical to SEQ ID NO: 19347
  Synthetic sequence.

SEQ ID NO: 19349 - protein, 174 aa, Artificial Sequence
  Synthetic sequence.
SEIEEVLERAERLLRRVAEALRRTTKELEDLNREVADLLRRTTEKAERLIRRVKSKIDKEEVKTRIDRLLDRSKDLTKKIKKRSDDSVKRSRELTDEIRRDLERLLRTLKKLADDGVPVEELKRVADEVVKKADDLVDEDRKLAKDSVDELRRLVEKDEKLAKDVVEEVEKLAE

SEQ ID NO: 19350 - protein, 174 aa, Artificial Sequence; identical to SEQ ID NO: 19349
  Synthetic sequence.

SEQ ID NO: 19351 - protein, 177 aa, Artificial Sequence
  Synthetic sequence.
SLEDAVRKARELIKRAEDILRRAVEEAKKLHKRSKEILEKAVEDAKRLYEEAKDAARKAGADERVIKELEENAKRVEEEAKKVKDDNDRLAREIKRRAEEVEKRARDLARKLDEEAKRNADAKTILDKAREVAERVARLARKLLEDSRKVARESAELAKRLLEYAKKSAEDAKRKAK

SEQ ID NO: 19352 - protein, 177 aa, Artificial Sequence; identical to SEQ ID NO: 19351
  Synthetic sequence.

SEQ ID NO: 19353 - protein, 185 aa, Artificial Sequence
  Synthetic sequence.
SIDEVLKELEDVARKSKEKNKRVHDDDERVVREVHKENRRVLRELEEMAERVRRELEKRGVPEEVLKRLEELIEELKRDLERSDDELRRSVEESEKRNRETNKRLDDHVKEVRRTVEKIKRDNQEEEKVVRRVKDIARHNLELADRSVEESRKSVKENKDLVDRSVKKVEDLVRELKRLVDEIKR

SEQ ID NO: 19354 - protein, 185 aa, Artificial Sequence; identical to SEQ ID NO: 19353
  Synthetic sequence.

SEQ ID NO: 19355 - protein, 185 aa, Artificial Sequence
  Synthetic sequence.
SIDEALTRLERAVEESHKRNEDVHRRDEEAVREVHKRNREVVKKLEDEVRKVIERLRRRGVDERVLRRLEEEIDKVRDELRRSDEELKKSVDDSKRRNKESDDELKKHVDELRRTIKTMKDSRVREEEVVRRIDELVEHNKDLVRRSVDESDKSVETNKDLVEKSVRRVDKLVKDLRRLVDEIER

SEQ ID NO: 19356 - protein, 185 aa, Artificial Sequence; identical to SEQ ID NO: 19355
  Synthetic sequence.

SEQ ID NO: 19357 - protein, 185 aa, Artificial Sequence
  Synthetic sequence.
KIDEALKRLREVVKRSHEENEEVHKEDEKVVRELDKENKDVLKELDEAVKRVEKKLRDRGTPEKVLKELKDLIDKVEKDARKTNEELKESVKRSAEENKKSNEELRDHARKLDKTVRDMKENRVREDEVVKRIDELVTHNKRLVEESVERSKESVDRNRRLAEKSVEDVRRLVEELKKLVDDITR

SEQ ID NO: 19358 - protein, 185 aa, Artificial Sequence; identical to SEQ ID NO: 19357
  Synthetic sequence.

SEQ ID NO: 19359 - protein, 177 aa, Artificial Sequence
  Synthetic sequence.
SLEEVLRRLEKVVRDSDKRLEEVLTRLAKVVRESNKRDEDVHKELRDVVRRVEELLERSNVPGEALKELRRLLEEVEKRNRDSKRESEKSEEEIRRRAKKVLDDSRKSLEEIRRLVENGVSEETVDKLVEDNERLVREIVKEVDELVKRNEDRARESVDESRKLVRRIEERVREETR

SEQ ID NO: 19360 - protein, 177 aa, Artificial Sequence; identical to SEQ ID NO: 19359
  Synthetic sequence.

SEQ ID NO: 19361 - protein, 173 aa, Artificial Sequence
  Synthetic sequence.
SVEDVLREAKRVLDEVRERLREVNTETNKVIKDVKKESDDVNRETNELIERVAREVPRTRELEEIEKEVRELDERNRKTSKELVDTVRKLDDENRKRIEEVEKEVEDRLRELRKRRLTEEVERLVDEVRKLVKRLVEHVKKLAKEIKELLERNVRHVEEVAERIKRLIKETKD

SEQ ID NO: 19362 - protein, 173 aa, Artificial Sequence; identical to SEQ ID NO: 19361
  Synthetic sequence.

SEQ ID NO: 19363 - protein, 177 aa, Artificial Sequence
  Synthetic sequence.
ELREDVERVVDEIRRLVEENVRRIDEVAKDIKRLADDNVRRVKELVRKIEEDIRRLKEEGVTEVVDELREEVRKLSEDNRRHSRELIERVKKLLKELEEHSRDLKRRVKELLEDLKRKGVDERVLKKLKEVIEDVERKSRDALRRLEEAIRRVRRESERVNRELDEVIKRVTEELKK

SEQ ID NO: 19364 - protein, 177 aa, Artificial Sequence; identical to SEQ ID NO: 19363
  Synthetic sequence.

SEQ ID NO: 19365 - protein, 181 aa, Artificial Sequence
  Synthetic sequence.
SAREKVEKVVKEVEELVKRDVEEVERIVEEVKKLVTEDLKISEEIVERVDRLIRELKKEPKSDEFRKKVEEVRERVRRLLEENRRHTEELERRVEELLKELEKHTRKVKDDIKKLLDRLREDGVDERVLKKLEDVVRRVEKESEDALRRLKEVIKKVKRESEEANRKLEEVIRRVVERVRR

SEQ ID NO: 19366 - protein, 181 aa, Artificial Sequence; identical to SEQ ID NO: 19365
  Synthetic sequence.

SEQ ID NO: 19367 - protein, 174 aa, Artificial Sequence
  Synthetic sequence.
SRSEKLVDEARKMVERSKEIVDKSEREVEDVVRRARRNVEKVLKDAKKVVDEVDELTKRGTDKETLKERLREILERIERYIEESKKDLDRILEELERKHRENKERLRRILEKIRRDGVGEDVLREVEELVRRVEEENDRVLKRAKELVEDVKRKHDRVLETVRKLVEDVTRRLK

SEQ ID NO: 19368 - protein, 174 aa, Artificial Sequence; identical to SEQ ID NO: 19367
  Synthetic sequence.

SEQ ID NO: 19369 - protein, 174 aa, Artificial Sequence
  Synthetic sequence.
DEVDKVKEELERVIKEVDERNKRSSERLEEVNRKIRKEIKEVVERLKELIERVLRKVEGRREVKRLTDEVRKRVEDLRRKVEDVSRKSKEDNERSNRRSKELVKRVRELLKSARRREGVDEIRRLVEEVLRRARKLVEEDKELIKKSLKDLKTIVDELRKLLEDVIREAERTAR

SEQ ID NO: 19370 - protein, 174 aa, Artificial Sequence; identical to SEQ ID NO: 19369
  Synthetic sequence.

SEQ ID NO: 19371 - protein, 170 aa, Artificial Sequence
  Synthetic sequence.
EEVERILEDVRRMIEDHRRKVEEIVKRSEDMARRLIEEVKRIVEESKKLADELKKEDGSEELRRKIDKRHKESEELLKDIERKLEEVHRDSERRLKENKERIDRTREEVEKRGVDEDVRRELKRLVDEVKKRNDEVRERDKEVVDRVKEVLDRVRETDRRLVEEVRRRAN

SEQ ID NO: 19372 - protein, 170 aa, Artificial Sequence; identical to SEQ ID NO: 19371
  Synthetic sequence.

SEQ ID NO: 19373 - protein, 170 aa, Artificial Sequence
  Synthetic sequence.
SRVEKILEDVKEEIKKHKEEVDRIVKRSREMAKRHIERVDEILERSRRMIEELKKREGSEDLERELERVHRESEKLLRENEKRIKETHEKSKRDLDENRKAIARTEEEVRKAGVKEDVERELRRLVEEVEKRNEDVEREDRRLVEEVKKRNDEVRKEDRRLVEEVKERAR

SEQ ID NO: 19374 - protein, 170 aa, Artificial Sequence; identical to SEQ ID NO: 19373
  Synthetic sequence.

SEQ ID NO: 19375 - protein, 183 aa, Artificial Sequence
  Synthetic sequence.
DELEKVEKDVRRLLEKVRKRIDEVRKEVERLSRESEEVTRRVLETVEKLLKDVERVIRETLKDDDEKLRDLERLIREIREKVRRAVETDEERNKRLNDKLKKLLEDLEDKIRKLEEELRKAKETGKPVEEVLETVKRLIERIEEEIEKVVKDVERLVRESIKHSRDVLKEVDDLIKRIRERVK

SEQ ID NO: 19376 - protein, 183 aa, Artificial Sequence; identical to SEQ ID NO: 19375
  Synthetic sequence.

SEQ ID NO: 19377 - protein, 174 aa, Artificial Sequence
  Synthetic sequence.
DDDKRIREILRRVHEKSEKVLRKVRKRLEEVRRESEEVVRRVKKDLDRVLEEVRRKGVSEELLKELEKIIEDIERHLKKNRDDVERKVREIEKKLRKLLEDDRRVVKEIEEKLRSGDGREDVAREVEEIAKRTIDRVEAIVREVERIARESIDNVRRVVEEVKRAVTELIKRVE

SEQ ID NO: 19378 - protein, 174 aa, Artificial Sequence; identical to SEQ ID NO: 19377
  Synthetic sequence.

SEQ ID NO: 19379 - protein, 174 aa, Artificial Sequence
  Synthetic sequence.
SEDETIRRIVRTVHEESRKSTEDVRREVERVLRESEEVVKKVKKKVDDVLKRVEETGISEELEERMRRIIREIREHLKDNLRRVREVIERIERKLEETERRDEKVLREIEKKIRDGDGREEVAREVTKIARDTIRENEEIAKEVREIVERSIKNLEEVAEEVERVVRELIEARR

SEQ ID NO: 19380 - protein, 174 aa, Artificial Sequence; identical to SEQ ID NO: 19379
  Synthetic sequence.

SEQ ID NO: 19381 - protein, 174 aa, Artificial Sequence
  Synthetic sequence.
SRDEKIRDILRRVLKEVRDSTKKVEEDLEDVHRRTEEELRKVKKRLDEVLKRVRDEGASEELKRRMEEVVRRIEELLKKLLKEDRDVVKEIRDKLDETRKEMEEVAERIKDKIRRGDGREKVAEEVKRIADRLIDLNRRIAEEVDKIVRDSIKKVEEIVTEVEKIVEKLIRDVR

SEQ ID NO: 19382 - protein, 174 aa, Artificial Sequence; identical to SEQ ID NO: 19381
  Synthetic sequence.

SEQ ID NO: 19383 - protein, 170 aa, Artificial Sequence
  Synthetic sequence.
DRLEKIVEEVRRLADELIRHVERNVREVEKAVRESIEHVRDVAEKVERAVRELEKREGSEDLDRELDRVRREIEELLKRNKDRITRVVDKSRRSSEENKRELKKVEDEVERRGISEEVRKELKRVIREVEKVNKESNDVTRKVKEESEKVLKEVEKRLREVIRRVKEKIR

SEQ ID NO: 19384 - protein, 170 aa, Artificial Sequence; identical to SEQ ID NO: 19383
  Synthetic sequence.

SEQ ID NO: 19385 - protein, 170 aa, Artificial Sequence
  Synthetic sequence.
SEVEDVVRKVEKLVRDLIKHVEENVRRVEEVVRKLIEEIKRIAEEITRIAEELAKEPGSEDLLRKLEKVLKEIDDKLKELEDRLRDMVRRSRESSEENERRLKRVEDEVRRNGISEEVEKVLREVVKEVEKVNRESREVTRRVLEEAKEMLERVKKIVKEVIEKVRRVVK

SEQ ID NO: 19386 - protein, 170 aa, Artificial Sequence; identical to SEQ ID NO: 19385
  Synthetic sequence.

SEQ ID NO: 19387 - protein, 184 aa, Artificial Sequence
  Synthetic sequence.
SADREVEERLREVIERVKEALKRSKDVTDEVTRRVEKLDKESNDTSREVIRRVEDMLSRVSDEDKVRRIKEELERVRRESEETSKKNKRELDEVRKDSRRTLEDIRRKLEEVERRIREELREVRDDELVKRIVEKVDKAVKDLEKLVRENVERVRRAVERSRKTVEDNVKRSRDVVRELRERVR

SEQ ID NO: 19388 - protein, 184 aa, Artificial Sequence; identical to SEQ ID NO: 19387
  Synthetic sequence.

SEQ ID NO: 19389 - protein, 184 aa, Artificial Sequence
  Synthetic sequence.
SSIDEVREEIRRVIEEVRKLLEESKKDTDRVRREAEDMDRKANETVEEVERRVREVLRSVSDERKVREIEKKLEDMLRELKKRSDDNKRRLEDLVRRSDKTLDEIREELERALREIEEVLEKVDKEEVVRRILKRIEEVLKKLRKAIKDNVDRVRDAVRRSRRTVEDIVRRVREVLERLEREIK

SEQ ID NO: 19390 - protein, 184 aa, Artificial Sequence; identical to SEQ ID NO: 19389
  Synthetic sequence.

SEQ ID NO: 19391 - protein, 175 aa, Artificial Sequence
  Synthetic sequence.
SLAEEVERRLEESHKRARKLVKEVKEALEESHKESDRLVREVEKELKRVAEEVRKEGIDEKRLKEIKELVDTIRKEIKEVLDEDRRTVKEIKEEVEKIVEDLERLHREIRKEIEKVKEAVEKVRDLVRKTTEKVEEVVRRLRELVKENLDEAKRVVEDLKRKVKEIEEKVKEDSK

SEQ ID NO: 19392 - protein, 175 aa, Artificial Sequence; identical to SEQ ID NO: 19391
  Synthetic sequence.

SEQ ID NO: 19393 - protein, 178 aa, Artificial Sequence
  Synthetic sequence.
SMAEKVDEVSKRSKEELKRVVKEVHEVSTRVEKVVKDVLREVEKVSKESTDVVDRVGVDSETLKDLKRRDKELLDRIRDKLRRMLEDLRRLNKEAEDLIRRLETEDEKLLRDIRRKVRGREVVDKVVRDLEKTVKDVKEVVDRAVTASKELVDRIRRLAEEVVRALERTVDKVRRDAK

SEQ ID NO: 19394 - protein, 178 aa, Artificial Sequence; identical to SEQ ID NO: 19393
  Synthetic sequence.

SEQ ID NO: 19395 - protein, 178 aa, Artificial Sequence
  Synthetic sequence.
DAREEVDEVSRESKEELKRVLDEVDDVSEKSRKTVRDMLRKNKEVVDEVEKTLEDVGVDSRKVDELRKRIKTLSRKSEEDVRKLLKRDEDLLRRIREEVKRLLDEDEKLLKDIRDKVRGKEVVKDVVRKLRETVKRVREVAEEVVRELEKTVDEVRKRADDSVKKHRDLVKEVKEAAD

SEQ ID NO: 19396 - protein, 178 aa, Artificial Sequence; identical to SEQ ID NO: 19395
  Synthetic sequence.

SEQ ID NO: 19397 - protein, 178 aa, Artificial Sequence
  Synthetic sequence.
SAEEDVERVVREVEREVREALRRVREVSERSREDVRRVVDENRKVAEEVEKRVRDVEVDSEDLRKLLEDIRRVSEESERLARELLKEDEDLLRRIEDTVRRLLERLKDLLEDIRNKVRGEEVVREVVKKLREIVKDIRRLAEEVVRRLEDTVRKVREIAKRSVDAHRELVRRVEERAR

SEQ ID NO: 19398 - protein, 178 aa, Artificial Sequence; identical to SEQ ID NO: 19397
  Synthetic sequence.

SEQ ID NO: 19399 - protein, 174 aa, Artificial Sequence
  Synthetic sequence.
SSAEEVERVLRRVEEEDRRLVAEVRRVLKESRRTLEELVRRVKEVLEEVRKEVERIEVSEEVLREIEELLERLDRELDEVLKESEDTLRAIEKKLEEVHRRTKKLLDELREVLERGKDAKELIKRVEEIVEESRKLIDEAIREVEENVDRSRKKIKELIDRVREILKRARDRAR

SEQ ID NO: 19400 - protein, 174 aa, Artificial Sequence; identical to SEQ ID NO: 19399
  Synthetic sequence.

SEQ ID NO: 19401 - protein, 174 aa, Artificial Sequence
  Synthetic sequence.
DSEEEVKKVLDEVRRRDEKLVEEVRKVNEDSLDTLRKLAEEVKRKLDEVRERVERLEVSEDVLRRIEELLKDLKRRLEEVLRKSEETLRRNKEEIEKTHKDTRDELKELEELIKAGKDAEELIREVERIVKKSEDMIREHIRKVEENVEESKKEIEELIRRVDDILREAKEAAD

SEQ ID NO: 19402 - protein, 174 aa, Artificial Sequence; identical to SEQ ID NO: 19401
  Synthetic sequence.

SEQ ID NO: 19403 - protein, 174 aa, Artificial Sequence
  Synthetic sequence.
SGEEDLERVLDEVRRRDKKLVEEVRKRNEDSLRRLERLAEEVERVNEDVLKKVEELRVSEEVLKEIEEELRRNKEAIKRTLKRSKETLDKNERDIERTHERTKKKLDEIRELIKAGKDASEVRKLVEEIVTDSRRRITEHIRRVEENAKDSERVIREHKERVKEILEKVRRAAE

SEQ ID NO: 19404 - protein, 174 aa, Artificial Sequence; identical to SEQ ID NO: 19403
  Synthetic sequence.

SEQ ID NO: 19405 - protein, 181 aa, Artificial Sequence
  Synthetic sequence.
SEVEKLVEDVKKAVKEVLEEAKENVRKVEDVVRRVLERAEDNVEEVKKVVATLVDLVRRGDRRERLEERAKRINDESRKHLDKLERDVERMSKESEKHLRELEKKVEEILKEVEDRLSRVDGEELMREVRRVIKEVRDRVRDVLDEVRRVNEEVNRRVRKVLEDVRRVNERTKEDLDRESK

SEQ ID NO: 19406 - protein, 181 aa, Artificial Sequence; identical to SEQ ID NO: 19405
  Synthetic sequence.

SEQ ID NO: 19407 - protein, 181 aa, Artificial Sequence
  Synthetic sequence.
SEVDKLVREVDELVKKSKDNIDKLVKRVREMVEESKRKADRNVEEVERVVREIKDLARRGDRDERLRREVRRRNEESRRHLEKNKKESDDMLKEVKDHLDRNLKESEEELKRVEDKLKDVRGDELVKKVRDRLEEVERRTRKALEDVKRVLEDVKRLTDTALREVERVNRKTEEEVDREIR

SEQ ID NO: 19408 - protein, 181 aa, Artificial Sequence; identical to SEQ ID NO: 19407
  Synthetic sequence.

SEQ ID NO: 19409 - protein, 181 aa, Artificial Sequence
  Synthetic sequence.
DKVDRVVKEIEEAVKENLDRVREIVKEVRDLVRENLEEVRKSVEDVKRLVKEILELVRAGVPEEDLKRTLDEVVKRSEESLKRLKEHTERVEERLDRLLRELKKHTDDVKRRVEELRKDSTDEDAVRKVEEVLREVEKRSTEALKELRDVLREVRRESEEALDENRRVTEEVKKKVEDERK

SEQ ID NO: 19410 - protein, 181 aa, Artificial Sequence; identical to SEQ ID NO: 19409
  Synthetic sequence.

SEQ ID NO: 19411 - protein, 181 aa, Artificial Sequence
  Synthetic sequence.
SEVEEIVREIRDLVRKNEERVKKIVEDVRRAVEEILELAERSVEKVKRLVDDLRRLAENGVPREKLREDLRKIVEESKESLRRLERKLEEVKDTLRRLLEELKEHTDRVARRLEELRRRTTDEEAVRKVDRVLEEVEKRSRDALKELEEVLKEVERLAREVLEKNERVTEAVEDLVTKAAK

SEQ ID NO: 19412 - protein, 181 aa, Artificial Sequence; identical to SEQ ID NO: 19411
  Synthetic sequence.

SEQ ID NO: 19413 - protein, 178 aa, Artificial Sequence
  Synthetic sequence.
DEEERVREELERVNEEVKELKKEVETVNKRVHETLEKVIREVKKVNDDVHRTVEDLRRRGLLTEEVIRDLERASRESEDELRKVREKLRRASEESRDKLREVEERHEKLSRDIEEELRAGGDVEEIVKKIKEVVDRTRKLAKELVKESRDLAEDVKRLIKRLVEDSRRLVEEIKERAR

SEQ ID NO: 19414 - protein, 178 aa, Artificial Sequence; identical to SEQ ID NO: 19413
  Synthetic sequence.

SEQ ID NO: 19415 - protein, 178 aa, Artificial Sequence
  Synthetic sequence.
SEEERVEKRLREVNKDVKRLVKKVRDVNRKVHEDTKRLVEEVRRVNRDVHRRVKELREAGKLDEEVIKDLEKASEDSKRELEKVVRESEDSSRRSEEKLRRVEERHKRLSEEIRRKLESGGDVDKIVEEIDKVVTETRELAERLVKESEDNVERSRDLARKLVEKSERLVKEIDDRAR

SEQ ID NO: 19416 - protein, 178 aa, Artificial Sequence; identical to SEQ ID NO: 19415
  Synthetic sequence.

SEQ ID NO: 19417 - protein, 178 aa, Artificial Sequence
  Synthetic sequence.
SAAEKVREELERVNRRVEELLKKVKKVNEEVRDIVRKVVREVERVNKEVEEEVKRLVDQGRATEEVKKTVDKLSEDSRRKLKEAIEELEKRSRESEKELEDVKREHDRLSEEIERELESGGDVEEIVKKIKDVVKRTDELAERLVETSERLARTIKKVAEDLVRDSKRIVDEVRTRIT

SEQ ID NO: 19418 - protein, 178 aa, Artificial Sequence; identical to SEQ ID NO: 19417
  Synthetic sequence.

SEQ ID NO: 19419 - protein, 178 aa, Artificial Sequence
  Synthetic sequence.
SDEDRVRRRLEEVNREVEELLRDVERVNEEVKRRVKKVIREVEEVNKRVEEEVKRLRDEGRLDDKDIKRLKEASDKSREDLKRVEEKVEKLSRDNKKKLDDVKRRHDELSKRIDEELKSGGDVEDIVRKIDDVVRETRELAKELVKHVRDVVEDVRRLVKELVDLSEKLVKEIRDKVE

SEQ ID NO: 19420 - protein, 178 aa, Artificial Sequence; identical to SEQ ID NO: 19419
  Synthetic sequence.

SEQ ID NO: 19421 - protein, 182 aa, Artificial Sequence
  Synthetic sequence.
SEVEKVVKEMEDLARENERLAREIVKDVERLVREIEDTVRRSVETTRRLVEEIRELAERGVDERELERFLKEIEERNRKSREDLDRLLEKIERKVRKVDRDSDRSLERIRRRIDDVRRKINSDERVLELLERVLRELEKVVEDSKRRIKEVLDELRKAVDKVKKEDKKVHDELRKVVEEVRT

SEQ ID NO: 19422 - protein, 182 aa, Artificial Sequence; identical to SEQ ID NO: 19421
  Synthetic sequence.

SEQ ID NO: 19423 - protein, 185 aa, Artificial Sequence
  Synthetic sequence.
RVEELLRKVITELDRVLEEVRRRNEASIEELDRVLKEVERLNKEVDEELKKVLEKVRKDVSDEKKVRELEREVREISRRNEKLLRELREEVKRIKERNKRLLEELERTARRIKKRLEDLLRKLKDVEEVVRRIVEEIKKVIDELREESRRTVREVEKLVKEILDRSRKTVEEVKRLAEEIERKAK

SEQ ID NO: 19424 - protein, 185 aa, Artificial Sequence; identical to SEQ ID NO: 19423
  Synthetic sequence.

SEQ ID NO: 19425 - protein, 178 aa, Artificial Sequence
  Synthetic sequence.
RVKELVDEVKRKVEESMRESTERNRTATEKVEKSLRDSEKLNRDATRKLKKVVDDVRREGRVPEEVERRVKEILDKNNEDMKKVLEETRRILKDNNEELKRVLKETRDLLKELDDEVRETKIDEEVVKKVEDVVERNKDLVRKSVEHIDKVVKENRELVKRSVEHIDRVVKEARERAR

SEQ ID NO: 19426 - protein, 178 aa, Artificial Sequence; identical to SEQ ID NO: 19425
  Synthetic sequence.

SEQ ID NO: 19427 - protein, 178 aa, Artificial Sequence
  Synthetic sequence.
SAEELVKRVLDDVRRSAEESERLNREATEEVKRSLEKSRKDAERVLRDLERVVRKVKTEGAVSDEVVKEIEDIVRELRKEAEKVHRETEKLLKDNNDDARRVHEETKELLERLRREVRETRIDERVVRKVEAVVERNRKLVEDSVRHIREVVKRNEDLVRRLVEEVKRVVKKAEDKAR

SEQ ID NO: 19428 - protein, 178 aa, Artificial Sequence; identical to SEQ ID NO: 19427
  Synthetic sequence.

SEQ ID NO: 19429 - protein, 178 aa, Artificial Sequence
  Synthetic sequence.
DVEELVKKVEDMVRKVIEEVKKRNTDVTRRVEESLRKSTELVREAEERLRRTLEELRRRGLAPEELVERLRRLLERVKREVERVHEETKRLLKRNNEDMKRVVEELKKLLDRLREEVRDTRISEEVVRKAEEVVKRAKELVARSVKHVDEVVRRNEELVTRLVRELDELVKEVRETAR

SEQ ID NO: 19430 - protein, 178 aa, Artificial Sequence; identical to SEQ ID NO: 19429
  Synthetic sequence.

SEQ ID NO: 19431 - protein, 178 aa, Artificial Sequence
  Synthetic sequence.
RAERLVREVARRLEEVLKEVEKLNKDATDKVKKSLEDSRKKNEDVTREVRRVIEELRTRGDISKDVVKRIEDILRENNRRIAEVHRETKELLKRNNDEARKVKKKAKEDLERLTREVRDTKIDEDVVRRAEELVERLRKIAEDSVRHLEEVVRKNERLVKESVDHVRTAVEELKETAR

SEQ ID NO: 19432 - protein, 178 aa, Artificial Sequence; identical to SEQ ID NO: 19431
  Synthetic sequence.

SEQ ID NO: 19433 - protein, 178 aa, Artificial Sequence
  Synthetic sequence.
DAEEKVKEVEREVEKVIEEVKRDNTRVTEENKRVLDTVRERNKRVTDELRKVLEDVRREGSVPEEVVRRAEEILKRNNDEVREVLRESERRLRENNERMKRVEDDIRKLTKELREEVRDTKIDEEVVKRIADVVKTVKRRVDESVKDIKRSVKETEDRVDRSVRHVEEVLKELRKASE

SEQ ID NO: 19434 - protein, 178 aa, Artificial Sequence; identical to SEQ ID NO: 19433
  Synthetic sequence.

SEQ ID NO: 19435 - protein, 178 aa, Artificial Sequence
  Synthetic sequence.
SAEDKVRKVKKEVEKVIKDVKEENRRVTRENEEVLDRVKKDNERATRKLRKVVEDVRREGRVPEEVVRKVTEELRENNKRMKEVLDKSRKKLEENNKRVDEVVEELRKLLEDLDREVRDTKIDERVVERIKRVVERVDELVRRSVKDVKDSVRETRKLVDDSVKDIDRVVKEARDRAK

SEQ ID NO: 19436 - protein, 178 aa, Artificial Sequence; identical to SEQ ID NO: 19435
  Synthetic sequence.

SEQ ID NO: 19437 - protein, 178 aa, Artificial Sequence
  Synthetic sequence.
DAKDKVRKVLEEVKKVIEEVERRNRTVTRENERVLKEVKDRNTEVTKELKKVVEDVKRRGDVPEEVEDDIRRKVEKNNRDVEKVLDDSRRLLEENNKKAEDVKRKLEDELRKLEEEVRRTKIDEEVVDRVRRVVEEVTELVRRSVEEIKESVKTTRDLVRKSVKNIRDLVEEAKRRAD

SEQ ID NO: 19438 - protein, 178 aa, Artificial Sequence; identical to SEQ ID NO: 19437
  Synthetic sequence.

SEQ ID NO: 19439 - protein, 174 aa, Artificial Sequence
  Synthetic sequence.
DEVETVVRDVKRLVRENERKVREIVKTVDKLVKENEDLVKRSVEELKKLAKEIKDLADEGVDKRELDEVLKRIRERSERSKRESDRTLEKITRDIERVKRESRKSLEDVRKRLEDFPESEDLRRVKKEAEDVVRDSERLIEEVKRRVKKVVDDSRRKDEEALRDVERVIEEVRR

SEQ ID NO: 19440 - protein, 174 aa, Artificial Sequence; identical to SEQ ID NO: 19439
  Synthetic sequence.

SEQ ID NO: 19441 - protein, 174 aa, Artificial Sequence
  Synthetic sequence.
SEVDDVVRRVKKLVKEDRDLVRDSVRKLDELVRDDKRLVDEVVERLERIVKEIEDLMREGVDERTLREVLKKAEEVVRESKERHDTTLERVKDVVRRSREEHKRTLDEAKKEIDRVPRSEKLEEVLKMLEKVSDEVKKENDRALKKVEDVSREVKELNKEVLKRARDVVERVRT

SEQ ID NO: 19442 - protein, 174 aa, Artificial Sequence; identical to SEQ ID NO: 19441
  Synthetic sequence.

SEQ ID NO: 19443 - protein, 178 aa, Artificial Sequence
  Synthetic sequence.
SSKEKVKKVLDKVKEVLDRVRELVKRVDRESEKVVEDVRRKNKRASEKVKTVIRDVEEKKQVPEKVVKEVEELLKRNNDTMKRVVDESKKTLDKLREEVKRVREDIKRLLRELEDVVDRGKDVDDVLRKVEEIVRKVKDMVRKILEKAERNVEETERVVTESKENADRIVKEVEDRAR

SEQ ID NO: 19444 - protein, 178 aa, Artificial Sequence; identical to SEQ ID NO: 19443
  Synthetic sequence.

SEQ ID NO: 19445 - protein, 178 aa, Artificial Sequence
  Synthetic sequence.
SAREAVTEVLRKVREVLKRVEDENRKVSKELRDLLEEVERRNRDLTEKVKRLIDELKERGRIDDKAVRDLEKLLEDNNRDVKRLLEEIDKLIKDNNKKVEKVLREIRRLLERLEDVVDRGVDVERILEEAERIVKELEEVLEESLRNVKEILKKLEDALRKSEEDVRRILERVEEEAR

SEQ ID NO: 19446 - protein, 178 aa, Artificial Sequence; identical to SEQ ID NO: 19445
  Synthetic sequence.

SEQ ID NO: 19447 - protein, 178 aa, Artificial Sequence
  Synthetic sequence.
REVEEVLRRIKEMVKRIEELVRRSEDRAKKLVDTNRDLVRRSEERFRELVKEIEDVAREGVDEKELDKIRKKVKKESDKSKRTLEESLERVEEDSKRVEDELERILREIKEEVDRMREEGVDVEELERVLREVEKVVRDVRRRNEKATRDVRRSVEESRRLDKRALDEVRKRIEEVRT

SEQ ID NO: 19448 - protein, 178 aa, Artificial Sequence; identical to SEQ ID NO: 19447
  Synthetic sequence.

SEQ ID NO: 19449 - protein, 174 aa, Artificial Sequence
  Synthetic sequence.
RVEEVLKRVLDKLRESNKDSERLVREALKEHEEVNKEVEDRIREVLRRVEEVLKKVEKDKGRDKELEKIRKVLKDLADEVRELLKRLNDVLDRIRKEVKKLSDESNELIKELERANLPAEDIKRLVDEIVDTDRKLVEEVKREAKESVKESEELVERVKRKADRIVEEVEKTVK

SEQ ID NO: 19450 - protein, 174 aa, Artificial Sequence; identical to SEQ ID NO: 19449
  Synthetic sequence.

SEQ ID NO: 19451 - protein, 174 aa, Artificial Sequence
  Synthetic sequence.
DEVEEVRKTIERLVDRIEDVVRRVLELSRDTVRKNEDLVRRIEEELTKLVEDIKDVSRKREPEEVIETLAREAERILEEVKRLDEESKRESEKKLEEIKRELEELAEELKRISDSVERAELLEEVERLLEEVLRKAEKVIEDARKLDEDVNRKSNKVIEDVARRLEKVLKEVKD

SEQ ID NO: 19452 - protein, 174 aa, Artificial Sequence; identical to SEQ ID NO: 19451
  Synthetic sequence.

SEQ ID NO: 19453 - protein, 177 aa, Artificial Sequence
  Synthetic sequence.
SVEDVIRRVKEKSEEVLKRLKEVIDEVKKRSEDVLKEVEDAIDEVRRRSEEALDRVRRAGLDKKDLERLRRHSEELVKRVRKLLEDLRDHSRKLVEEVRKLLEDLRDHSRKLVERARRERKSEEARDLADRDVEDVERVVTDIRRLVEKNVRDVRRVVREIEDAVRRNVKEIDRRVK

SEQ ID NO: 19454 - protein, 177 aa, Artificial Sequence; identical to SEQ ID NO: 19453
  Synthetic sequence.

SEQ ID NO: 19455 - protein, 177 aa, Artificial Sequence
  Synthetic sequence.
SVEELIERVKRRSEKVLRDAEKTIRDLKKDSKRVNDELEKVIRDVMEKSKTALDEVRRRGVPKEVLERLERSSRKIKRDVEKLSEDNRRHSEELERRVEELLRKLKKHSEELEEEARRKRVSEEARRLVERDVEDVKRLVEEIKKLVTDNVRTVEDLVRRIKREAEENVKEIKEEVR

SEQ ID NO: 19456 - protein, 177 aa, Artificial Sequence; identical to SEQ ID NO: 19455
  Synthetic sequence.

SEQ ID NO: 19457 - protein, 178 aa, Artificial Sequence
  Synthetic sequence.
SDVDRAVETNDKVVTEIVERVKEVVERNREIVERISTTVDEMVRRNRDIVRRVAERVSDKEKVDRVVKHVEDTVRTIRDLVRRIREHVRRTVERIRKLAEEITERSKRLSDEIRKVGSDKDVRDLVREVLERSDELVKRVEEEVKRLLERNKKLLDDVTEAAARLLKRNKEVVEELDK

SEQ ID NO: 19458 - protein, 178 aa, Artificial Sequence; identical to SEQ ID NO: 19457
  Synthetic sequence.

SEQ ID NO: 19459 - protein, 178 aa, Artificial Sequence
  Synthetic sequence.
SEVDRVVEENDRVVRKVEEVVREAVERNETVAERVKDTVDRMVRENEKIVDKVRKDVKDKDKVDTVKKHVEKLVREVKELVERIVETSRDLSRKIKDLVDKVKERSKRLSEEIRRVGDEKDVEKLVRDVLRESEKLVDDVRRAVKKLLEDSEELVREVKEAAEESLRRNKKIVEDLTR

SEQ ID NO: 19460 - protein, 178 aa, Artificial Sequence; identical to SEQ ID NO: 19459
  Synthetic sequence.

SEQ ID NO: 19461 - protein, 170 aa, Artificial Sequence
  Synthetic sequence.
DELETVLREVERVVTEVKKLNERTVRDDKEVVERVLREIDKLLKEIREKVKEVKKKLRTEEVAERVVKEIKDRVDDIERRVDEALKESKRTVDESEREVKEMVERIEEMARRVKGEDVERTVRKLLEEIKDSVRKSKEDVRRSVEEIERLVRKVKEDVKRLLRDIRERAK

SEQ ID NO: 19462 - protein, 170 aa, Artificial Sequence; identical to SEQ ID NO: 19461
  Synthetic sequence.

SEQ ID NO: 19463 - protein, 185 aa, Artificial Sequence
  Synthetic sequence.
SKVEKALKKIEDVLEDIKRLVEEVVERDERLLERLEEENKRADEKSKELVKRLTDLVRENKGKEETVKRVVDRVTEEVKRVVDKTREVLKKIEDSSRRVLEEVERLLREVEKEVTDILDEIRKDNLREALERIREILEEVRKAVEDLLRKIKETLKRIRERVKRLIENLEKSLEDARKEVDRLRK

SEQ ID NO: 19464 - protein, 185 aa, Artificial Sequence; identical to SEQ ID NO: 19463
  Synthetic sequence.

SEQ ID NO: 19465 - protein, 177 aa, Artificial Sequence
  Synthetic sequence.
DVDERIEELLRRIERLVEESERDVRRLKREIDDLVTKSLKTVEESLKRIKELVDRVSEEAKDEDKVRTVKTKVDEALKRSKRTAEESKRLVDEARKEIEDVVKKSREIVKRVIDEIKKIRNKDDVERVVRRVLKEIDDSTKEIRRIVKRVLEEIERTTRDDKRVIDEVRELIKETSR

SEQ ID NO: 19466 - protein, 177 aa, Artificial Sequence; identical to SEQ ID NO: 19465
  Synthetic sequence.

SEQ ID NO: 19467 - protein, 178 aa, Artificial Sequence
  Synthetic sequence.
DADELVTEVRKRVRETLEEIRTILDEVRKRVKKTVEDIRTEAERVKREVDKLVKEVRDNNLPEEMVEKIRRMVDTVAREVEEAVKRSEDTLDRIRKLVEKVLDDSRKTLEEIEKLVKENKGKDREIEKLLDDNRRLIEEVLRRIDELVREDEELVKRVLDRIRTVLDRIREEVDEVRR

SEQ ID NO: 19468 - protein, 178 aa, Artificial Sequence; identical to SEQ ID NO: 19467
  Synthetic sequence.

SEQ ID NO: 19469 - protein, 178 aa, Artificial Sequence
  Synthetic sequence.
DVRELLKKVEDEVRRTLKEIERILKEVKTESDKTLKEVAELLERLDRDVKRLVKEVRDNNVPEEVVRRIEKVARDVKEEVKRLLKELERSVEELARRVKDALRKSARTLEEIRRLVEENQGKKEEIRKLVERNKELVRDVLRRIKELLKRDKEMLEEIRERIKEIEKRLKELLERAKR

SEQ ID NO: 19470 - protein, 178 aa, Artificial Sequence; identical to SEQ ID NO: 19469
  Synthetic sequence.

SEQ ID NO: 19471 - protein, 185 aa, Artificial Sequence
  Synthetic sequence.
SEIEEVLKRVEEMIRRSKKLTDKVLREVEKMIRELDKKTDEVLERSERLARELKELVRRDVPDSEKVERIREKIDRLVKESRDSVKKNKDENREIVRRVRDLVRENKERLDKVLEDVDREVKRVRRRERIEEILRRVTEAIKRSKEDSERIRETVTRLIRESEENSKRNLERVKKVIDELREEIR

SEQ ID NO: 19472 - protein, 185 aa, Artificial Sequence; identical to SEQ ID NO: 19471
  Synthetic sequence.

SEQ ID NO: 19473 - protein, 185 aa, Artificial Sequence
  Synthetic sequence.
DKLEEVLKRVEEMLRELDKETDDVLKTVEDLLRRLDELTDEVLKESRRAAEELKRKVDRDIDRSERAERIKRKIEELVKESERSVEENKRRNREVLDRVTKLAKRNKERNREVLKRIAEDVKDIRREEKIREIEKKARKLIKDSRKNIRDILETVKRLIEESDKNIKENEKRVRKVIDELDKEIK

SEQ ID NO: 19474 - protein, 185 aa, Artificial Sequence; identical to SEQ ID NO: 19473
  Synthetic sequence.

SEQ ID NO: 19475 - protein, 182 aa, Artificial Sequence
  Synthetic sequence.
REKEEIIKKVKDVVKRVKEELKKIVEESERLVREVEEELKRSNEKSRDLVRRAEEELEKKSTDKDVRERVKEIVKDLRRLLREDKRLVEEILKRLRELLERDRRTIEEILKELEDLLRRIEESDRREEELDRLIKRVEDRARKVLEDSKRTIEEIEKVARDVLRRSEETVKEVEEKARRALK

SEQ ID NO: 19476 - protein, 182 aa, Artificial Sequence; identical to SEQ ID NO: 19475
  Synthetic sequence.

SEQ ID NO: 19477 - protein, 189 aa, Artificial Sequence
  Synthetic sequence.
SAVEEIVKEVERIVREAEKALKKSVDDNRRIVEDAVRTLKRLVEEAARLVDEARKELTKKSTTEDVERRVREIVRDLERLLEEVEKRVEDIIEELKKSLEESERHTREVVKKLRELLEEIKRVVTEKGTDEDVLRELKRLLKELERVVEEVLRRDRKWLEDTRREVKRVVEELKRLLDELREVVERARR

SEQ ID NO: 19478 - protein, 189 aa, Artificial Sequence; identical to SEQ ID NO: 19477
  Synthetic sequence.

SEQ ID NO: 19479 - protein, 185 aa, Artificial Sequence
  Synthetic sequence.
KELEDLVREIEDTVDRIEREIRKLVEDDHRSVRKAEEDNRRLVKESEDLVRRIEEEIRKKETTEEVKERAERVIRELRELLKRNREIVERSIRKLEDINRRSKEIADRVIEELRRLLKEVRKVVKDGVDEEVMRRLKEDIERLMEEIRREVEKLNETTKEVVKESLETHKRIIERIREVAEETRR

SEQ ID NO: 19480 - protein, 185 aa, Artificial Sequence; identical to SEQ ID NO: 19479
  Synthetic sequence.

SEQ ID NO: 19481 - protein, 175 aa, Artificial Sequence
  Synthetic sequence.
SSLEELLKEIRKRVERIKEELDRALKEDHDIVRKALRELDEMLKKNEETVRRAMERIKDKREVIKELEDSLRKSEEIVRRLKETLKRSNEDSERLVREIKKKLEELARTIEDLVRRGVPEDVVRKVLEELEEEARRVLRELRESLKRTEELVRRALETLKRSDEETKKLVEDIER

SEQ ID NO: 19482 - protein, 175 aa, Artificial Sequence; identical to SEQ ID NO: 19481
  Synthetic sequence.

SEQ ID NO: 19483 - protein, 175 aa, Artificial Sequence
  Synthetic sequence.
SSLEELIKEDHRVVREAEKRLEELLKEDHDRLREAKEELERVLKRDHETLKEVVERIREKREVIEELKRSNEESRRLVEDAKRRLDESNERSEEIVRRLKEELKRSNDDSRRVVEEGVPEEVLKKIIERTRDLVRRALRTMEESIKRTEELVKKLLDELEASIRKTEEDADRIRK

SEQ ID NO: 19484 - protein, 175 aa, Artificial Sequence; identical to SEQ ID NO: 19483
  Synthetic sequence.

SEQ ID NO: 19485 - protein, 175 aa, Artificial Sequence
  Synthetic sequence.
SSLERLIEEDHETVRRVKKTLDDMLKRDHEVVDEARRRLDELLKRDTDIVRDAVKRIRDKREVIERLRESNDDSRRIVEEIKKTLKRSNEKSKRIVEELKRRLEESNERSRDVVRKGVPEEVLKKIIKETKELAKEAVERLEESIKETEDLVRRVLKEMEESLRRTEELVREIER

SEQ ID NO: 19486 - protein, 175 aa, Artificial Sequence; identical to SEQ ID NO: 19485
  Synthetic sequence.

SEQ ID NO: 19487 - protein, 180 aa, Artificial Sequence
  Synthetic sequence.
SIEEVIERIREEAERLLKELEEVNRESTRLAEDLREELRRVLENSRALVKELKERIRKESLLKEVDELAKRLTEEHERLLREVEDIMRKVNKHDTELLRTVEELMKEVKRRLEELRRRNVDDKSLKELLRDVERKIREVRKRLKESLERVEREIRRVREEIKRLNDESRERIERVKRRVD

SEQ ID NO: 19488 - protein, 180 aa, Artificial Sequence; identical to SEQ ID NO: 19487
  Synthetic sequence.

SEQ ID NO: 19489 - protein, 176 aa, Artificial Sequence
  Synthetic sequence.
DAEELLRRLDKSSKETLKRNEESLRRSEETSKRSLDTNRRSLEKIEKIATDLRRKLSERKIRELLKRIEEILRKVAEDVRRNSEHNKRLLDRSRENVRRISEHNRKLLEELAELAKRGDVDERVVREAEKLDEDNTRHSRRNLEESKRLDEENIKRSEDLLRDVRRLIEEVLEEAR

SEQ ID NO: 19490 - protein, 176 aa, Artificial Sequence; identical to SEQ ID NO: 19489
  Synthetic sequence.

SEQ ID NO: 19491 - protein, 188 aa, Artificial Sequence
  Synthetic sequence.
SKLDEILERAKKLIDDLRKESDDVLRRDRELIERIRRKSEEVLERVKRLIEELEDRVRKVRDEDLKRKLEEEVKKILEDVDDVIRRITEEIRRTARESEKVIEDISRKIDEVLDRLRKLIEELRKESDEDEVRRVLRELERLVKELKDKNKESLDELKKTNDRLEEENRESLRRAREEARRILEEIRR

SEQ ID NO: 19492 - protein, 188 aa, Artificial Sequence; identical to SEQ ID NO: 19491
  Synthetic sequence.

SEQ ID NO: 19493 - protein, 188 aa, Artificial Sequence
  Synthetic sequence.
DELEEILKRVEKLIRDSIEKIRRILEEDRELIKELIKESREVLERVRELIKTLEKKVKDVDKEELKKRLEDEVRKVEEDVRRLIEEITRKIEKTLRESKKKADEDKEENKKILDEVRELIRDLREKTDRRTVEEVLKRIEELVKRSLEESDRVAKEVRKTNEEVKKTNEDSLRKIKELVKRILEKIRK

SEQ ID NO: 19494 - protein, 188 aa, Artificial Sequence; identical to SEQ ID NO: 19493
  Synthetic sequence.

SEQ ID NO: 19495 - protein, 188 aa, Artificial Sequence
  Synthetic sequence.
DELEDVLREVRKLIKELEKKSREVLKRDKELIDRIRKESEEVLKRVEDVLRKLEDEVRKVREERLKEELKKKVERVLREVERLIKEISDKIRKTLKESRDVIREISEEIKDILRRAREKARDLADKSDKRRVDEVLEEIERRVTELNKKNEESLRRAEKTNKELDEENKESLERIRKLIEDILRKIEK

SEQ ID NO: 19496 - protein, 188 aa, Artificial Sequence; identical to SEQ ID NO: 19495
  Synthetic sequence.

SEQ ID NO: 19497 - protein, 188 aa, Artificial Sequence
  Synthetic sequence.
DELERILEEVKRRIERLIERLREVLERDKKLIEDIRRESEDVLRRVEEVIKKIREELERIRDRRLREELMKKIEKLLREVDKVIKDISEKIRRTLERSREVIERLKEEVEKVLREVEDMIRKLAERSDRETVKDVLRKLRKIADEVRRDIERVLDEARKTNKRLDEENKDSLKKLRDRAKELLDEVRR

SEQ ID NO: 19498 - protein, 188 aa, Artificial Sequence; identical to SEQ ID NO: 19497
  Synthetic sequence.

SEQ ID NO: 19499 - protein, 174 aa, Artificial Sequence
  Synthetic sequence.
RELEEVLKEAEKLIREITEEVKEALRRDEKTVRDNIRDLRRVLEEVRKLIEEILDRVRRRGPRDELERDVERIADKVRRAITRSRKHVEDSVRTTKEMIDRLRRKVEKILTEVRKKIDSKFLERLEELITRLKERIDKALRDLEKTNDELRKRSEEVLRRLERLLERLREEIRR

SEQ ID NO: 19500 - protein, 174 aa, Artificial Sequence; identical to SEQ ID NO: 19499
  Synthetic sequence.

SEQ ID NO: 19501 - protein, 172 aa, Artificial Sequence
  Synthetic sequence.
SEVERVLEDSRRTNEEIIKRLRDALRESEKTNRDIEKRLREMLKKSKETNERIKRSDRDKDELKKLVEKDKKEVEDALKDLEDLVREDKERVDEALERMRKLVEDDKEALERRIKDKKVLDKARELVRRTEEIVKDVIRKSRELVKESKERVDRVITESRRVVKKTLDDIRK

SEQ ID NO: 19502 - protein, 172 aa, Artificial Sequence; identical to SEQ ID NO: 19501
  Synthetic sequence.

SEQ ID NO: 19503 - protein, 172 aa, Artificial Sequence
  Synthetic sequence.
SEIEEALKRSKETNERIIRKLEEVLRRSRKTNEEIIRRVERVLEDSERTNREIEKSDRRKEEVAKLVDDDRRKVEKALEEARRLVEEDKERVEKALRDMRELVKEDKERLDRTIKGEEFLRTVKKLVDDTRKAVEEVITRSRRLVEESERRVREVIDRMRKLVEETKRKLDK

SEQ ID NO: 19504 - protein, 172 aa, Artificial Sequence; identical to SEQ ID NO: 19503
  Synthetic sequence.

SEQ ID NO: 19505 - protein, 172 aa, Artificial Sequence
  Synthetic sequence.
SEIEKALKESEDTNRKIKDDLRKVAERVRKLIEDVIRTLERVLRDSERTNREITRSDRDKDELRKLVERDRERVEKVLRDAKRLVRTIKEDIRRALEEMKKLVEEDEEKVKKKIKDEDVLRKAKRLVDETLKEVERVIRELEKLVEDLEETVKEVIKRSRELVDETEKRIRD

SEQ ID NO: 19506 - protein, 172 aa, Artificial Sequence; identical to SEQ ID NO: 19505
  Synthetic sequence.

SEQ ID NO: 19507 - protein, 172 aa, Artificial Sequence
  Synthetic sequence.
EEIERALKKSEETNRDIIRKLREVNERDKRAVERDEEELKKALDESRKTNEDIRKSDREKEELRKLVEEDRKRVEKVLTDSKRTNEELLRHSEDVLRKLRKLVKEDEKRLKDEIKDKDVLETVRKLVEDTLREVERVITHSLKRVEDTLRKAKEIADRMRTLVRKTLEDIER

SEQ ID NO: 19508 - protein, 172 aa, Artificial Sequence; identical to SEQ ID NO: 19507
  Synthetic sequence.

SEQ ID NO: 19509 - protein, 172 aa, Artificial Sequence
  Synthetic sequence.
DEVERVLEKSKRTNEDIIRRLEEVNKTDRKLVEDDIRRLEKALRDARKTNEEIRTSDRDKDLLRKLVEDDKKRVKDVLRESRKTNDDLRRHSEKALEEARRLVDEDRERLEREIKDEDVLRKVRELVERTKERVERVIDHSRKVVETTLREVERVIREIEELSKDSERKIRK

SEQ ID NO: 19510 - protein, 172 aa, Artificial Sequence; identical to SEQ ID NO: 19509
  Synthetic sequence.

SEQ ID NO: 19511 - protein, 172 aa, Artificial Sequence
  Synthetic sequence.
SDAERALKESEDTNREIIEKLERVNKRDKDIVDKIREDLKRVLERVRDTNRRIRESDRRKEELKELVERDKERIEDALRRLEELVKRLEDHSRELLKDAERLVRTDDELVKRRIKDERVLREVKRLIDETKRIVDEVIKHSKEEIDKLREEVERVIKELRELSDKSLDDIRK

SEQ ID NO: 19512 - protein, 172 aa, Artificial Sequence; identical to SEQ ID NO: 19511
  Synthetic sequence.

SEQ ID NO: 19513 - protein, 172 aa, Artificial Sequence
  Synthetic sequence.
KEIEDVLKKSEDTNRRIIERLRKANDTDRRLIEDTIRKLREVLKEAEKTNKDIKDSDRDTSVLRELVRRDERRVEEVAREMHKLNEDIREHSERVLRELRRLVEEDRDRVRREIKDEDVLRTVEELIERTEREVERVIAHSEDLIRRSNEDVKRVIKTIRELSEDSKRAADK

SEQ ID NO: 19514 - protein, 172 aa, Artificial Sequence; identical to SEQ ID NO: 19513
  Synthetic sequence.

SEQ ID NO: 19515 - protein, 174 aa, Artificial Sequence
  Synthetic sequence.
DEERVLKELEDLLREILKDIERTVRESRKLVKTILDEIEEVARHNRKLIEEIRREVKKKEVLDEVEEALRRSVKNLEDILREVERLVREDEEKNRKLVEDITRIADTLVKVLEAGTRDLKELLETVRRVIEEVKKVLKRSLEESKKVIDDVRRHLEKNNRDIKTVIDRVREKAK

SEQ ID NO: 19516 - protein, 174 aa, Artificial Sequence; identical to SEQ ID NO: 19515
  Synthetic sequence.

SEQ ID NO: 19517 - protein, 174 aa, Artificial Sequence
  Synthetic sequence.
SVEEVVEEVKRLIEEVEKTNKKTVEDSKRLIDDIRRRIEEVMRHNRELIKKIEREVTKEEVVRKIRDVLRKSEENLKELLREITERVKKDEKDNEENLRRTRELLEEMERLARAGTIDLRELLERVRRLVEESKRNAEESLRRSEKVIKEATDHLRRNNETIKRVIDRVREEAK

SEQ ID NO: 19518 - protein, 174 aa, Artificial Sequence; identical to SEQ ID NO: 19517
  Synthetic sequence.

SEQ ID NO: 19519 - protein, 174 aa, Artificial Sequence
  Synthetic sequence.
DTERVLKTLRDLIDTILKRNEEILRHNEKLSRDSKRRIEEVARHNRDLARRVEEEVTKEEVVRKAREMMKRSLRNLEELLKEDDKVLRDSLRHVEENLRRTEKLLRELEELLEAGKRDLRKLLEDVKEIIKTSKENVDRNNDRIRRVVERSEKHLEDNNRDVKRVVDEVREEAR

SEQ ID NO: 19520 - protein, 174 aa, Artificial Sequence; identical to SEQ ID NO: 19519
  Synthetic sequence.

SEQ ID NO: 19521 - protein, 174 aa, Artificial Sequence
  Synthetic sequence.
KEEEDIKREIEKRITEIKKKNEEVLRRVEELIKRIHELNKRIEDTIDEEIRRIEDLVRRGTDKEDLKRRVKEIEDRVRRLIEDSRKKIKDIEEEVKDLARRSRKEIKEIKDEVRKKVDDDVLRKLKRLLDEIIKHSEDVLRKIKELLDEIKRDSDRVFKKLKELLDRIAREIEK

SEQ ID NO: 19522 - protein, 174 aa, Artificial Sequence; identical to SEQ ID NO: 19521
  Synthetic sequence.

SEQ ID NO: 19523 - protein, 174 aa, Artificial Sequence
  Synthetic sequence.
RELEEIDRKIKKLIEDIHRENRDILRRIRELIERIKKKNEDILREVRKLIKEIEDLVREGAPKEELKKRIEDIMRRVEKLAKESRDEIDRILEEVERLAERSRRKIDKIMEDVKREVDDKVLKKLEDLLREIKKDSDRVLEEARKLLEEIKRHSDEVLEEIKKLLDDIKKRVET

SEQ ID NO: 19524 - protein, 174 aa, Artificial Sequence; identical to SEQ ID NO: 19523
  Synthetic sequence.

SEQ ID NO: 19525 - protein, 174 aa, Artificial Sequence
  Synthetic sequence.
SELEKIDDEIRKLIEDIHRLNREIARRNEKTIREIRKKNEDVLRRNKRSADEIDRLVKEGVDKRELRKEIKKSNDESRELIDRSRKEIKKSNDETRRLAEESRKLIEDIRREVERRIDSEALRKLKRLLEEIERDSRRVLDELHKTDEDIERHSREVEDRAHKTDKTIKDRVET

SEQ ID NO: 19526 - protein, 174 aa, Artificial Sequence; identical to SEQ ID NO: 19525
  Synthetic sequence.

SEQ ID NO: 19527 - protein, 174 aa, Artificial Sequence
  Synthetic sequence.
SEDEKILEEVRREIERIHEENRKVRERIERLIREIHKLNREVLERNKESIEEIRRLVEEGAPKEELRKTVRKSNEDSKRLAKESKDRIDEIEREVEKLIRDSEREIERIEEEVRRKIDSKFLEDIERLLREIDKDSKRVLEELKRLLDEIRKDSDRVLKTAHDTDDKILKDIDK

SEQ ID NO: 19528 - protein, 174 aa, Artificial Sequence; identical to SEQ ID NO: 19527
  Synthetic sequence.

SEQ ID NO: 19529 - protein, 174 aa, Artificial Sequence
  Synthetic sequence.
KEEDEVREEIKRRIEEIARLNKEIEDEIRELIKRIHELNREILKKVRKLIEEIEDLVRKGVPKEELRKRIEDIRRDVERLLRESEDRIRRIEERVDRLLKDSRDKIDRIKEEVKKKVDSEVLRELDELLRRIKKNSEDVARKLKDLLRRIREDSERVAKEIRRLVEEIKKKVDK

SEQ ID NO: 19530 - protein, 174 aa, Artificial Sequence; identical to SEQ ID NO: 19529
  Synthetic sequence.

SEQ ID NO: 19531 - protein, 182 aa, Artificial Sequence
  Synthetic sequence.
DEVKRIVDEVRRLVEKVHRVNEEVVKESEDLVREVHRKNKRVLDESERLVEEVERVLKRDVSDRRKVEELVEELRRLNEETRRAVKRSSEELKRINDETRRELEDNSRKLKEVLDRVEKELRKGNGDERVLRTAEEVIRRLEKHSKDLLDTSRRLAEEILRKSDDLLRRSKEKIDDLKRKIK

SEQ ID NO: 19532 - protein, 182 aa, Artificial Sequence; identical to SEQ ID NO: 19531
  Synthetic sequence.

SEQ ID NO: 19533 - protein, 182 aa, Artificial Sequence
  Synthetic sequence.
SEVDRIKEEVRKLLEEHHKRNEDIVREVTRLLEEHHKKNEEVVRESEKLVKKIREILRDRVRDEDKVRDLERRVERLNRETRRELTESSEEARELVKRVTDELRKSSKELTDVVRDVERLLDEGRGDERVLEEARKVVRELNRRSEELLKRARELVERLDRKSEELLRKSERIIKKIEEDIR

SEQ ID NO: 19534 - protein, 182 aa, Artificial Sequence; identical to SEQ ID NO: 19533
  Synthetic sequence.

SEQ ID NO: 19535 - protein, 182 aa, Artificial Sequence
  Synthetic sequence.
KEVEEIVRDVRRLVEEHHRENRKIVETVEDLVRKVHRENKRVVEESERLVDELTKILRDTLSDKDRVDDLKKKVDEINEETRRHVERNSREAEKLLRDVEKEVRKSSERLRDLERRVRKLLRDGRGDEEVLKRVREAIRRLNEDSKRLLKEARDVVERIKRNSDKALEESKRKLKEIEERIK

SEQ ID NO: 19536 - protein, 182 aa, Artificial Sequence; identical to SEQ ID NO: 19535
  Synthetic sequence.

SEQ ID NO: 19537 - protein, 178 aa, Artificial Sequence
  Synthetic sequence.
SKMEEVRRRIKEEADRDEEDNRRVLEDIRRLIEENKRRNEEVLKRIEKKARDLLERIKKDGRTEEIERLLRELEREVDEAVKRSEKNNRDSNRKIEELAKRSRERNRTTNEDIKEVLRRGEIKEEIIKEVSTLNEKLKRDTDEILKEVTRLNERLKEETDRILEEVKKLIDKVRKAVE

SEQ ID NO: 19538 - protein, 178 aa, Artificial Sequence; identical to SEQ ID NO: 19537
  Synthetic sequence.

SEQ ID NO: 19539 - protein, 178 aa, Artificial Sequence
  Synthetic sequence.
KEADDVKRRLDDLIRRNEEKIRDVRRRVKELVDRNRKKIKEVLDKVKEIIDRLKDEIDKTGRDEKIEKKLEDVRREVTEAVKRSREDNRRSNEEVRRLVEDSRRNNKKSNDEVREVLRRGEIEERIIEEVTRENDRLRKESDRVLDEVSKLNDEARKETDDVLKTVDELVREVAEKAK

SEQ ID NO: 19540 - protein, 178 aa, Artificial Sequence; identical to SEQ ID NO: 19539
  Synthetic sequence.

SEQ ID NO: 19541 - protein, 185 aa, Artificial Sequence
  Synthetic sequence.
SDAERLLETVRRIAKRLKELNEEVLREAKRIIDRVREENERSRETIREIMKKLKEDIDRIGGRDEEDLRKLLEDAKRIIEEILRRNEELLKEIEKEVDTVLKKNERLLERAEEEVRRMIEEIRTRDGPGVDEILRDVERLLEEVRRSVKESTRRIKRLLDEVRKSVKESTKEIKKLLKDVEDAAR

SEQ ID NO: 19542 - protein, 185 aa, Artificial Sequence; identical to SEQ ID NO: 19541
  Synthetic sequence.

SEQ ID NO: 19543 - protein, 185 aa, Artificial Sequence
  Synthetic sequence.
KDIEDLRRRIEEIIEEAKRLDKTSLELIRRIIKRIKDENKKMLDEAEKIIRDALKTIDDVGGRDEEELRRLLRKAEEDVRDVDRRNEKLMRDVDKEVAEVLERNKRLLDEIRKRVERVIEDIERRRGPGVEDVTRRIEELLEEVRKSSEDSIRDIRRLLKEVRDSFKRSSDELKRLLDEVRKRAE

SEQ ID NO: 19544 - protein, 185 aa, Artificial Sequence; identical to SEQ ID NO: 19543
  Synthetic sequence.

SEQ ID NO: 19545 - protein, 185 aa, Artificial Sequence
  Synthetic sequence.
RELEEVVKELRRLLEEVRKRVEDSIKRLDELLDEVRRSNKKSSEDTRKLLKELEDEARKVMERVPDERVRRVLDELRKLVDDNHRENEEISRRMKELVDRSRKHVEEVLRRLEELVKRIEDELRKGERDVREVREEIERIVTKARKVVKEDDDLVKRIVAEARRLSKESEEKVREIVKRAEEKVR

SEQ ID NO: 19546 - protein, 185 aa, Artificial Sequence; identical to SEQ ID NO: 19545
  Synthetic sequence.

SEQ ID NO: 19547 - protein, 174 aa, Artificial Sequence
  Synthetic sequence.
DEVEELREELERLLKESEDRLREVKKRSDDSLKESRELIKKVRDTLERLLREVEDKVEDERIVEKVRKAVEEVERHLRENEKTIARVVEETRRLLKRNLDEARRVVEEVRELLKRNKDVETVAREVRERVERSKRHIEKVLKEDEEMVRESKKNIEDLLRRVKEDIDRLKEEVD

SEQ ID NO: 19548 - protein, 174 aa, Artificial Sequence; identical to SEQ ID NO: 19547
  Synthetic sequence.

SEQ ID NO: 19549 - protein, 174 aa, Artificial Sequence
  Synthetic sequence.
SKADRLREELDRLLKEVKELNERSKRESDRSLEEIKRLIEKVERESEKTLREVRAKVDDERIVREAEKIVRETKEELKRLEKRVEEVVRRTKKANDDNLKAVTDMVRRVRDLLARNVDIDTVVEEVKKLIKEILDHIRELVEDDKRKIKEILEEIKKLAEDDRRKVEEVKRKVD

SEQ ID NO: 19550 - protein, 174 aa, Artificial Sequence; identical to SEQ ID NO: 19549
  Synthetic sequence.

SEQ ID NO: 19551 - protein, 174 aa, Artificial Sequence
  Synthetic sequence.
SDVEDLKKKLDELLEEVERTSREVRKTSERSLEEVEKLLRRVKEESKRLLEEVERDIKDESIIDEVRRLVERSEENLREILRRITKVVEDTERRLKESLDEAREVVERVRDLLERNVDVKKVLDDVKKLVDDVKRKDKKLLDDDRRRVEEALEHIKRNLDRSRDLIRRIKEKAK

SEQ ID NO: 19552 - protein, 174 aa, Artificial Sequence; identical to SEQ ID NO: 19551
  Synthetic sequence.

SEQ ID NO: 19553 - protein, 174 aa, Artificial Sequence
  Synthetic sequence.
DEVKKLKDDLDRLLDEIRRKIEKVRKDSEDSLKRVEELIRRVEEESRRLLEDVKREISDEEIIREAKKAVEESKKNLDDIRREVKRIVEETERLLKKLDDDLKRVVERVKELLDRNKDIKKVLDDVRREIRRIDEEIKRVEEEDRRMVTELLKHIERNLERSKRLADEVKEKAR

SEQ ID NO: 19554 - protein, 174 aa, Artificial Sequence; identical to SEQ ID NO: 19553
  Synthetic sequence.

SEQ ID NO: 19555 - protein, 174 aa, Artificial Sequence
  Synthetic sequence.
KEVDELRKALKELLDEVRETSKRVLDETRRLLEEVRRELERVKRESDETLKRIKDRVKDKRLIEEVKRVVEKTRRDLRKIEDEVRRAVEESKKNLDESIKTVEKVVREVKELLDRDRDVDTVLEDVKRKIDELKEHDKRNLDESRRLITELLERIKKLAEDDRRVIEEIERRIQ

SEQ ID NO: 19556 - protein, 174 aa, Artificial Sequence; identical to SEQ ID NO: 19555
  Synthetic sequence.

SEQ ID NO: 19557 - protein, 184 aa, Artificial Sequence
  Synthetic sequence.
KTMDEIKKEVTDLVRRIRELNERVERTVEDLVRKSRRLNERVLREVERLVKEVRDALRDKDEKDAKRIKDKLDEILRRVKKVLDDNSRHTDKVLEEVRKLLEDDTRELDRILEEVDDVIKKVGKDDETLEKVVDDVRKRIKRSKEHSDEVLEDAKKKIDENLEHSRRVLEEAKKLIDDLKDEIR

SEQ ID NO: 19558 - protein, 184 aa, Artificial Sequence; identical to SEQ ID NO: 19557
  Synthetic sequence.

SEQ ID NO: 19559 - protein, 184 aa, Artificial Sequence
  Synthetic sequence.
EKAERIIEEVTDLVRRVRETTKTVKEEVRKLVERSKRRNEEIRREVKELVDEVEKKLREKDEKDARRIRKELKEVLDRVDKLLTDDSRKVEEIRREVEERLDESRKRIEKILKDVEDLLRKIGTDKDALEKVRRDVERLIRELEKTDRDVLEEVKKLIEESERNSDRILEEVRRIIEELKKKIK

SEQ ID NO: 19560 - protein, 184 aa, Artificial Sequence; identical to SEQ ID NO: 19559
  Synthetic sequence.

SEQ ID NO: 19561 - protein, 184 aa, Artificial Sequence
  Synthetic sequence.
SVVDEIRERVERLLREVEKTTEELRDTVRKLVEESEELTKRIEDEVRKLVEKVRRELRRKREDEVTRIRKELEDILKEVKRLLDENRDKVRRVLERAKRLLEDSKRRLDEIVERVRDLLEKIGTDEDKLREVLEEVKERIDRLKELDKKILEDVKRLVKESKEELKDILRRARKLIRDLEEKIK

SEQ ID NO: 19562 - protein, 184 aa, Artificial Sequence; identical to SEQ ID NO: 19561
  Synthetic sequence.

SEQ ID NO: 19563 - protein, 184 aa, Artificial Sequence
  Synthetic sequence.
SEVEKMLKELKELVERALERDKDALRKLRDLVRESLERDKRMVDKLDELVKEIEDRIRKRKESREDVKRLLKRLREELDKIRKENEELVRRLKEELERIKEENKKLLEELKKRLEDAVRKVGKDKREKVDKIRRDVKRLLDESRESLERSEKDVEKLLEDSRDSLRKSKKRVEELVKRVEEALK

SEQ ID NO: 19564 - protein, 184 aa, Artificial Sequence; identical to SEQ ID NO: 19563
  Synthetic sequence.

SEQ ID NO: 19565 - protein, 184 aa, Artificial Sequence
  Synthetic sequence.
REVEEALKESTDTIKKILDDDRKAMDELKKLVDKSLEDDKRAVDRLRELVKEIKKIIKKRKDLEEKVKELLRRLEEELRKIEEENRRLVEELKRKLEEIKKKNEKLVRDNEERLKEVVERMGKDKKEDVDRIEEESRRLNEESRDSLRKSEDTVRKLLEESKESLDRSRREVEKLLKEVEDALR

SEQ ID NO: 19566 - protein, 184 aa, Artificial Sequence; identical to SEQ ID NO: 19565
  Synthetic sequence.

SEQ ID NO: 19567 - protein, 185 aa, Artificial Sequence
  Synthetic sequence.
SELEELDREVEELVERSKRTNERVVEESKRLVDESRRDIDRLLEEVRKLVKDILERIKEEGGESEKAEKEVRDLIRRIKELLDEIRKRVERSNEENEKLLRENKKLDEKSVRDLEDVARKIAKRVRSEDVRRLLEKIERLIEESNRSLERSREESERLSKESEDRLRELEKTVKELLKRVEEALR

SEQ ID NO: 19568 - protein, 185 aa, Artificial Sequence; identical to SEQ ID NO: 19567
  Synthetic sequence.

SEQ ID NO: 19569 - protein, 185 aa, Artificial Sequence
  Synthetic sequence.
DEIRELLKKAEELVERSLRDNEKVVDELKKLVDESLRRIREMLKRAEDEVRKILEDIERKGGESDDAKRRVEKAIREIEDLLDKVRREVEKSNEELKRVLDENRRRDRESVERLRKELEDVERRIRSDEVDTLRRTVDKLVKDSNRSLEESKRTLEDLIRRSKEELDKLEKDVRRLLDEVRKALK

SEQ ID NO: 19570 - protein, 185 aa, Artificial Sequence; identical to SEQ ID NO: 19569
  Synthetic sequence.

SEQ ID NO: 19571 - protein, 174 aa, Artificial Sequence
  Synthetic sequence.
DELEDAMRRVEEMAERSERNIRRSIRKVEELVTRSKKNIEDSLREVEKVAREAEELLRRNVDTDEVVKRVEEVVERIKRHNDENNKTSDRLVKEIEKENRENNKRTEEVVRDVARRVTGEEVKRRLDELLKRVTDLDRDSEKKLRELLEEVTKLDKESKDRLDELLEKVRRDRE

SEQ ID NO: 19572 - protein, 174 aa, Artificial Sequence; identical to SEQ ID NO: 19571
  Synthetic sequence.

SEQ ID NO: 19573 - protein, 178 aa, Artificial Sequence
  Synthetic sequence.
SEVDKLLDRLTKLAKRSIDEARRLVERDREVLEKSIRDAEKLVERDEKVLEDIKRLIEREGPSEELLKRVEDVVRRSREDLEELLKRSKEVVKRSDEALRRLLERSKDVVREVEDELRKKNLDETVRRLVTELNKASKKVVDDVRRESEKSNRDSEDVVRKVKKASDKSLEDVERDIR

SEQ ID NO: 19574 - protein, 178 aa, Artificial Sequence; identical to SEQ ID NO: 19573
  Synthetic sequence.

SEQ ID NO: 19575 - protein, 181 aa, Artificial Sequence
  Synthetic sequence.
EEVERIVERLKRLAEEDSREIKEVMDRNRESVRRILKRIKDIVEELRRLVEEIKKKIEKDGPTEEVEKRVKELEERVDEEVKKLKELVKRNHDEVRRVLERSRDTVRRIREDVERVAREISDKEKVERLEKDIRRLEKESEDALRRLEDTSKRTDDEIERAIEELERTITDLVREIRERVR

SEQ ID NO: 19576 - protein, 181 aa, Artificial Sequence; identical to SEQ ID NO: 19575
  Synthetic sequence.

SEQ ID NO: 19577 - protein, 182 aa, Artificial Sequence
  Synthetic sequence.
REVDEIRKELDDRVREIKKRIEEAVEDSRRTVEEIKRRVEEVDKTDRKLVEDIKREIDRRKDAREKVERLLEELKTHSDDSERRIRELIREDEETVRRVLEEIRKLIRDLEEKVKRVEKDISDRKKAEELRDRVRKLVEEIERLLEELRRTLEKTRREIERVVEENRRSVEELIREIKERVD

SEQ ID NO: 19578 - protein, 182 aa, Artificial Sequence; identical to SEQ ID NO: 19577
  Synthetic sequence.

SEQ ID NO: 19579 - protein, 174 aa, Artificial Sequence
  Synthetic sequence.
DDERRVKEEIKRILTEAKKVIDENKRRSEEVLDRVRKLVKENKDENDEVLKTVDELVRRGSPKEEVLRRVEELLERSKRKIKEVLDRVTKLNEESKRHSDEVLEKVERDLRRLAEEARIEEVRKELKRVLDEVRRLVKETEETDRTSNRTVAELAKDLEKKTDDIEREVRKKVT

SEQ ID NO: 19580 - protein, 174 aa, Artificial Sequence; identical to SEQ ID NO: 19579
  Synthetic sequence.

SEQ ID NO: 19581 - protein, 186 aa, Artificial Sequence
  Synthetic sequence.
DRVERILKKIEDALRKVEELIRRNKKKIDDVLDEVRRLVEESKKRIDEILDEVRDRITKLKDDEKVVREIEKEVRRLIEEARKDDERTNRKVKKEVEESERDNERSNREVDKVIRDIKREIERDIGGKKEAKRLKDLLDTVRETVKRLNDELRKRSEEVLRRVDKLNKESKKRLDEVLRTVREELR

SEQ ID NO: 19582 - protein, 186 aa, Artificial Sequence; identical to SEQ ID NO: 19581
  Synthetic sequence.

SEQ ID NO: 19583 - protein, 182 aa, Artificial Sequence
  Synthetic sequence.
REIEEVKKENDKSLKEIEKIIREVKEENKRSLDKIKRIIERALEEIKRMLEKAKKLADEGVDRSVVEKAIKDIERLLEEIRKEVERVLEENEELLRRIERRVKEVIKKDKKLMEDVARKLKELDKFLTEVKRSFEKSVEDIKRLLKEVSESVKRSTDEIRRLLDEVRRAVEEVLRRIRELLR

SEQ ID NO: 19584 - protein, 182 aa, Artificial Sequence; identical to SEQ ID NO: 19583
  Synthetic sequence.

SEQ ID NO: 19585 - protein, 179 aa, Artificial Sequence
  Synthetic sequence.
SLVEELRRVVEEVRKTLEELVKRLEDSVRRSAEEIRKLIEDAERSVRESERAVKETGDGKILEEAKELVERSERKVRKLLRDLERLVEESEREVRRIADEVRRVLDDLRRKIEDLERKRVTKEIKELLEEIKEMLRRLKKKAEDIDRTNRELEKEVRELVERLLRDNRRLLKEVVERAK

SEQ ID NO: 19586 - protein, 179 aa, Artificial Sequence; identical to SEQ ID NO: 19585
  Synthetic sequence.

SEQ ID NO: 19587 - protein, 179 aa, Artificial Sequence
  Synthetic sequence.
DKIEEAKKNVDESKRRVEELIRELRESVERSKRDVERLVRELEESVERSLETVKRDGDSRILREAERLVEESEKKIRELLRRAEKLVEDSARKIEELLREAEELVKESEDLIRDLERKNVTKEVKELLKRNSDLLRRVEELVKKLDKENRDLLRKVREDAKKLLKENEDLLEKVKRDAR

SEQ ID NO: 19588 - protein, 179 aa, Artificial Sequence; identical to SEQ ID NO: 19587
  Synthetic sequence.

SEQ ID NO: 19589 - protein, 179 aa, Artificial Sequence
  Synthetic sequence.
DEIEKAEKNVRDSRREVERVVKKLKESVDKSREEVERLVRELERSVEESRRLVEERGDSKILKEAKDLVDESRKEIEELLRRAEELVRRSEEEIRRLLKRARELVKESRDRIEELAKRGVTKEVDRLLERNSRLLEEVEERAKELDERNKKLLEEVRRRAEEVDKRNKDLLRTVDRRAR

SEQ ID NO: 19590 - protein, 179 aa, Artificial Sequence; identical to SEQ ID NO: 19589
  Synthetic sequence.

SEQ ID NO: 19591 - protein, 179 aa, Artificial Sequence
  Synthetic sequence.
SLIEEARENVKDSKKKVKELVDRLRKSVEESRERVREVVRRLRESVDTSADAVRKAGDSRILEEAKRLVDTSRKKIDDLLREAEELVKRSADKIKRLLEEATKLVEKSRRDIEKLAKDGVTEAVKRLLEENSKLLADVADEARKLNEENERLLREVEKKAKKLDDENRKLLEEVIETVR

SEQ ID NO: 19592 - protein, 179 aa, Artificial Sequence; identical to SEQ ID NO: 19591
  Synthetic sequence.

SEQ ID NO: 19593 - protein, 179 aa, Artificial Sequence
  Synthetic sequence.
DEIEELKKNVEDSRREIDRLIKELKESVEKSRKDVEKVVKELRESVKDSLDKLEKTGDSEILKEVRRLVERSEREIERLLEEARRLVDTSREEIDRLLKKARKLVEESERKIEDLRRKGVTKEIKELLKENSDLLERVREEAETLDRKNKELLERVKRKADRLNEENRRLLKEVIEKAR

SEQ ID NO: 19594 - protein, 179 aa, Artificial Sequence; identical to SEQ ID NO: 19593
  Synthetic sequence.

SEQ ID NO: 19595 - protein, 181 aa, Artificial Sequence
  Synthetic sequence.
SEVEKLLRDLERLLEEIVKEAEDLDRENKERLKEIARKARELNEENKDLLRRVKELVDRNVDKDTLRDEVRKAVEDTKRRVDDLLRDVKRVADETKKKVDELLERVERVLRRVKEEVRRIDDERLVREVERVIREVRKRVEEVVRKVEESIKESEERVKELVKRVTDSLERSKKEVEDAIR

SEQ ID NO: 19596 - protein, 181 aa, Artificial Sequence; identical to SEQ ID NO: 19595
  Synthetic sequence.

SEQ ID NO: 19597 - protein, 181 aa, Artificial Sequence
  Synthetic sequence.
SEVEELLKRLEDILRENERRARELNRKNKEVLKDNRRRAEEVNRRNKRMLDEAERLAEDNVDKRELLERVKKVARETRELVKDLLRHSEKVVRDTRKVVEDILRHSEEVAERVRREVKKISDEKLVREVETKIEEVRRRSEELVKEVEKSLKESEDDSRRLVREIEESIRESEERIKRRVE

SEQ ID NO: 19598 - protein, 181 aa, Artificial Sequence; identical to SEQ ID NO: 19597
  Synthetic sequence.

SEQ ID NO: 19599 - protein, 178 aa, Artificial Sequence
  Synthetic sequence.
DEVEEILEKSRRTLEENKRRAKEAVRRSRETLRESEERVKRVVEELRDRLRRIEEEPRRREEIRKVLEELARDVERVLKELEELSKRDEDEVKRVIDENRKSLDKDRRDVEKVIREIQDEDALRKIKKVLDETETESRRTLEELRKVLEETHRRNEKLIRDLREVLKEIEEAVRRREK

SEQ ID NO: 19600 - protein, 178 aa, Artificial Sequence; identical to SEQ ID NO: 19599
  Synthetic sequence.

SEQ ID NO: 19601 - protein, 178 aa, Artificial Sequence
  Synthetic sequence.
DEVEEALRRLEDLLRRNVEEAKEVVKDSERTLREDAERVKRVVEKSKRTLEAIEKRDLRRELIKEVLDKDREDVDRVLKDSKRTLEEDKERVKRALERNKKSLEDISRRVEDVIRKVTDEEAVRRIEEVLKKIREDSKRTIDELRRVLERTEEETRRLIKELEDVLRRTEEEVKRRLK

SEQ ID NO: 19602 - protein, 178 aa, Artificial Sequence; identical to SEQ ID NO: 19601
  Synthetic sequence.

SEQ ID NO: 19603 - protein, 186 aa, Artificial Sequence
  Synthetic sequence.
SEVEKVLEEIKRLLDRIKERVDETDRRNKELLKKIKDEVRRAVEEIRRLLEEIKKSADEKGGERKEVRDEAKRVLDRIRDLLRKLREEIERVLRESRKLNEESNKEIKDLLKEVEDRVEDIKRKIGDEKLVREVEEVVTRVRKTIEDLVKKDNDSVRKSEERIKEVVKRIEEEVKRVLEDVDRLAK

SEQ ID NO: 19604 - protein, 186 aa, Artificial Sequence; identical to SEQ ID NO: 19603
  Synthetic sequence.

SEQ ID NO: 19605 - protein, 177 aa, Artificial Sequence
  Synthetic sequence.
DEVRELLERNRRLLEEIKKTVKDLIRRNEELLKRIEDDAKRLIDRNEELLDELEKRLKDDRLIREAKERLKKSLEDVKRRVEEVKRRLEKSLEEVETIIREAEKRNRDSLREMERRVKGEELEELRRVVEESDETIKRLLEEAKESVDRSLDRIRKLLEDVRRSVERSKKRIDEKRK

SEQ ID NO: 19606 - protein, 177 aa, Artificial Sequence; identical to SEQ ID NO: 19605
  Synthetic sequence.

SEQ ID NO: 19607 - protein, 177 aa, Artificial Sequence
  Synthetic sequence.
DEVRKILKDIEDILREIEERVKRVIERNKRILEKIREDVKRVDDRNKKLLEELERKLKGRELIKRAKEELDRTLEDARRLIEEAKRTLDESLEDIRRLIEEVSRRIERLLEEIRRKVKGDDLRRVEEVAKRIKDRIRELLDEIRRSVERSKRDVKRLLDELRRSVEESKRRIDEREK

SEQ ID NO: 19608 - protein, 177 aa, Artificial Sequence; identical to SEQ ID NO: 19607
  Synthetic sequence.

SEQ ID NO: 19609 - protein, 177 aa, Artificial Sequence
  Synthetic sequence.
SEVDKLLRENEKLLEDIERTVKRMLERIKKLNDDVHREIRRIDEENRRLLDEIEKKVRDERMVREVTERLKRTLDEIRDIARKAAEEHDRLLEEAEKIIRDVREESDRSLEEIERKVKGRDLDRLRRVVEKSKKRIEELEREARKVAKDVKKNLEELLEEVKESVRESEKRIKETEK

SEQ ID NO: 19610 - protein, 177 aa, Artificial Sequence; identical to SEQ ID NO: 19609
  Synthetic sequence.

SEQ ID NO: 19611 - protein, 184 aa, Artificial Sequence
  Synthetic sequence.
SLKERIEEELKKVKDTSDRLNEEVRRSVEDTRKRSEDLNEEVRRSVEESRRRVESLLKRIEDEDKARELRKKVEKVARDTRRLIKEDKDRSDKMVRDTERLIEEDARESEKAVREVEELVRRVDKEEEVKKIIERIEEILERSERRNREIIKRDEEALKRSEERNREIIERDKEMLERLEREVR

SEQ ID NO: 19612 - protein, 184 aa, Artificial Sequence; identical to SEQ ID NO: 19611
  Synthetic sequence.

SEQ ID NO: 19613 - protein, 184 aa, Artificial Sequence
  Synthetic sequence.
SLIETIKEVVKRVAETSKRLNDRVREELRKVEREVEELNREVERVLREVETAVDDLVKKIEDEEKVRRVEELVREVAREVRELIKENKEEVDRIAKEVEELVETDKRDVDRVVREVEELLKRVRRREEAEDIIRKIEEVLKKSKELNDRIIERIKKMLEDLRRHNEEIIEKIRRALKRLEDEAR

SEQ ID NO: 19614 - protein, 184 aa, Artificial Sequence; identical to SEQ ID NO: 19613
  Synthetic sequence.

SEQ ID NO: 19615 - protein, 184 aa, Artificial Sequence
  Synthetic sequence.
SLKETIRELLKRVEEESRKLNEDVARSVRETKRRSDRLNEEVERSVRRSEEEVRRLLKRIEDEEKARRLADKVRRLVERTKKLIDEDRDEVRRVVEETKELIKDSKKKVDELSEEVERLVDKIDRKEKAEEIIRRIKEMLRRDEEENRRIIERDERALDKSRRLNEKIIEEDKKAMRDLEEEVK

SEQ ID NO: 19616 - protein, 184 aa, Artificial Sequence; identical to SEQ ID NO: 19615
  Synthetic sequence.

SEQ ID NO: 19617 - protein, 181 aa, Artificial Sequence
  Synthetic sequence.
SEVEEIIKENRRTLERDRREVEKVIEENKRSLEEIERKVREIIKDNDRSAKEITELAKAGVPRKDLKRFLEEDKRRVEKVLDELRKLLEEDRRKVEEALRKSEKTLREDERRAREVIRRIDDEELVDRLRKSLRDVREESKKLIDELRRSLEESDRRVKELIDRLRKSLDDSRKLVDDLRR

SEQ ID NO: 19618 - protein, 181 aa, Artificial Sequence; identical to SEQ ID NO: 19617
  Synthetic sequence.

SEQ ID NO: 19619 - protein, 181 aa, Artificial Sequence
  Synthetic sequence.
SEVEEIIKDNERTLEEIRKRVEDVIREIRRLLERIERRVREAIKRNEESLRRIKELVERGIDRRELEKLLRKDEEDVRRMLEELKRLLDEIRKRVKEAIDELERLLREDEKRADEVIRRIEDDELVRTLRESLRRVAEEVKRLLKEVEDVAREVEDRVKKLIEDLRRSLEKSREDVERDSK

SEQ ID NO: 19620 - protein, 181 aa, Artificial Sequence; identical to SEQ ID NO: 19619
  Synthetic sequence.

SEQ ID NO: 19621 - protein, 188 aa, Artificial Sequence
  Synthetic sequence.
DRVREIIKRLRDLLREIRTVVRKIIEDNRKSLEEIEEHNRRVIRELRELLKEIKETVEREGRNDEVKERLDELLRRLKKRVEEIVRRNEKLLEEDKRRIDEALEELERLLRRLKRVVEKAVDELAKENKEEMIRTVKKVITEIAEEVKRLADEVRDSVRRSEEAVRRLTKETKEVVDDIVRRVRELIE

SEQ ID NO: 19622 - protein, 188 aa, Artificial Sequence; identical to SEQ ID NO: 19621
  Synthetic sequence.

SEQ ID NO: 19623 - protein, 188 aa, Artificial Sequence
  Synthetic sequence.
KKVEEIIEELKKLLREIEEHNKRVIEENERSLEEIKRHNEEVIEELRELLERIEEVVKRKGKNERVVEELEKLARDLKKRAEEAVERNKRLLDEDRDRMRKVLERNERLLRRLRTRVEKVLRDLKRDRKEDMIRTVEDVVRRIERRVRELSRESEESIRRSTETVKKLTKDTRDVVRRILKTVRDRIK

SEQ ID NO: 19624 - protein, 188 aa, Artificial Sequence; identical to SEQ ID NO: 19623
  Synthetic sequence.

SEQ ID NO: 19625 - protein, 187 aa, Artificial Sequence
  Synthetic sequence.
SLEERLREVLKDIERRVRELNETNKRVLDKSKTTVDELLKRLREVLEEIREEVRKLIEELARRGKREVLEKIKKDLEELRKTVEEAIKEIERLLREDEKRVREALRDSERLLEELRERVRKAIEEVKGREMIEKVLRDLEELAKRIEDKNRETIKESEKTLEEIRRRVDRLLEELRRLLKEIAKEVK

SEQ ID NO: 19626 - protein, 187 aa, Artificial Sequence; identical to SEQ ID NO: 19625
  Synthetic sequence.

SEQ ID NO: 19627 - protein, 187 aa, Artificial Sequence
  Synthetic sequence.
SLEETLEKVLRDITERSERLIRENEKNLRDVKREVEKLNERNRDVLKKIREKVRELIEELRRKGKKEVLEEIEERLKRIEEEVRRALERSREILREIEKRNDETLKTSKDTLERIREEVEKISDKVKGEEAIRKVLEELKKLLEEDERRAKRVSEESKELLDRLAEDNERTIRKLERLLEELERRTK

SEQ ID NO: 19628 - protein, 187 aa, Artificial Sequence; identical to SEQ ID NO: 19627
  Synthetic sequence.

SEQ ID NO: 19629 - protein, 182 aa, Artificial Sequence
  Synthetic sequence.
SEVDKVLEELKKLLDDDRREVERLLRELRRLLDRDRREVEKSIRTLEKLLKEIEDIVRERKEAKEELRRLLEEIEDVSRKSLEDNEKTLRDIRRTVEKILRDNEKTARDIKKRVEEIERRIKDKRALERVREVLERAEDESRKLSERIKKVLEDIERESKRLSEEDREVLKRIKEEVERLEK

SEQ ID NO: 19630 - protein, 182 aa, Artificial Sequence; identical to SEQ ID NO: 19629
  Synthetic sequence.

SEQ ID NO: 19631 - protein, 182 aa, Artificial Sequence
  Synthetic sequence.
SEVDKVLEELKELLKRLEEDVKRSSKESEDLLRKDEEDVRRSIRELERLLEEIEERVRRRKDAKEELRRLLDDIRRKSEDSLRRNTETMEENRKKSEESLKRIEDAAREIAERVKDIERKIKDERALREVRKVLEDIKKSVDELLKEDKDNLRETARESERLSREDKKVLERIEERVKELED

SEQ ID NO: 19632 - protein, 182 aa, Artificial Sequence; identical to SEQ ID NO: 19631
  Synthetic sequence.

SEQ ID NO: 19633 - protein, 182 aa, Artificial Sequence
  Synthetic sequence.
SEVEKVIEELKKLADDDRRRVEKSLRELRKLLEELEKRVRDSLEKLKKLLKEIEDRVRRRKDMKEELRKLLEDIERESRKSLEDIKKMLEKIERKSRESLKENEETARRITRRVEDIERKIKDEKLLREVRKVLREARETSRELSRADEKVLRDIRREVKRALDADKKVLDDIRERVKELEK

SEQ ID NO: 19634 - protein, 182 aa, Artificial Sequence; identical to SEQ ID NO: 19633
  Synthetic sequence.

SEQ ID NO: 19635 - protein, 184 aa, Artificial Sequence
  Synthetic sequence.
DEVEKILKEIDDAVKDLKRKSDKSLTDDRRMVEELKKKSEESLREVEEMVRRLEDEASRTTDEEKLDRLRKKVETVERKIRKTIRDLEDDVRRIVETTKKTIKELKDKARKIVEDVKRLVDRLEDEKVVRRVRDILDKLRKTVERLVEENEDSARRTEETIRKLVKDNEDILRELRRLIEERRT

SEQ ID NO: 19636 - protein, 184 aa, Artificial Sequence; identical to SEQ ID NO: 19635
  Synthetic sequence.

SEQ ID NO: 19637 - protein, 182 aa, Artificial Sequence
  Synthetic sequence.
SEVEEMLERLKELLRRIEKVVRDSLRRLKELMRRDEEEVRRSLRRLEELLKEIERVARERKEVQEELERLLREVEKVVRTSTEKNKRSLEEIREVVRRSSERLKKLLEEVKRRVKEVLDRLGDKKVLDEVKELLERIEETVRRLIEENERVLEEAEELSRKLSEDNEKVLEDARREAERLTK

SEQ ID NO: 19638 - protein, 182 aa, Artificial Sequence; identical to SEQ ID NO: 19637
  Synthetic sequence.

SEQ ID NO: 19639 - protein, 182 aa, Artificial Sequence
  Synthetic sequence.
DEVEEVLKELEKLAREDEDRVRKSEKKLRELADKDREDVERSLRRLERLLEELKRVVEERKEVKEELERLLERIEEVVRKSTEDNKRSLEEIERVVRESSKENKDTLDRIRERVEDILRRLGDKDMLERVERLLREAEKLSEKLSRDNEDLLRRARDLSRELSKENERLLEDIRRRVEEAIK

SEQ ID NO: 19640 - protein, 182 aa, Artificial Sequence; identical to SEQ ID NO: 19639
  Synthetic sequence.

SEQ ID NO: 19641 - protein, 182 aa, Artificial Sequence
  Synthetic sequence.
REVEEVLERLKRLLDTLEREVRKSLEELKRLLDELRKESKKSLDELRKLAEELERVVRRLKEVTERLDELVRRIEKKVRDSIRRLKKLLEEIEKKVRDSSKKLEELLETIKRVVEEILRRLGDEKMLREVKRVLEEAERRVRELIEENKRLLKEIKEEVKKLIEENEKVLEEARRLAEELKK

SEQ ID NO: 19642 - protein, 182 aa, Artificial Sequence; identical to SEQ ID NO: 19641
  Synthetic sequence.

SEQ ID NO: 19643 - protein, 182 aa, Artificial Sequence
  Synthetic sequence.
DEVREVLKKLEKLADELREEVRKSLEDLKRLLREDEERSKESLKDLERLAREIEEVVKKKKEVEEELEKLLREVRKKVKESLDRNKKSLDDIRKRVKESSDKLRELLKRIKEEVEDILRKLGDEKALRDVEELLRRIEERVRRLIKENEDLLREIEKTSEKLSRDNKELLKEIEERVRRLRQ

SEQ ID NO: 19644 - protein, 182 aa, Artificial Sequence; identical to SEQ ID NO: 19643
  Synthetic sequence.

SEQ ID NO: 19645 - protein, 182 aa, Artificial Sequence
  Synthetic sequence.
DEVEEALKTLEELMRRDKEEVDKSLEKLRRLLKEDEDRSRESLERLKRLAEELEEVVKKEKEVKEKLKKLLDDIRRLVEESLERNKRSLEEIERTVRESSRKNKETLEEIKKVVDDVLRRLGDRRVLERVKKLLEDARRLSERLSEENERVLEEAKRRSEELSKRNEDLLREIEKKMKEDTR

SEQ ID NO: 19646 - protein, 182 aa, Artificial Sequence; identical to SEQ ID NO: 19645
  Synthetic sequence.

SEQ ID NO: 19647 - protein, 182 aa, Artificial Sequence
  Synthetic sequence.
SEVEKVLEELKKLADDLRRTSKRSEEELEKLARELEKRVRESEKRLRDLLRELEDVVRKKKEVKDELRELLKRIEDVVRRSTEELKKLLDDIRRRVKESIDTLRRLLEEIERRVKKILEDLGDKDALKRVKELLDRIREEVEKLIRRNEKLLRDIEEKVRTLLERNERVLEEIKKKVDDDIK

SEQ ID NO: 19648 - protein, 182 aa, Artificial Sequence; identical to SEQ ID NO: 19647
  Synthetic sequence.

SEQ ID NO: 19649 - protein, 182 aa, Artificial Sequence
  Synthetic sequence.
DEVREVLEELRRLMKELRDVSEKSLRDLRKLAEEDKDRVRKSLEKLRELLRTLEDVVRKRKEVREELDKLLEDIEREVRTSTKENKESLERIREVVERSVRKLERLLEEIKRVVDDILRKLGDEKMLREVEDLLRRAEKEVRRLIEENKKLLKEAEETSRKLSKENEDVLRDIRRAVEELKR

SEQ ID NO: 19650 - protein, 182 aa, Artificial Sequence; identical to SEQ ID NO: 19649
  Synthetic sequence.

SEQ ID NO: 19651 - protein, 182 aa, Artificial Sequence
  Synthetic sequence.
SEVEKALEDLERLAKELEKVSRESLRRLEKLLEDDRRRSKRSLEELEELLDRLRDTVRRRKEVKEELRKLLDRIRERVKESLDRNEESMREIKEVVDRSIDRLRRLLERIRRVVKKVEDDLGDEKALREVRDLLRRIEERVKKLIEDNRKLLEDARRESERLSEENKRVLEKIEREVKKLED

SEQ ID NO: 19652 - protein, 182 aa, Artificial Sequence; identical to SEQ ID NO: 19651
  Synthetic sequence.

SEQ ID NO: 19653 - protein, 182 aa, Artificial Sequence
  Synthetic sequence.
SRVEEVLKKLEDLLRRLEEVSERSLRELRELVKRLEDVVRRSEKKLKELADRIEEVVRRRKEVREELRELLKRVEDTVRRSNEELKKLLDEIRKKVEESIRTLKKLLDEIREEVERILRELGDKKALDDVRRLLEEIEKRVTELIERNRRLLEEAEDRVRKLLRDNEELLKRIEKLVRDLER

SEQ ID NO: 19654 - protein, 182 aa, Artificial Sequence; identical to SEQ ID NO: 19653
  Synthetic sequence.

SEQ ID NO: 19655 - protein, 182 aa, Artificial Sequence
  Synthetic sequence.
SRVEEVARKLEDLLRELKRVSDESLKTLEKLMTDDERRVRESLDKLRELAREIDEVVRRRKEDDEKLKRLLERVEEVVEKSNRDNRESLERIRKVVEESIRKLEKLLERIRREVKKIEEELGDEDALREVRRLLERAEELVRELIKRNEDVLREAKRTSDELSERNRRLLERIKETVDRKRK

SEQ ID NO: 19656 - protein, 182 aa, Artificial Sequence; identical to SEQ ID NO: 19655
  Synthetic sequence.

SEQ ID NO: 19657 - protein, 177 aa, Artificial Sequence
  Synthetic sequence.
REVEEILKRIEELLRRIKKLSEETLREIAKLLEDIKRLSEETLKSNKDLLKRVRDELRTEEAIKKVKEENDKNLKDSEKIIREVAERIKRALEKSREIIKKVKKEIEDLLDEARKKIDSRMLREIERIIKELKELVDKLLEDNERLIERLDREVKRLLEENEKSVREASREIDERRR

SEQ ID NO: 19658 - protein, 177 aa, Artificial Sequence; identical to SEQ ID NO: 19657
  Synthetic sequence.

SEQ ID NO: 19659 - protein, 177 aa, Artificial Sequence
  Synthetic sequence.
DEVEELLRRIERLVEEARRLVEELLETNKKLLKDIEKLSRDTLKSNEELLREVKDRVRTEELVRRVAERNRKNLEESERIIREVKRRNEENLREAERIIRELERLIKELEREVREKVDSEMLRRLETIIREAERDLRRLLKEARDSVKKVSDEIKRLLEENKRSVDRVSREIKRVEK

SEQ ID NO: 19660 - protein, 177 aa, Artificial Sequence; identical to SEQ ID NO: 19659
  Synthetic sequence.

SEQ ID NO: 19661 - protein, 181 aa, Artificial Sequence
  Synthetic sequence.
DEVEELLKEIRELIEEARRRIEELLKEDRDIVRRVTELSRRTLEKIKDLIRKIKDIADRNDKRERAVEKVAKEIKELKDESKKVIDDIDKLIKESDEKAKKLIEEMKKRIKELKDKVRRDVDSEMLRRLEELIKEIEDLVRKLLEELKRSVRETEERVRKLKEDNDELIKRIDELVKEREK

SEQ ID NO: 19662 - protein, 181 aa, Artificial Sequence; identical to SEQ ID NO: 19661
  Synthetic sequence.

SEQ ID NO: 19663 - protein, 185 aa, Artificial Sequence
  Synthetic sequence.
SSLDDLRRLAEELLRTNKKLMEDLRRTNEKLIKEIEDVLRRIRESSKRIKEEVDKLTRDVRGDEELKRVIDELRKKVEDNLERVKRLIDRLRELVDRNHERVKTLVDDSRKKLEDLRERVERLPIDRKVLERVKEAVDEVRRSVEESLRDAKRMDEETRKTVEDVRREVTKSVEDVKRRIDESRK

SEQ ID NO: 19664 - protein, 185 aa, Artificial Sequence; identical to SEQ ID NO: 19663
  Synthetic sequence.

SEQ ID NO: 19665 - protein, 184 aa, Artificial Sequence
  Synthetic sequence.
DEVDEVVREVERLLEELRKENDKSVEEDKRLVDKLREEVKRILEEVRKLLEDLARKAKEDKREKVVEELRREAKKILDDIRRVIEELKKKITEILERTREAIRRSEEAARKIVEDIERVASKLKDKDVLRKLREVIKEVERIAEEVVRKNKDSADKSRKIIEDVVRALKKVVDDVRKIAEDLSR

SEQ ID NO: 19666 - protein, 184 aa, Artificial Sequence; identical to SEQ ID NO: 19665
  Synthetic sequence.

SEQ ID NO: 19667 - protein, 181 aa, Artificial Sequence
  Synthetic sequence.
DEVEKAVRESEETVKDIRRRNDETVRRLRELAKRLKERNEESVRRLRDLLRRLDEEVARRGRREEVEKVLKRIKDEVRRTLEESRKILEDIERDIERSLRDSRRLVTEDLDRLDKLLRKTTDERVLRDIRRVMEDSERIVKEVLDRNRKVAEDVRRIVEEVLRVNEDVLRKIEKRVRELKK

SEQ ID NO: 19668 - protein, 181 aa, Artificial Sequence; identical to SEQ ID NO: 19667
  Synthetic sequence.

SEQ ID NO: 19669 - protein, 181 aa, Artificial Sequence
  Synthetic sequence.
SELEEIKKRVDRALEENNKLLKEIEERVRKSNRDNERLLKEIEDRVREVTERIKKVEEEGRDRSVLEKIVRKVLDDIRRVMEESEELNRRSNKEIRRVLEESRELLKRVREEIEEVLKKVTDEDVLKKIRDLAREVEENVRESERKIKKLAEDDNRSVAESLREIKRLADEVKRRVDEARK

SEQ ID NO: 19670 - protein, 181 aa, Artificial Sequence; identical to SEQ ID NO: 19669
  Synthetic sequence.

SEQ ID NO: 19671 - protein, 182 aa, Artificial Sequence
  Synthetic sequence.
SELEEVRKRVKDVNRKNKELLDEIERTVRELLEDDRRLVDEAKKELDTLLRDIERLRREGVDREVLDRVLKRVKEIADRVKELLDRSLERLRREIERLKELVERSREEIERLIRKVETELKDVEDALREIRRLLEEVRKSIEDSKRLIEELLRRLKKVTDESRKKVEDLLREVEREVREAKK

SEQ ID NO: 19672 - protein, 182 aa, Artificial Sequence; identical to SEQ ID NO: 19671
  Synthetic sequence.

SEQ ID NO: 19673 - protein, 182 aa, Artificial Sequence
  Synthetic sequence.
RELEEIEKELKRMLDENRRLLERIEEEVRRLNEDNRRLLEEIEKTVEDLLEKIRKLSKEGVPEEVLRRVLREVEKIIKDAKKLLETTAERIRTIIEEARKRSEESLRRVTEIVKEVLRKLKDVREALKRIEELLREIEEVVKRSKTEIERLLRELEESVRRSDERIERLLKRVKDVVDEEER

SEQ ID NO: 19674 - protein, 182 aa, Artificial Sequence; identical to SEQ ID NO: 19673
  Synthetic sequence.

SEQ ID NO: 19675 - protein, 182 aa, Artificial Sequence
  Synthetic sequence.
EKEKEITKTLEDLIRKNRKLLEEIERRVKEVLKRDRELLEEIERRVADMLRRIRDVLRKGVPEEVLDRLLKEVKRIADKARRDLDRSLDEIRRIAEEAKKRNRDSLEEVKRIVEKVATEVKDLREVLERIKRLLEKVEKVSTESAKRIEELLEEVKRVTDDSKRRVTELLREVERVVDEVRR

SEQ ID NO: 19676 - protein, 182 aa, Artificial Sequence; identical to SEQ ID NO: 19675
  Synthetic sequence.

SEQ ID NO: 19677 - protein, 180 aa, Artificial Sequence
  Synthetic sequence.
DTLRELAKKAKELDDRNRKLLETVEELVRRVNEKNKDLLRRVRELARELLDRLRKLAREGSGKALRDIKKEIDRLLEELRRLVKESADEIDEILKEARRLVDESREEIKRLLDEVRDKVEDEEVRRELERLVRKLEESVRKSRKDVEDLITELKKSVKESLKEIEDLVRRLREVVKEIER

SEQ ID NO: 19678 - protein, 180 aa, Artificial Sequence; identical to SEQ ID NO: 19677
  Synthetic sequence.

SEQ ID NO: 19679 - protein, 182 aa, Artificial Sequence
  Synthetic sequence.
EEVDRILKESEDTIREIRDRVRKMLETSKKTVEEIKRRVDRALERDKKLVEDLRERVERTGRDKEVEKIVTDILRHSRELVREIEKLITEDKREVERALEEIERLVREDEERVRRVVEELRELKEAVEKMRRIVRESREVVARIREDIKRVLDESDKVVKDLKRAADRSVEEVKKVVDDIKK

SEQ ID NO: 19680 - protein, 182 aa, Artificial Sequence; identical to SEQ ID NO: 19679
  Synthetic sequence.

SEQ ID NO: 19681 - protein, 184 aa, Artificial Sequence
  Synthetic sequence.
SELERLKETSKDTIKKIKDLLRELKKTVDDVIERDKTLLDDLREKVERVIRRIEELLKRTRDDRLLEKILREIKEALKKLEEDVRKILKENKDALRELEDRVRKIKDDNRKALRRLEEEVARLKDEKVRDEIRKLIETNKRVADRVEEEVRKLIEDSERSLRKSEKDVKELIKKVEEVMEEVRR

SEQ ID NO: 19682 - protein, 184 aa, Artificial Sequence; identical to SEQ ID NO: 19681
  Synthetic sequence.

SEQ ID NO: 19683 - protein, 184 aa, Artificial Sequence
  Synthetic sequence.
SIEETVKRLIEEIERVLRDARRESKRLSEEDKKVLDEIREEVRKLEEKIKTVLDKARKDISDEDKLRRVKERVEEAIRRLRKLLREIEERSRESLRDNERTAREIERKVREIIKELRELLERLRTEKLLDEVRRRVEEVIKELEELLRRDKERVDRSIRELEKLLEEIKERVDRMIKELEDRLR

SEQ ID NO: 19684 - protein, 184 aa, Artificial Sequence; identical to SEQ ID NO: 19683
  Synthetic sequence.

SEQ ID NO: 19685 - protein, 182 aa, Artificial Sequence
  Synthetic sequence.
REVEEADKTVKELIKRNKELLDRIKKEVDELIRRDKELLDKAERDVDRLIKELRDVAREGVDRKVIDELRRDLERLIKKLAEDNKRSLDEARELIREVEERDKRSLDEARKLIRDAERRVKDGKEVVDEIRRLLRELEKVSEDTKREIRELLKRAEESVRRVTERIERLLKELRDVIREIEK

SEQ ID NO: 19686 - protein, 182 aa, Artificial Sequence; identical to SEQ ID NO: 19685
  Synthetic sequence.

SEQ ID NO: 19687 - protein, 182 aa, Artificial Sequence
  Synthetic sequence.
DELEKIKKDVKKMIRDNEDLLRRVEERVRELNRRNEELLKEIEKRVEELIKRLEDVARRGEPEEVITTLEKEVRRLIKEVAERDEESLRENRKLIKEIEERDRESLRRAEKLIREVEKEVKDKREVLEAIRRLEKEARDVSRRSTRKIEELLETSETSSEKSKRRIEELLRRLERVVEEARK

SEQ ID NO: 19688 - protein, 182 aa, Artificial Sequence; identical to SEQ ID NO: 19687
  Synthetic sequence.

SEQ ID NO: 19689 - protein, 186 aa, Artificial Sequence
  Synthetic sequence.
EELERAAERIEELLRSNRDLADKITKLSRETLEKIKDLLRKIEKEVRELLERIKDLERRLKDKDTLRREIERLLREVTEIIKRVKKEVDELLRESEEIMTRVKKENEDNLRKAEEIVRDAERRVKDKEEVLRELERLLRELKKSVDELSRLIEELLRENKRLIDEVKKRIDELLEELKKLIEKVKK

SEQ ID NO: 19690 - protein, 186 aa, Artificial Sequence; identical to SEQ ID NO: 19689
  Synthetic sequence.

SEQ ID NO: 19691 - protein, 181 aa, Artificial Sequence
  Synthetic sequence.
EIEKVVEEVIRRVRKVLEEVERSVRDTIERIKDVLRRVEEVVRRTDKTIRDVLDRIRKEISDKDKLARVKEIVDEALERSRRSLDEVRKRVEDVVRDSERSLEEAERIVREAIKRLEELLRQKVRDEDIRRVLEDIRRELKRIVDENRKLAEEIIRTLERMVEKNKELMKEVVKKLEEDSR

SEQ ID NO: 19692 - protein, 181 aa, Artificial Sequence; identical to SEQ ID NO: 19691
  Synthetic sequence.

SEQ ID NO: 19693 - protein, 181 aa, Artificial Sequence
  Synthetic sequence.
RIKETVDKVIEEVRRVLEEVRTTVKRTDERIKEVLEEVEETVRRTLEEIRRVLEELERAIKDKDKLDKVRKKVEEVLRRSERSLERAEEIVRKANKESKDSLDEAERIVREVIKELERVLKDNVRDEDIRDLVRKIKEELRRIVEKNRELMEKVERELRRIVEENERLARRIKEELDRDMK

SEQ ID NO: 19694 - protein, 181 aa, Artificial Sequence; identical to SEQ ID NO: 19693
  Synthetic sequence.

SEQ ID NO: 19695 - protein, 181 aa, Artificial Sequence
  Synthetic sequence.
RIEEIVERLIREVEKVLRDVERTVDKTDRKIREVLEEVRRISDESIKEVREVLEDLERKIKDKDKLKEVRDEVREVIKELEDTLRKAEKIAREVNKESKKSLDDIRKEVKDVIERLEDLLRNKVRDEDIRRLAEEIKKKLKRMVERNKELMERIEREIREIVERDKELVERIKRKLRELAR

SEQ ID NO: 19696 - protein, 181 aa, Artificial Sequence; identical to SEQ ID NO: 19695
  Synthetic sequence.

SEQ ID NO: 19697 - protein, 181 aa, Artificial Sequence
  Synthetic sequence.
SIEDVVREVIKRVEDVLRRVEEVSRETIERVRRVLREVEERVERTDERIRRILDKLAKSIKDEDKLRKVEEEVKRVEEESRESLERIREIVERVIRELERTAEKAREDVERVIRELEELLARNVRDEDIRRLVKKIEEDLTRIVERDKELLEDIERELRRMVEENERLLEEIERRARDEER

SEQ ID NO: 19698 - protein, 181 aa, Artificial Sequence; identical to SEQ ID NO: 19697
  Synthetic sequence.

SEQ ID NO: 19699 - protein, 175 aa, Artificial Sequence
  Synthetic sequence.
EELERLARDVDKRVEDLKDDIRKIREEVKRLLDDNRRRAEEILEESRKSLETLTDLMRRNRVDKRELEELAEESKREVKRLLEESEEHIERIKERVDRLLKELKRKVDKIKEDVKRDARSEIVKRVLEKLDEVLKDLKRTIDELKKRLEDVLRESRDIARRALEENERVLDELRK

SEQ ID NO: 19700 - protein, 175 aa, Artificial Sequence; identical to SEQ ID NO: 19699
  Synthetic sequence.

SEQ ID NO: 19701 - protein, 175 aa, Artificial Sequence
  Synthetic sequence.
SEEDRIAEESRESLEKLKDDIRKIEDRVRKLLEDNKRRAEEILREVEEDLKRIEELFKQNRVDKEDLRRKVEEIERKIRKLMEESKKHVEKIIREVKKLLDELRRKVEESLKEIKKKLRSEIVRRLLEENKRVLDELEKRIEELLRRLDKVLKESERIAREAERKIEEVLRKLEK

SEQ ID NO: 19702 - protein, 175 aa, Artificial Sequence; identical to SEQ ID NO: 19701
  Synthetic sequence.

SEQ ID NO: 19703 - protein, 181 aa, Artificial Sequence
  Synthetic sequence.
SAEEIIDRVTKEAKKSIDRTRDRITKLRRELEESIRRSRDIITKLLEELRRVVEEVKRDKRELEELVKKIKEVIDRLREKIERNVRKTEDMVRKLEEKIDRIVRRTEKRVEELKEEAKRVRTEKVVEDLERKVEEIVREDEDLVRRLAEEVKRVVEDDERTAKKLEDDVRRIIEAVKRELK

SEQ ID NO: 19704 - protein, 181 aa, Artificial Sequence; identical to SEQ ID NO: 19703
  Synthetic sequence.

SEQ ID NO: 19705 - protein, 173 aa, Artificial Sequence
  Synthetic sequence.
SLEELLEEARKTVERLIRESERVLRESEERVRRLIEELERVVRETRKRVKEVIERVEDEEALKELEKLLREDSKRVKEVLDDLRRDLERNKRRNEKVLRELEELLKRLEELVREGVREEELEKLLREIEERVKEMLKRDEDTLREIERKVKEAVRDSERTLEEIEKRVTEEKT

SEQ ID NO: 19706 - protein, 173 aa, Artificial Sequence; identical to SEQ ID NO: 19705
  Synthetic sequence.

SEQ ID NO: 19707 - protein, 181 aa, Artificial Sequence
  Synthetic sequence.
SITEEIKDIERKVEKLIRELDEENKRILETLEREAKDVLRRIEDINEKLHRRARDLKRKGVDRREVDKLIREADKLHRDLKELIDRLATEVKDRLRKSLERVKKLIKEIRELVERLAEKVTREELKRVLDRVLKKVEDLLRKLEKSVRDSERRLEELLRELREVVKRVRDNIEKVLEELER

SEQ ID NO: 19708 - protein, 181 aa, Artificial Sequence; identical to SEQ ID NO: 19707
  Synthetic sequence.

SEQ ID NO: 19709 - protein, 181 aa, Artificial Sequence
  Synthetic sequence.
SIREEAREELKRLEEEAERLDRENREILKELTREFKELLKESRDINREIHERIRKLKKDGVDRKDVRRTIEDAKRKHEESHKKVEDLIRTVTERLKKSLEDVKRLIDEVRKRVDELRKRSTDRKLDKVLKEIEERLRELLKRLEDSVRESEKRLRDLLRELAKVDEEAKRNVEKVLKELED

SEQ ID NO: 19710 - protein, 181 aa, Artificial Sequence; identical to SEQ ID NO: 19709
  Synthetic sequence.

SEQ ID NO: 19711 - protein, 179 aa, Artificial Sequence
  Synthetic sequence.
SIKDEIRKLLEKVKREVEEIDDRNRRLLEKVKREAEELLEKNRRLLEEVRKRAEELKDSSEEMVEKLLEDATRLVKTSEDEIRALLKRAEDLVRDSRRRIEEILRTARRALERLREKFTDKDLERVVRDVERRIEELIRKLERSVDRSEEEVRRLIEELRKSVEDSKREVDRVVEELRR

SEQ ID NO: 19712 - protein, 179 aa, Artificial Sequence; identical to SEQ ID NO: 19711
  Synthetic sequence.

SEQ ID NO: 19713 - protein, 179 aa, Artificial Sequence
  Synthetic sequence.
SILEDVRRLLDEVKKLVEELLRENRRLLEEVKKEVEKLDRKNRELLREVRELVKELKDSSEEMVETLLRRAKKLVDDSREEIDRLLEELRRLVEDSRRKIEELLERAERLLEEVRRRFTDRKLEEAVREVEERVRDLIRKARESVDESRKRIEDLIRELKKSVEESLRDIERLIKELRD

SEQ ID NO: 19714 - protein, 179 aa, Artificial Sequence; identical to SEQ ID NO: 19713
  Synthetic sequence.

SEQ ID NO: 19715 - protein, 179 aa, Artificial Sequence
  Synthetic sequence.
STREDARRLVERVRKEVKRLLKKNSDLLREVTERVKTLNERNRRLLEEVEREAKRLKDSDERDVERLLDRARKLVKESEDLIRKLLKDLRELVRRSEKDIDELRKELKRLLDELRARATDKDLERVVREIEKEIRDLIRELEENVKTSEKLIEDLIRELEKSVDESRKRVEELVKELRT

SEQ ID NO: 19716 - protein, 179 aa, Artificial Sequence; identical to SEQ ID NO: 19715
  Synthetic sequence.

SEQ ID NO: 19717 - protein, 179 aa, Artificial Sequence
  Synthetic sequence.
SAEDVVREIEKTVRELMRRVEESVRKVEEDVKRLIKEVKDSADESEKKVERLLEEVKREKEEDEEVIRKLERLVEEDKERIRRAVRRLEELLKRDRERVEDVLRKLAELLERLKDRATKRKESEEELRRLLEEIKKEVDKVIRENEETLKRIKEVVERVIEDNKRTLREIEEEVRRIRK

SEQ ID NO: 19718 - protein, 179 aa, Artificial Sequence; identical to SEQ ID NO: 19717
  Synthetic sequence.

SEQ ID NO: 19719 - protein, 180 aa, Artificial Sequence
  Synthetic sequence.
SVEEVVKRILETIKDLMRRIKKNSEDVLETIKRLADEIRESVKRSNERIRELIKDIRETRKGDKVERIVRRLEELLRRNTRLVEKIERDLDRLLKENEDLLREIIKTLEKMLRDVRRIAEEGVGTDELEKLLREVEEIVKDVSRKSDTSLKKAEERVRDVKRKDEKTLRDAEEVVRREKK

SEQ ID NO: 19720 - protein, 180 aa, Artificial Sequence; identical to SEQ ID NO: 19719
  Synthetic sequence.

SEQ ID NO: 19721 - protein, 182 aa, Artificial Sequence
  Synthetic sequence.
SVEDLVRDVRDKAKRTSDEIRKLIERSKEIFERSSREIRRLIEESRDTARRVVEKLKKNGVDEELIRRLEKLVRELEKKHEDILRKNEELMREVVKEHERILERNEELMRELDDKARKNKDKSEEEIARLVEEVKRLVKESLELIEELHRRSEKLVRDSLREIKTLNDESRKIVTDVLREVT

SEQ ID NO: 19722 - protein, 182 aa, Artificial Sequence; identical to SEQ ID NO: 19721
  Synthetic sequence.

SEQ ID NO: 19723 - protein, 182 aa, Artificial Sequence
  Synthetic sequence.
KVEELVREVTEIARKVREDLERLVRESERRMRESSEKIKRLIEESRRRMKEVVEELKREGIPEELIKDLERLMREVDEEHKRILKKNEDLARELIEEHKDLIRRLEKLAEDLIREAEKNKDKSEEEIKRLREKVKRLVDKVKREIERLNRKSRELVKKSEEDIEKINRESRELLRKVLEDAK

SEQ ID NO: 19724 - protein, 182 aa, Artificial Sequence; identical to SEQ ID NO: 19723
  Synthetic sequence.

SEQ ID NO: 19725 - protein, 182 aa, Artificial Sequence
  Synthetic sequence.
DVEELIKEVKDKAKRTSDEIKKLIDESKRVLDEVVRRLEELVKRIKESADRVLEEIAREGVPEEILKKVEDLVRELKKRLEDLIERVKTVVRELKKKHDKILKENEELLEEVVRRAEENRDKDRKIAKKLVDDVERRLRKSLRLIEELNKESRDIVRELLRLIEELLKEVEELVERLLREVK

SEQ ID NO: 19726 - protein, 182 aa, Artificial Sequence; identical to SEQ ID NO: 19725
  Synthetic sequence.

SEQ ID NO: 19727 - protein, 175 aa, Artificial Sequence
  Synthetic sequence.
SELEKVLDEVRKRAKESLRRSEELAKRVEEMDERNLRNSKELRERVEEVIKRLLEVARQNRSDKKDLLRRIEEVLEEVRRHIEENLRHNEKVLEEVERVSEKNLRDVKRVLEEVRRKARSRVLEEVERIVKRVLDEDKKVLDRLRRSVERSSRESEKVLDELKKRVDRVLDEVRR

SEQ ID NO: 19728 - protein, 175 aa, Artificial Sequence; identical to SEQ ID NO: 19727
  Synthetic sequence.

SEQ ID NO: 19729 - protein, 175 aa, Artificial Sequence
  Synthetic sequence.
SELEKVFEDVKRRLDESLEKSKELLKRVRDTDRENLKNSKRLLERNKRLVDDLLRVVEANTRDKRELEKKNKDVADETREHSRRNVEHNKEVLRRVEEESRKNLEEVKEVLKDVRRRVRSRLLEELEKRAKKVLDDDKRVLDEARRSSKRVTDEDRKVLKTAEDINREVSKRIRD

SEQ ID NO: 19730 - protein, 175 aa, Artificial Sequence; identical to SEQ ID NO: 19729
  Synthetic sequence.

SEQ ID NO: 19731 - protein, 175 aa, Artificial Sequence
  Synthetic sequence.
SELEKVVDDVRRRLDRLLETSEKLLEDATKRLKDSERKSDEIVKTNEELLERLKTVLERRETDKRELLKENKEILERTRELSERNLKEVEDILREVEEEVRKNLRRIEKVLEEVRRKLRSELLKRVEERIKRVLDESKKILKEIADEVRRVLERDKELLKRLEDKNREVSERIRK

SEQ ID NO: 19732 - protein, 175 aa, Artificial Sequence; identical to SEQ ID NO: 19731
  Synthetic sequence.

SEQ ID NO: 19733 - protein, 174 aa, Artificial Sequence
  Synthetic sequence.
SELEKVVKEVADLLRRNLEKSKRVLEEVRRRLEENLRESEKVHDDNRKTARRILELVREGKDKRDLTRLLEEDDKRVKEALDKSRENNERILKEVRRALRESEEDNRRILKEVREKVDSRLLEELEERVRESIERSRRFIEELEKIVEETLTESEKLARASSEITKTVLDEIRK

SEQ ID NO: 19734 - protein, 174 aa, Artificial Sequence; identical to SEQ ID NO: 19733
  Synthetic sequence.

SEQ ID NO: 19735 - protein, 174 aa, Artificial Sequence
  Synthetic sequence.
RELEEVFKEVEKELRDNLRKVEEVLREVRERLKENLDRSKEVLKDVRRRIKELLDLARGGKDKRELEKRVRKIEKDVRKLMEESKENNKRILERVEEAMKDSERDNRRILDKVRKKVDSKLLERLERKVEETLRRSREVIEDAKRIVEETLRRSEDIIREAKEIIDDVLEKIRR

SEQ ID NO: 19736 - protein, 174 aa, Artificial Sequence; identical to SEQ ID NO: 19735
  Synthetic sequence.

SEQ ID NO: 19737 - protein, 180 aa, Artificial Sequence
  Synthetic sequence.
STDDALRKIERRHKELTKEVRDMLRKVDEEVKRLIEENEDVLRKLREEVDRVIKDIRRADTPNVDELLDEVRRLLEEVERHNKKTLDDLEKRLRDIREKARKLLEDNERALERIKRVVEAGKVDLEDLRRDSERIIEEVKRRLDELRREVEKVIDDVRRLSEKNEKDARRIIEEVKRRLD

SEQ ID NO: 19738 - protein, 180 aa, Artificial Sequence; identical to SEQ ID NO: 19737
  Synthetic sequence.

SEQ ID NO: 19739 - protein, 180 aa, Artificial Sequence
  Synthetic sequence.
STEEVLDEIRKLHKTLTEDIKRVLREIEELHRRTIEENKEVLDKIREDYKRVIDDVRTKDTPNVEKLLKDLEKSAKENEEHNERTLREDDRVLKEIRRRATELLKANEEMLRRIEEVMRAGKVDAEELLRESKEAIKEVKRVLEELRKESKRVVDETRKLSEENLEHSERVLRKVEEDLR

SEQ ID NO: 19740 - protein, 180 aa, Artificial Sequence; identical to SEQ ID NO: 19739
  Synthetic sequence.

SEQ ID NO: 19741 - protein, 180 aa, Artificial Sequence
  Synthetic sequence.
DEDKVLRKVKKLVEDIRREIERILREAERLHKELTRRNEEVLERIRRLVDKVIKEIRKADTPDVDRLIKEVRDALRRLEEHNRETLRENETVADEIRKKVEELLKRVEEVLETIRKVIEEGKRDLRELLERVERVIREVRRDLKRLLDESRDVVRRVEERSRRNLEEVKRDIERVKRELD

SEQ ID NO: 19742 - protein, 180 aa, Artificial Sequence; identical to SEQ ID NO: 19741
  Synthetic sequence.

SEQ ID NO: 19743 - protein, 180 aa, Artificial Sequence
  Synthetic sequence.
SKEEVLREIERLHKETIRRIEEVLREATELHKRLTETNKRVLEDLEREAREVIEDVRRADTPNVEELLRELKDALDKVRDHNRKTLKKNEDVVREIEKEVRELLKEDEDVLRRIEKVMRDGRVDARELLEESRREVERSEKEVERLLRKSRKVVEEVRKLSEENDREVKKILEEVKRRLD

SEQ ID NO: 19744 - protein, 180 aa, Artificial Sequence; identical to SEQ ID NO: 19743
  Synthetic sequence.

SEQ ID NO: 19745 - protein, 180 aa, Artificial Sequence
  Synthetic sequence.
SKEEVLDEMRRLHETTKRDIRRVLKEIEELHERTLRENKRVLEEIKELVRRVIEDIKRKKTPDVEKLVRRVEEMLKELEKHNKKTTDDDKRVLDEIRRRADELVKEDERVLREIEEVVRAGKVDLKELLDESRRVVKESKEDLDRLLKESRDVVDDTRRKSEKNLRDAERVIREAEEAVR

SEQ ID NO: 19746 - protein, 180 aa, Artificial Sequence; identical to SEQ ID NO: 19745
  Synthetic sequence.

SEQ ID NO: 19747 - protein, 180 aa, Artificial Sequence
  Synthetic sequence.
DRERVLREMERLVRELLRENREVLDEIRKLHERTVRRNRELAKRLEEEAKEVIDRIEKTKTPNVEELLEKVRRALERVKRHNEKTTRDDERVLRELEKHNEETTRELKEILDRILERVRDGKVDVKKLLEEARDVIRRAKEKSKRNLDESRRVVKETDDLSEKNREDVRKIIKEVEEELK

SEQ ID NO: 19748 - protein, 180 aa, Artificial Sequence; identical to SEQ ID NO: 19747
  Synthetic sequence.

SEQ ID NO: 19749 - protein, 180 aa, Artificial Sequence
  Synthetic sequence.
DVEEVLREIEELHRRTIERIKKVAKKVREDVKRVLDENKKVLDELRRRVEEVIEKIKKADTPNVEELLKTVEKMLEDVKRHNEETTRRAADILRKIEDKARKLLEEDERVLREIEKVARDGRVDMRELKKRSDDVVRESEKELRRLEDEIRKVIEDLKKLSEDNEREVEKVIRKVEEDLR

SEQ ID NO: 19750 - protein, 180 aa, Artificial Sequence; identical to SEQ ID NO: 19749
  Synthetic sequence.

SEQ ID NO: 19751 - protein, 184 aa, Artificial Sequence
  Synthetic sequence.
DMERIVDTLRKLNTDSNRRSKEAIDRLRKTNKDSLDKVEEVLREAERLAEDVLRKVEEKVTSEKLERIRREIERVVEEVRKRIEEIKRKIKESLRRVDKLITENSKKNKDSLDRVEDIIRKVGSKKEVLKKLLEEVKDSNRRSEEDVRRMEEEVKRSNDELLKELKEILDKVREAIKKLEEKVK

SEQ ID NO: 19752 - protein, 184 aa, Artificial Sequence; identical to SEQ ID NO: 19751
  Synthetic sequence.

SEQ ID NO: 19753 - protein, 184 aa, Artificial Sequence
  Synthetic sequence.
SAEDIIRRLRDLNRRSNKKSRDVAEKLRRDNKRTLEKVERKARELKKLAEEVVKEVRDKVTSEKLRRIEKEIRDVVDRVRRLIEEIAREIERSLEEVKRLIKENERKNEESLRRVDDIIKKVGDLEEVLRRMLKEVEDSNRDSDRDVRRIEEEVRRLNEELDKKLEDLEREVRRMIEEIRRKVK

SEQ ID NO: 19754 - protein, 184 aa, Artificial Sequence; identical to SEQ ID NO: 19753
  Synthetic sequence.

SEQ ID NO: 19755 - protein, 178 aa, Artificial Sequence
  Synthetic sequence.
SELEEVKERVERVLKRIRDLTRELEDRVDKILEKSKRTLDELEKRVREVIARIKELVKRLKDDRRAVKEILDEIREMLKDLEKKARDNLKEVEDRRKELEKLSRDSIKEVEEVLKELRDKVRSEVLKRLEELAREVIEEDKRALERLDRKIRRVLDESRDVLRKIRKLIEDVLREVEK

SEQ ID NO: 19756 - protein, 178 aa, Artificial Sequence; identical to SEQ ID NO: 19755
  Synthetic sequence.

SEQ ID NO: 19757 - protein, 178 aa, Artificial Sequence
  Synthetic sequence.
SESETIEKEADEMLKRSKKTLEELRKTVKRILERIEKLTRDLEKTAEDIIRKIEDDLRRLKDDERVVDEIIERIKKELRKLEERSRESLRDIKRVLDELRRRMEENLKRVEEILKRLEERVRSEVAKRISEKIRRVLEDSRRVLEELEDLIRRVLERDKRALERIKEDIDRIIRRVRT

SEQ ID NO: 19758 - protein, 178 aa, Artificial Sequence; identical to SEQ ID NO: 19757
  Synthetic sequence.

SEQ ID NO: 19759 - protein, 177 aa, Artificial Sequence
  Synthetic sequence.
SELEAVLDELRKLVKELEDRLRKVNEESRRLIKELLDRLREVDERSRKLIKDLAEKARRRGVDEKLLDELRRRLEEHNKENRKLEERIRKLLEEHNRENRKITKELRDLLKELEELLDEVDTDELRKRVRDLVRRVDELIKRSKRHAEELTREVEEKVRESEEHVRRLVKEVEDRIR

SEQ ID NO: 19760 - protein, 177 aa, Artificial Sequence; identical to SEQ ID NO: 19759
  Synthetic sequence.

SEQ ID NO: 19761 - protein, 171 aa, Artificial Sequence
  Synthetic sequence.
DEVEEADKRVEDEVRRLKRLVEEHTKRVEDKVRTLKKLVKEHTDEVRRAVEELKRRRDDEESVRRKIEEIKRRSDKIRRDVERKIEEVYRDSERELRRIKKEIEDVLREMKRRDIDEDVLRKVKELLEDVARLVEESHEEARKLLKEVEDRLRESVREVEELLRDVERRTR

SEQ ID NO: 19762 - protein, 171 aa, Artificial Sequence; identical to SEQ ID NO: 19761
  Synthetic sequence.

SEQ ID NO: 19763 - protein, 174 aa, Artificial Sequence
  Synthetic sequence.
DEVEKVKEEIRRIVKELEDRVEEHKKEAKKIIDELRRLVKRHREEVEEIVKKLEELVRRNSPREEIEKELDKVRRRSDELHKDAKKKLDEVREDSKRMAEEIKRTLEKVRDELRRKISNEEVLKEAEKLLEDVERKLRKSHEDLERLLKEVEEAVRDSNEEVRERLDRVREKMR

SEQ ID NO: 19764 - protein, 174 aa, Artificial Sequence; identical to SEQ ID NO: 19763
  Synthetic sequence.

SEQ ID NO: 19765 - protein, 174 aa, Artificial Sequence
  Synthetic sequence.
DEDRKVEEDIRRIVKRLREIVEKHNREAREIIKRLRDEVRKHRDKARKIVTRLDELIKRNTPEEEAKKEVDDVRRRSKEEHDRFDKELKEVRERSKEMADKIKEDLDRVRDELRRKIKNKDVLKEAEELLEKVKRDLDRSHEELEELLKRVREELEDSNRELEKLIEEVERKVR

SEQ ID NO: 19766 - protein, 174 aa, Artificial Sequence; identical to SEQ ID NO: 19765
  Synthetic sequence.

SEQ ID NO: 19767 - protein, 174 aa, Artificial Sequence
  Synthetic sequence.
SEVEDVDDRIRKIIKKLEDLVRKHNEDARRIIDELRELVERHNRRAREIVRELEDLVRRNKPRERIEEKLREVKKESEDVLKEAEDRLREVRKRSREVHEEARRRLEDVRKKLEERIDSEEVLKKVEKLLKEVLDLMKESNEELEKLLEEVKREMEESVKELKKLLDEVREKVK

SEQ ID NO: 19768 - protein, 174 aa, Artificial Sequence; identical to SEQ ID NO: 19767
  Synthetic sequence.

SEQ ID NO: 19769 - protein, 179 aa, Artificial Sequence
  Synthetic sequence.
KEIEDVLEKVRKVVTDLKKKLEDVNRESEKLVREVVKELKRVDDESRKLVERVEKEADEKGVDETLKRKLREYLKEHHKRNKKIIDDLKKYLDEHHDKNRRIIEELDRLLKEMEEIIRRNELSEEELDRRIKELKDRADKLIKDSKDNVEELRKKAEELIRRSRKNVEDLVRKATEDVR

SEQ ID NO: 19770 - protein, 179 aa, Artificial Sequence; identical to SEQ ID NO: 19769
  Synthetic sequence.

SEQ ID NO: 19771 - protein, 179 aa, Artificial Sequence
  Synthetic sequence.
RELEEVLKKVEDLHRDVMKKIDDVVREASELHKKVKEDIDEVVKRAEDVLRRVKRELDKRGGIEEVKRRLDKVLKDLRKEVEDIKRKLDEDNKTLRKKAKEIKDELKENLKRLEDVVRRGDLDKDELDEHIERSLRKVTELVKDLKEHIERSLEEAKELVRRLEELIEELLRRLAEEVR

SEQ ID NO: 19772 - protein, 179 aa, Artificial Sequence; identical to SEQ ID NO: 19771
  Synthetic sequence.

SEQ ID NO: 19773 - protein, 177 aa, Artificial Sequence
  Synthetic sequence.
SEVEEVLREAEELLKEVRDRLRESVEKSKRLLDEVRRKIEESHRRHKELSDEIRRLAEERNLDKTLEEKIKKVNDENRRRLRELERTLEEVLERNKETVRRLEDELRKVLERLRRLAKDVDIEELRKEIKKKIDEMRRLVKEDTERLERVAEELRRRVEEDKERSKDVVRRLREDVK

SEQ ID NO: 19774 - protein, 177 aa, Artificial Sequence; identical to SEQ ID NO: 19773
  Synthetic sequence.

SEQ ID NO: 19775 - protein, 177 aa, Artificial Sequence
  Synthetic sequence.
SEVEEVLKRAEELLDDVRRLLERSHRETERLLDEVRKRVEDSHREHRKLSDEVRRKAEERNLPEELDERLKTVNEENKKLIEEIKDRLDRVREEDEKSLKELKDKLDEVRDRLERLKKDVDIEELRKDIERAVKELRERVEENTRRVEELVRRLRELVEEDRKRSKEVADEMDERVR

SEQ ID NO: 19776 - protein, 177 aa, Artificial Sequence; identical to SEQ ID NO: 19775
  Synthetic sequence.

SEQ ID NO: 19777 - protein, 177 aa, Artificial Sequence
  Synthetic sequence.
KEVEEVLDTAKKLLDEVRRELERSHEEHKRLSDEIRERLERSHEETERLLKEVKEEVDDKNVEEELKKKLDEIRKEDEETLRELEERLKRADDKNEKIVRELEKRLRDVEEELRKLMKDVDIEELKRRIDDMVRRLRELVERDRRESKKVADDLRRLVKENTERAREKIEELRKDVE

SEQ ID NO: 19778 - protein, 177 aa, Artificial Sequence; identical to SEQ ID NO: 19777
  Synthetic sequence.

SEQ ID NO: 19779 - protein, 177 aa, Artificial Sequence
  Synthetic sequence.
SEIEEVLKEAEKLLREVEKELRRSHEELKRLLKEVRDKVRRSMEESERLLEEIKKKADERNLEDELRKRLEKVLRDNRETIRRIEEAIKRVEEENRKTIRDIERTLREVLERLKELKDRVDIEELKRRIEDAARKLEKLVKDDRERIERKVRELERLVEEDKKRLRDRVRKMDEDVR

SEQ ID NO: 19780 - protein, 177 aa, Artificial Sequence; identical to SEQ ID NO: 19779
  Synthetic sequence.

SEQ ID NO: 19781 - protein, 174 aa, Artificial Sequence
  Synthetic sequence.
REVEEIVKKVRKEVTRLLREVEEDMKRNRDTIRELLKYVKKDLEENKDIIRRLLELIRRDGSTKELRKTLEDKLKESEDNLRRVAEELREKEERSKRNLDRIEREARERVKRLEEEGVSEEARKDIERLLEEVRTKLRENEEDLRRLVKEVDRELKRNRDELERLAKEVRDELK

SEQ ID NO: 19782 - protein, 174 aa, Artificial Sequence; identical to SEQ ID NO: 19781
  Synthetic sequence.

SEQ ID NO: 19783 - protein, 174 aa, Artificial Sequence
  Synthetic sequence.
SEAEEIAKEVEKRIRELLDRVRRMVEESEKYARDSLRKIKRLLDEVRRRIEELLRKIRRDGPTEELRKELERIKEEIDELLKKIRKENEDAHRRSKELIDRMKEELDKIKEEIDRKNLPSEVAKKVKELLDEVERILREWEKEDRRLLKESEDLLREVEKEVRKLLRRVEEELK

SEQ ID NO: 19784 - protein, 174 aa, Artificial Sequence; identical to SEQ ID NO: 19783
  Synthetic sequence.

SEQ ID NO: 19785 - protein, 174 aa, Artificial Sequence
  Synthetic sequence.
SESEKILEEAKRRIRKLLEDVKEMVKRSRDYARESLKRIKDLVEESKREIDKLLEEIKRSGPTEELEKRLREINRRSRELVKKIREENERLHRRSKELVKEMEDRLREIEEEIRKKGLPSEVEEDLKRLLEEVKRELKRWEEDDKRLLDDSERALKEWEDTDRRLLKRVEDELR

SEQ ID NO: 19786 - protein, 174 aa, Artificial Sequence; identical to SEQ ID NO: 19785
  Synthetic sequence.

SEQ ID NO: 19787 - protein, 174 aa, Artificial Sequence
  Synthetic sequence.
SEVEEIVKDAERYIKESLDRIRKAVEESRRRITELLKEVERLLREVRKRIKELLDEIRRDGPTDELRRKLEKIEREIKKRLDDLRRELEEIHKRSDELVRRMEEENKKAEEEIRRRGLGSDAERKLEELLEESRELLKRWRDDDKRLVDDVRRKLKEVEEEVRKLLKEVEDELR

SEQ ID NO: 19788 - protein, 174 aa, Artificial Sequence; identical to SEQ ID NO: 19787
  Synthetic sequence.

SEQ ID NO: 19789 - protein, 174 aa, Artificial Sequence
  Synthetic sequence.
SEVEEIVKEAKRRIDELLKKVDELLKESERYARKSLKDNKDMVRRSEERIRELLEKIKRDGPDDKIREELKKINKESEDLIRKNKEDNERFHKKTEDMLKRLKEELDEIEERIRRKGLGSEAEKRLKDLLDRVKEKLDEVRRRDRELLEESKDLSRRWKERDDRLLEEVEKALK

SEQ ID NO: 19790 - protein, 174 aa, Artificial Sequence; identical to SEQ ID NO: 19789
  Synthetic sequence.

SEQ ID NO: 19791 - protein, 176 aa, Artificial Sequence
  Synthetic sequence.
REIEKIREDLERLLEEVKRAAEEWRRRDEELVRKLEELIKRVLDEDRRLLRELRDKGKGERLKEIERRSEESRRRLKRLLEEIRRLSKRSKEELDEALKRVEEEVRRIEDKLRKVRGREVIKKVLEEIRDKIRKILKTIEDLVRKSEDLIRRVLEEIERILDESRRDVEEVKRREE

SEQ ID NO: 19792 - protein, 176 aa, Artificial Sequence; identical to SEQ ID NO: 19791
  Synthetic sequence.

SEQ ID NO: 19793 - protein, 174 aa, Artificial Sequence
  Synthetic sequence.
DEDRRVKTEIKKLLEELTRRSREVEEDDRRLLDELTRETERIEEDLRRLLEEVRRSGVPEDKLREIEREIRELRKRLEDLNKEIKDLSEKTRKELRDLNRRLKEIVDRLKERIDKEGATDEIEREVRKVEEDYRRSLRRVLEESRKIAERYKKKLDEMREEVRRRAKKVKDEVR

SEQ ID NO: 19794 - protein, 174 aa, Artificial Sequence; identical to SEQ ID NO: 19793
  Synthetic sequence.

SEQ ID NO: 19795 - protein, 177 aa, Artificial Sequence
  Synthetic sequence.
KSVEKIVEDIKRVADKILEDIKRSEDRVREIVDRHRREIDKVVKEIVKRVEDLKRNNIPREEAERVLRDVERKVEEINRRMEEHLRKLEEEVKRSHDEIRRKLEELEKRVRDIKKDVDKDEMEDLKRRVDELKKEIERALKEHKDKVKKLLDDLRRLNEELRREVRRVLEEVRETTR

SEQ ID NO: 19796 - protein, 177 aa, Artificial Sequence; identical to SEQ ID NO: 19795
  Synthetic sequence.

SEQ ID NO: 19797 - protein, 191 aa, Artificial Sequence
  Synthetic sequence.
DEIERVEEALKKVEKDLRRLIRELEKLNDKIERDIRRLHEETNKRLKEVREKVEDMIRRVSARAPEEDLRRLKEEIDKLVRELEKKDRDLAKENERKIRELRKHLEELLREAEREIKRIEDKVREAKKRGEDRRVVKKLLDEIEEILRRLKKLVDDHARESKRILRESERKVEALLEEIEEILKRLEEKVK

SEQ ID NO: 19798 - protein, 191 aa, Artificial Sequence; identical to SEQ ID NO: 19797
  Synthetic sequence.

SEQ ID NO: 19799 - protein, 180 aa, Artificial Sequence
  Synthetic sequence.
DEIERVLREIDELRKKVEKVIEDSRRNAKRWLDRVKRTAEELNKLSDELLEEVTRLAEAGIPEEKVKELRDRLEELDRRSKEKIKKLKRDLERNLRETERTIEELKRELERLVEKIRREIDSRAMEEVRKTAEEVIKTVDKLLKELRKTYEDILRDIDRLLKEHHARNRRVLEEVERLTQ

SEQ ID NO: 19800 - protein, 180 aa, Artificial Sequence; identical to SEQ ID NO: 19799
  Synthetic sequence.

SEQ ID NO: 19801 - protein, 171 aa, Artificial Sequence
  Synthetic sequence.
SEREEVKKRLDDVRREAKRLLDEVRKRLEESHRKHKKLLDEVRKRLKEVEEEAKRRGVSEDLERELKRLLDELDKKLKESLRENEKTIRDIEESLKTVLKKLEDLVKKLRDDNVRKEKVTKIIEDLKRELEEMFRKLKRLVEEDDRRSKESLEEVRKLVEDARRKIEEDTR

SEQ ID NO: 19802 - protein, 171 aa, Artificial Sequence; identical to SEQ ID NO: 19801
  Synthetic sequence.

SEQ ID NO: 19803 - protein, 181 aa, Artificial Sequence
  Synthetic sequence.
SSIEKLKKVVEDIKRRSEDLNRELEKVVRDVKKRSEELNEELRKVSEEIERRLRELLKRISDEKKLRDAARLIDELRKNSERVSRENEELVRRLKKKVDDVSRKNKEIVKDLERRVDEVRKRGPAEERFVEELRRALKKDEDDMRRVVEDIERLLEEDERRMKKAVEDHRRLLEELEERAK

SEQ ID NO: 19804 - protein, 181 aa, Artificial Sequence; identical to SEQ ID NO: 19803
  Synthetic sequence.

SEQ ID NO: 19805 - protein, 174 aa, Artificial Sequence
  Synthetic sequence.
DESEELKKVLKEIEDEVRRLIREIERVLEEIERRDRELLKRDEETLKRIEEEVRKLRLSEELKKEAKKRLDESRRRLRELHEESKKRLDDIRERLERLLRELEKRLTEVDKRIKREGAREEIIEELRRILKEAEDVIRRIIEEVRDVLRESEKRVRESIDENRKILEELRRRAK

SEQ ID NO: 19806 - protein, 174 aa, Artificial Sequence; identical to SEQ ID NO: 19805
  Synthetic sequence.

SEQ ID NO: 19807 - protein, 170 aa, Artificial Sequence
  Synthetic sequence.
DEEDRLRRELEKVRRDADRLLEEIRRVLEEVERRSKELLKRDEDSLREIVRTVTEETKRDEIKREVDKIAEDTRDHLRKHEEKTRRIKEEVKELLKRLKDKVDKVRKEVEAKKVTDEVLEEIRRILEELRKEAEDIIRRIRELLRELEKNVTDSIRRNEEMLKELRRKVK

SEQ ID NO: 19808 - protein, 170 aa, Artificial Sequence; identical to SEQ ID NO: 19807
  Synthetic sequence.

SEQ ID NO: 19809 - protein, 180 aa, Artificial Sequence
  Synthetic sequence.
SEAEKILEDMKRYIEEHIERVKRSLEENKKKDRELIEKSRKSLEDARKKIRELLELVRQRKTSEDVLRKSIRELEEDLKKHEEDSERDKRRLEEDHKRHEDESKKSLDDLERRLEEVERRGLVSEEILKRIRDLVKELEERDRRVIEEMKKSNKRTEDTDREVLERIRRLVERLADEARK

SEQ ID NO: 19810 - protein, 180 aa, Artificial Sequence; identical to SEQ ID NO: 19809
  Synthetic sequence.

SEQ ID NO: 19811 - protein, 185 aa, Artificial Sequence
  Synthetic sequence.
SELERVIEEIKRLLERLKRENEEVKKRVKKLLDELRKINKDVEDTVRELLKRVKELVDRANLDEKSRRDLEKKREETKRELEEIKKKSDKNLTDLKRELEKIMEDSKRDIEKIERETKKLEEDRLGKDEIEEALRRVEEHIKRHLKTVKELAEKAERHIREHLKEVKRMLEKAKRTIDELLKKIK

SEQ ID NO: 19812 - protein, 185 aa, Artificial Sequence; identical to SEQ ID NO: 19811
  Synthetic sequence.

SEQ ID NO: 19813 - protein, 175 aa, Artificial Sequence
  Synthetic sequence.
SLREAAKEVLERVRREVEKLRKSNEEVLTRVREEVKKLLETNKDVLRRVAEILKTANVDKRIADRVRDELRRYEERLKEEADRIRKMLEDYERESRELRERIERTIKALEDRVEKKGEVSEEDIREIEDILRKIAETVETLNRRLEDILREIRKSSKKTIDELREKAKELEDRTR

SEQ ID NO: 19814 - protein, 175 aa, Artificial Sequence; identical to SEQ ID NO: 19813
  Synthetic sequence.

SEQ ID NO: 19815 - protein, 182 aa, Artificial Sequence
  Synthetic sequence.
SEVDEDLKDIKRYLDEHRKRVEEVVKRLEDRSRETAREVEEDVKRIERKVEEAKKEADERGNRKERLEELRKELKKERDDLRKRNEDDRRDLDRERKRLEKELEDSRRKLDKKEDELRKKNLDEDAKRRIEEVLERVRRELERSEEKLRRVLEKHREDNDRLEEELDRVLRELEKILDEVAT

SEQ ID NO: 19816 - protein, 182 aa, Artificial Sequence; identical to SEQ ID NO: 19815
  Synthetic sequence.

SEQ ID NO: 19817 - protein, 182 aa, Artificial Sequence
  Synthetic sequence.
DEVRKILKELKELVKRIEDKLRKYLEDVRREVERIEEEVRRNLERIKRLAEEIERRVRRDGKSKELAEEVKRKLTENEKEDRKRERDVREKNKEDKRRLEEEMKKVEETLKRKEDDVRRRNLSEDVKRKIDKVLDEVRRLLEDIKRRVEKINTDTERLLKKLAEDSKRALEEVKETLERAER

SEQ ID NO: 19818 - protein, 182 aa, Artificial Sequence; identical to SEQ ID NO: 19817
  Synthetic sequence.

SEQ ID NO: 19819 - protein, 179 aa, Artificial Sequence
  Synthetic sequence.
ELRERIKRALDEHRRVSEELERRVREANKRHNEVSKEVKDDLKRSHDELRESLERIKRRGDLSEEMEKKLRERLERSKREIEKKEKENRDEHEKSRKKVEDKKRDNERRVKEMEDKIEKDGRVEEEDLKRIREETERLKEDVRRYLRELEKLSRDLRRKVEELLKDNKRKVKEIEDEAK

SEQ ID NO: 19820 - protein, 179 aa, Artificial Sequence; identical to SEQ ID NO: 19819
  Synthetic sequence.

SEQ ID NO: 19821 - protein, 182 aa, Artificial Sequence
  Synthetic sequence.
DELETLEERIRRSVERVRRELKRYKEEMDKHSEDLKRLVDKNLEDVRRELEEIRKLATDGRFDEDVERTVEKRLKDNEDRDRERSRKVEDDNRRSREELEKLKKESDEELERTKKEVEERNLDEDMEKKLRELLERHERENKKAREDVEEANRRNEEVLKDIERRSKKALDDVRRELERVRK

SEQ ID NO: 19822 - protein, 182 aa, Artificial Sequence; identical to SEQ ID NO: 19821
  Synthetic sequence.

SEQ ID NO: 19823 - protein, 178 aa, Artificial Sequence
  Synthetic sequence.
SLKEVLDKIEEDHRRMSKRNEEVLEEVKRRAEKLLKDAEEVLRRVRERIEELIRRVEETKGRTERLRELEERIRKRDEEIERKLRKELERLKERLRRYRERTKELNKKFEEDLRELRKKGVDVKELKKRADESRKTVERLSRELKKELRKVEEDVKREVEKIEEDLKRIARRVREESR

SEQ ID NO: 19824 - protein, 178 aa, Artificial Sequence; identical to SEQ ID NO: 19823
  Synthetic sequence.

SEQ ID NO: 19825 - protein, 180 aa, Artificial Sequence
  Synthetic sequence.
SELERLLEEVERLLEKLERDNKRLLDDVRRLLERLRRDNERLLEKNKRLLDRLREEVSRVSDEKFLREVEKKLRDNEREAERVAEESEKHLRDVKKRLDELLETSERNLREVRERLERVRRDEDIEKLAREVKRHIERHKEELDRLRKEVEKNARKHEEDLRRLEERSKKHVEDIERETR

SEQ ID NO: 19826 - protein, 180 aa, Artificial Sequence; identical to SEQ ID NO: 19825
  Synthetic sequence.

SEQ ID NO: 19827 - protein, 180 aa, Artificial Sequence
  Synthetic sequence.
SELEKLLEDVKRLLDELRERNEKVLEDARRLLEELRKRNEDLLRRNRELLERLEREVSKVEREEVLDRVRRELEKNERRVDELRRESEKHLREVKEELDRLKEKSETNLRDAERELTELKDDEDIDRVRRRVERHIREHERDLREVKKRIEEDAKRHRDRLKKLEEDSREHVKRMEDRTR

SEQ ID NO: 19828 - protein, 180 aa, Artificial Sequence; identical to SEQ ID NO: 19827
  Synthetic sequence.

SEQ ID NO: 19829 - protein, 182 aa, Artificial Sequence
  Synthetic sequence.
KLEELAKELRRLLEELRKRSKEVIDRLRRLNEELRKTSEEVIRRLRELNRRLTEKARRRLKDEGEKLKEAEKLSEDHRRKVEELLKKSEEDSRRHREKLEELERRSREDLRRLREEIERVLKDRDIKEEVLRKVREEVKEHERRLEDALRRSKKEIDDHKRELEELLKENAEEVRRVEERIR

SEQ ID NO: 19830 - protein, 182 aa, Artificial Sequence; identical to SEQ ID NO: 19829
  Synthetic sequence.

SEQ ID NO: 19831 - protein, 182 aa, Artificial Sequence
  Synthetic sequence.
KAEELVRELKRLLDKLREESKKVIEELKRRLDEVAKKSEDVVEEMRRLLEELKEKIERRLKDKGEDLKRAEEKLKDIEREIDKLEKESRKNLEDIKRDLERLLKESEDDLKRLEDEIDTVRKDGNIREEVLRDVRRKVEDHRRKLDEIRKRVTDEARRHERELEKALEKIRRDIRRIEEELR

SEQ ID NO: 19832 - protein, 182 aa, Artificial Sequence; identical to SEQ ID NO: 19831
  Synthetic sequence.

SEQ ID NO: 19833 - protein, 182 aa, Artificial Sequence
  Synthetic sequence.
KVEDLLREAKALLDELKRESERIIKELRKLNDDLTKKSEEVIRELEKLLRDLKKIVDERLKDRGKDLEEVRRRLEEIKKEIDDALEKSRRNSEKHRREVEEVLERSERDLERIREELERLAKKGDIKEEALKKVRKEVEDHKRRLKEAVDRNRKKIKDHEEELERTLRDIRRKIDKERRELE

SEQ ID NO: 19834 - protein, 182 aa, Artificial Sequence; identical to SEQ ID NO: 19833
  Synthetic sequence.

SEQ ID NO: 19835 - protein, 176 aa, Artificial Sequence
  Synthetic sequence.
EELERLLKRVRDESKKNRDKVREDLERSRRKSKRHEDELRRLLKEARDDIDRVRDLRRKNSQRREDLKRILDTLREKLKKMMEDSERDLRRWEEENRKLNKESKEELDRLKEEIDKSPIGEEVVKEAEKILDDNRKENERVSEEDKELLERNKKKAEDVLRELEELIRKLAEELKK

SEQ ID NO: 19836 - protein, 176 aa, Artificial Sequence; identical to SEQ ID NO: 19835
  Synthetic sequence.

SEQ ID NO: 19837 - protein, 179 aa, Artificial Sequence
  Synthetic sequence.
SELEELLKRIRDKSKENEDEVRTDLKRVRDYARRHEERLRELLERVRDELRKAEELRRAGEVSEKVVKEIVDKLRKMIEEIKREVDESKKRLDDDLRKIADTSRRKAEELKKDLDKVRTDGADERVLEEIERIMRENKRRNEEVIKEIKELIDRLRRKSERVIEEIKKRIDELRDKARR

SEQ ID NO: 19838 - protein, 179 aa, Artificial Sequence; identical to SEQ ID NO: 19837
  Synthetic sequence.

SEQ ID NO: 19839 - protein, 179 aa, Artificial Sequence
  Synthetic sequence.
EEEREIEERLRKKIEEIRREDKRHHDEVRRKVKEIKEEDREHHERVKRKAEEVKKRIETTGPRREEVEKIEREVEKNSRDHKRRLDEIRRELEKDSEDHKRRVKEIEDDIKRDLDEIRRKVKDDKDVLRELKRLLDELRESARKNNEDLKRLLEELEESVKRNNDELKKLLDELKERAR

SEQ ID NO: 19840 - protein, 179 aa, Artificial Sequence; identical to SEQ ID NO: 19839
  Synthetic sequence.

SEQ ID NO: 19841 - protein, 186 aa, Artificial Sequence
  Synthetic sequence.
RELEELAERVKRLLERDEELLRRLKDAVRRLSEKDRRLLERLAREVKRLLDELRDLVRKRLKDKREDLERVEKMLREIKRDLEDHKRRVEETNRRLEEEVRKHEEEVKKDNDDIRKELREIEERKLDKELLERVITELERKARESEKKHEDSLRELERLARESEERHKRSLEEVERKIEEIKRDLD

SEQ ID NO: 19842 - protein, 186 aa, Artificial Sequence; identical to SEQ ID NO: 19841
  Synthetic sequence.

SEQ ID NO: 19843 - protein, 178 aa, Artificial Sequence
  Synthetic sequence.
RELEKLEDEIRRELRRIEKELKDYERELEERADKDRRDIEDYRRRLEERVKEIEDRLRRDGSDEEELRRIREESRKTLEELKRHLDKSRKESEDTLRRLEKRLRDIEKRAEEIKRELDRAGVSEELRKILEDALKRVREEVKRILDRNRELLRESEELVRRVLKRNRDLLREVDERVR

SEQ ID NO: 19844 - protein, 178 aa, Artificial Sequence; identical to SEQ ID NO: 19843
  Synthetic sequence.

SEQ ID NO: 19845 - protein, 182 aa, Artificial Sequence
  Synthetic sequence.
DKVREALKRLKDKMETYERRSKKHIEDHKRKLKEYEERVRRNIKRLREELKKLEEDAKTRGPREKDVTEILKRIEDHLEEHHRRSEEVKRDLERNLEEAHKDSRRVLEELKKELEKIRRGDLSEELLKRVDELARRIMKRIKELNRENERVVRESLKRVDELNKRSEKVHKEVLDRLEELRR

SEQ ID NO: 19846 - protein, 182 aa, Artificial Sequence; identical to SEQ ID NO: 19845
  Synthetic sequence.

SEQ ID NO: 19847 - protein, 178 aa, Artificial Sequence
  Synthetic sequence.
SLKEELEKLVRDIIRDNRRLLEENEELVRRSEESNKRLLEENEETARRIKAELERAGIPEEELKELVKRLEEELRRIKEEADRLDEKHKDDLRRIREEAKKIDDELKKELDEIKRKDDSEKLVEEVKRKLKRKLEEIRREHRRTKEEIKKTNEDIKRRHDETLRRLEKTLEDIKERTR

SEQ ID NO: 19848 - protein, 178 aa, Artificial Sequence; identical to SEQ ID NO: 19847
  Synthetic sequence.

SEQ ID NO: 19849 - protein, 182 aa, Artificial Sequence
  Synthetic sequence.
SEVEKILEELKREVREHERRVEKLVRELEDYVRRHREKVKRIEERLRDKLREIEELVKEGRLDDSEVERLKREVEDEARRLEEEHEKSLRRIEEKLREIEKDHKRSKEELDKRLEDIRRRGLPEKAVREIETLADEIRERIERSLKRIRDLIREIKEDLRRSLERIREIIREIKKAIDDRRK

SEQ ID NO: 19850 - protein, 182 aa, Artificial Sequence; identical to SEQ ID NO: 19849
  Synthetic sequence.

SEQ ID NO: 19851 - protein, 182 aa, Artificial Sequence
  Synthetic sequence.
SEVEKILKEIRDENERLKKEIEEILRELERKLREHRREVEEVLKRIREKIETLKDESRREDRGSERVDKVRRELEETLKRIKERHDESRKELREKSERIKRRIEEYKERNDRKLEEIERANLPEEMLREMERISREDRETLKRLTDRIREMIRRLEEEIKRSEREAREIIKEAKKVLEDEAT

SEQ ID NO: 19852 - protein, 182 aa, Artificial Sequence; identical to SEQ ID NO: 19851
  Synthetic sequence.

SEQ ID NO: 19853 - protein, 179 aa, Artificial Sequence
  Synthetic sequence.
SRVEELIKDLRRSTKELEDRVRKLLEELKDKTRRTEKRNREKLEKLKEELRKLEEDVKREGPRETDLDERVKELEKAAEDSKRELDENLERVTREIEKIKREIDKYRKDSERRIEEIRKSGDDDEKVRKVMEDDRRKLKKILDDVEDVLRKHKKVLEDLKRTNDDVLREARKLAEKIRR

SEQ ID NO: 19854 - protein, 179 aa, Artificial Sequence; identical to SEQ ID NO: 19853
  Synthetic sequence.

SEQ ID NO: 19855 - protein, 181 aa, Artificial Sequence
  Synthetic sequence.
SAEERLKEALKRLDDVSKRSEEEIRRMIKRIERISRESLKRLKDLNRRIKELVERIERRLKVDDELRRLRKRVEKLNRDSEETAEREREDNERMIRELEKRLREEKEDNKRFLKELEERLRRGPVDERLLEEIKRYIDEHKRRLDELRKDIERYLEEHKERLRELEKRHEELLRTLDREAK

SEQ ID NO: 19856 - protein, 181 aa, Artificial Sequence; identical to SEQ ID NO: 19855
  Synthetic sequence.

SEQ ID NO: 19857 - protein, 185 aa, Artificial Sequence
  Synthetic sequence.
SAEEDLDRMRKKVEDVIREDKERVRKLLERAKEVIRESEKKHEDLRRRIRKVIKEIRERTNGSSDELRKIEDLLRRLEKHVDDSEREVKKNEEEIREEVERHLKRSEDNAEEIRKEIEEVERRKVSDTDLERELRRIDKHLRDHKDEARKSEERVEDHLRRHRERVRRNEEDVEDKLKKLKDETK

SEQ ID NO: 19858 - protein, 185 aa, Artificial Sequence; identical to SEQ ID NO: 19857
  Synthetic sequence.

SEQ ID NO: 19859 - protein, 175 aa, Artificial Sequence
  Synthetic sequence.
REEEELKRRNKDHNRRHREDTKRIAEDVDRKLREWKKKSDEAREEVKRLLERLKELADRNEVEEREVERLLKELRDRVKELKEESDRDLERLRRTVEELLKKLDKNLKESEDELRKKPESEDLRRLMKENRETIRESAEILERLRERVEDLVRRDREILEKLLRDIEELAERIKR

SEQ ID NO: 19860 - protein, 175 aa, Artificial Sequence; identical to SEQ ID NO: 19859
  Synthetic sequence.

SEQ ID NO: 19861 - protein, 184 aa, Artificial Sequence
  Synthetic sequence.
SVEDELRKLEERLKRIADELRRLVEKNIEDNKESLKEIEKLIRENIERNKEVLKRIAERGKREDELRDIERKIRESIEKLKDLLRRAEEKVRRSIRRLEKILKELKEKVDKLKEELKDLTDKRLDKDELKKALDDVDKKLEDLRREVEDRDRKNEEDNRRLRKELEERSRENKEFLDKLAREAD

SEQ ID NO: 19862 - protein, 184 aa, Artificial Sequence; identical to SEQ ID NO: 19861
  Synthetic sequence.

SEQ ID NO: 19863 - protein, 175 aa, Artificial Sequence
  Synthetic sequence.
SEKDESARDIEEKLERHLRKSDESRRRNEKRIKEHRDRSDESRKKFETDLKRIEDEVRKRGPNRDELDELLKRLKDELDDHRRRTEKSARESKKHLDEHRKRTEDSLRTFEEELKKLEPDEKLKDLERKVREVIDRDRDILRRLEEEHRKVITEDEEILKRLEEKAREAIERIRR

SEQ ID NO: 19864 - protein, 175 aa, Artificial Sequence; identical to SEQ ID NO: 19863
  Synthetic sequence.

SEQ ID NO: 19865 - protein, 175 aa, Artificial Sequence
  Synthetic sequence.
SEKDERLEEIKRRLKEHKRRSEEAVKDNDRKLEKHKRDSDRSAEEVKKKLEEIEKRVRKDGPRETELEELDRRLRKELEDHARRTDESMKRSEEHLRKLKKEIDESLKEFKKELDKLEKDKKLDDLEREIRKVIEESKRLLEELERRHRRVIEEDKRILDELRRLIEELIEDAKR

SEQ ID NO: 19866 - protein, 175 aa, Artificial Sequence; identical to SEQ ID NO: 19865
  Synthetic sequence.

SEQ ID NO: 19867 - protein, 175 aa, Artificial Sequence
  Synthetic sequence.
SEKDEELKRIKEDLERHERESEDDVRRNEEKIRRHRRKTEEAVKEVEEELKRLEEDVRREGPGRDELEKASEDMKRRLDELRRRIEESMKESDKHLRELEEKVRRSSRRFEEELKKLERDRDLERLRKEIREVIEKSKDLLRELRRRHEKVIEDSEDILRKLEKKIKDLVDKIRK

SEQ ID NO: 19868 - protein, 175 aa, Artificial Sequence; identical to SEQ ID NO: 19867
  Synthetic sequence.

SEQ ID NO: 19869 - protein, 175 aa, Artificial Sequence
  Synthetic sequence.
SRKDEEVKRVKEKLKKHEERSRDMVRKVEDKSRRHREKIKEAEREVRRRIEELEEDVRRRGPRRDELERVKRELEKRLEELEREIRKSLEDAKRDLERLKREIDKSLEELKRELEKLEEDKKLEDLREEAERVIRRSEKLLEELREHVERNIDEVREILRELAELVKRVIDEIRR

SEQ ID NO: 19870 - protein, 175 aa, Artificial Sequence; identical to SEQ ID NO: 19869
  Synthetic sequence.

SEQ ID NO: 19871 - protein, 184 aa, Artificial Sequence
  Synthetic sequence.
SVEDILRTLRRLLEELEEESERILKRLREIIETNVRRVKELLRRLKERLDELAERLKAKVREEEVLRRLAEELKRAEDELRKLEEDVKKSVKELRDKLETLRRDVRRNLEEIRKELEKIEKDRVTSKELDDLLKKVEEHLRRHKRKLEKALKDVEDESREHEKELRRALKRIERLLRELERKAD

SEQ ID NO: 19872 - protein, 184 aa, Artificial Sequence; identical to SEQ ID NO: 19871
  Synthetic sequence.

SEQ ID NO: 19873 - protein, 180 aa, Artificial Sequence
  Synthetic sequence.
DEEEVIREIEKRFRDLIRRAEDVLRRIAEKMKRLKDKTRRLLEELRESNRKLIKELRDRIRDERLRKEVEDLEKTSRDRLDAIREELRESEERAREILDRIRRLIEELRRTAKERLDELRDTRRSKEVRDRVEEELKRIEDRLRKLDTDVDRYLKEHEDRLRKLKEDNERDLKRVEERAR

SEQ ID NO: 19874 - protein, 180 aa, Artificial Sequence; identical to SEQ ID NO: 19873
  Synthetic sequence.

SEQ ID NO: 19875 - protein, 177 aa, Artificial Sequence
  Synthetic sequence.
DIEELLKEVKKEVDRVEKKVKELIDRNKERVDRVREENERVADEVRKLIKELRDRIRDDEEVVREVEEVLRRVEKKLDELSRHVDEVLKESEDRLRKVLKLVREVLEDATKLLKDIETRELVEKVAREAREKLKKVEDLLRKISRRSEELLRRNREATKKILKELRELLRRVEEKRR

SEQ ID NO: 19876 - protein, 177 aa, Artificial Sequence; identical to SEQ ID NO: 19875
  Synthetic sequence.

SEQ ID NO: 19877 - protein, 185 aa, Artificial Sequence
  Synthetic sequence.
SEAEEALKRHRKLNKEAEKRAKDATDDSKRLLDEIRKRAKEASEDSKRLLDEARRLREAGARKEEVEKIIDEAAKKSKKAAEEARKAADDAARKSRKAAEEAKKLADDSARDAERAAREAKDREDKERVRRILEEAKKTARELRERIKKLLKENEDAAKKLRDEIDEAAKKNKKAADEAREEARR

SEQ ID NO: 19878 - protein, 185 aa, Artificial Sequence; identical to SEQ ID NO: 19877
  Synthetic sequence.

SEQ ID NO: 19879 - protein, 185 aa, Artificial Sequence
  Synthetic sequence.
SELEKVLEEHRRLNDEIRKELEDVTRKSEETNKRIEEDLRRVTKEAKDLLERIKEKLEAGRRKEEIREEVKKVLEDSERVIEKVKRLLDESLDRSRKMIKKVEDLVRDSLRKAEEVIRRVRDKEDRRRVEEILRDMKETVDKLKKEIEKLLEENKESAKELRERIKENLETNRDLVRKLEEDIKR

SEQ ID NO: 19880 - protein, 185 aa, Artificial Sequence; identical to SEQ ID NO: 19879
  Synthetic sequence.

SEQ ID NO: 19881 - protein, 175 aa, Artificial Sequence
  Synthetic sequence.
DEAEKALEEVRDLIREIRERDRKVTEDVERLNREIREKLKEVTERVKRSNDDIRRLLEEGRDKREIKKLIEESNELVRKVVKEATELIRDSNRLVKEAVDTSRKLIKEVLDRVREMPVDKSILEELERLVRELRKESEKSLEDLERLNKKLEDEVRDILRKLNKLNEDLLRKVEE

SEQ ID NO: 19882 - protein, 175 aa, Artificial Sequence; identical to SEQ ID NO: 19881
  Synthetic sequence.

SEQ ID NO: 19883 - protein, 175 aa, Artificial Sequence
  Synthetic sequence.
SEMDEARKEVKKLLDEVRKRDEDVTRKVEELNKRIEERAKRVAEEVEKLIREILKRLRDGSRKEEARKLLEEVKRTVDKMIKELEELVRRSNRVVKEAVKESRELIKRILERVEKVPVDEKILEDLRRLVKKLKEESDRSLERLERLNERLERRIREILKRLEKLVRELRKEVER

SEQ ID NO: 19884 - protein, 175 aa, Artificial Sequence; identical to SEQ ID NO: 19883
  Synthetic sequence.

SEQ ID NO: 19885 - protein, 175 aa, Artificial Sequence
  Synthetic sequence.
SEAEEALRKVEELIRRVKKRDDEAVKEVRELNKRIADILREVLETVRKLLEDVEKALRDGSDKREARKLLEEILEAVKRAADRIEDLIRRSNEAVRRVVEESRDLIKRILEEVERAPVEEDILRTLRELVRDLERKSEESLKELNRLNEDLKREVKRVLDELEELVRRLKKKVDD

SEQ ID NO: 19886 - protein, 175 aa, Artificial Sequence; identical to SEQ ID NO: 19885
  Synthetic sequence.

SEQ ID NO: 19887 - protein, 185 aa, Artificial Sequence
  Synthetic sequence.
QVEDVIRESKKLTEDSEKRVRDIIRRLKKTIKDSEDRVRRMVEELRERIKRLRERLESEDERVVREVERVVRELEKLVKEAEDRARKFLETSDRIVREIEKRAREMLEESKRVLEEIKRLADEGVSDEVIETLLRKDRDLNRRVNEELRKLEEEVEELNRRVNETIKEILRRIAELIRRILEKTK

SEQ ID NO: 19888 - protein, 185 aa, Artificial Sequence; identical to SEQ ID NO: 19887
  Synthetic sequence.

SEQ ID NO: 19889 - protein, 185 aa, Artificial Sequence
  Synthetic sequence.
KVEEILKELEELIKRSKETVDEVIKRSKDLVDESRRRIEDVIRELEKLIRELDKKLETDDKDVVKEVKEAVKRLRDEVKRIDDEVRRAVEKSKEVLDEIRRRVDELVKRSKRLVDDIRRLLAEGVSEEVVRTLVKEIRDLNKRVNEEIKRLLDEDKKLNEEVNRLIKELKKEIEDLIREVLEDKR

SEQ ID NO: 19890 - protein, 185 aa, Artificial Sequence; identical to SEQ ID NO: 19889
  Synthetic sequence.

SEQ ID NO: 19891 - protein, 185 aa, Artificial Sequence
  Synthetic sequence.
EVEDIIRESKKLIEDSKERVKEVIKESKRLIEELERTVREVIKELRERVDRLRKKLRDDNEEVERRVTEAVERLKELIERIRREVEEAVRRSEETLEELKRRADKLVEDSRRVLEEIKRLADENVSKEVLDTLLKEDRDLNEDVKRRITELLEEDRRLIEEVKKRIRELRERIKRVIEEVDRATT

SEQ ID NO: 19892 - protein, 185 aa, Artificial Sequence; identical to SEQ ID NO: 19891
  Synthetic sequence.

SEQ ID NO: 19893 - protein, 175 aa, Artificial Sequence
  Synthetic sequence.
STAEEIVRRIRDVNRRINEAIERLLEEDEKVIRDVERRIEEVLERDRRVIEEVKRRVRTEEVVERVIRRSEKTIEDLKKLVEKLLRDSARTIEKIERLVREVIKETKRLLEEIKRRNVDERIIEEIKRILKESEDRLRRILETSRERLKELKKKLERVLEDSKKKLDELRRELRK

SEQ ID NO: 19894 - protein, 175 aa, Artificial Sequence; identical to SEQ ID NO: 19893
  Synthetic sequence.

SEQ ID NO: 19895 - protein, 175 aa, Artificial Sequence
  Synthetic sequence.
REAEDLVRKVREVNKKANRDIKELLDRDEKVIREVARAAEAIVDEARRIVEEVERKIREERVAKEVLERLKKILDELAELAKRVLERSEETIERIERLAREVLRATRDLLEKIRKNNVDERIIKEIKETLDESRKRAEEVLEKSRRLLEELRKRVEEIVKRIKELIDELERRVRK

SEQ ID NO: 19896 - protein, 175 aa, Artificial Sequence; identical to SEQ ID NO: 19895
  Synthetic sequence.

SEQ ID NO: 19897 - protein, 187 aa, Artificial Sequence
  Synthetic sequence.
SAEEIIKTLEELVEKLKRDAEETLRKIEELVRRLEEEARKSSEKIRKLVEDLAKEARERTRSKEVEKIVEEAKRRLDEIIKRNNEVVKRVLRELEELIERNRKVVEDALRELKKLIEKLEDLVRRNTGDEVLTEVLKEITELVKRLKELSDRTLEEVRKLVERVKRESKRTLEEAEEVVRELKERLR

SEQ ID NO: 19898 - protein, 187 aa, Artificial Sequence; identical to SEQ ID NO: 19897
  Synthetic sequence.

SEQ ID NO: 19899 - protein, 187 aa, Artificial Sequence
  Synthetic sequence.
DAERLLREVEELVRRLEEEMEKTDREIKELIKRLEERLRTTSREIKKLIEDLEREARERTRSEEVDRIVKEVIERLKRVLDKNNEIMERARERLERLLEENKKIVDEVLKELKELIDRLKDLVDKNGGREVLKKVIDEIRKLVKRVKDESKRSLDEIRKLAEEVDRRSKKVLDEIRRLVDEVRERLR

SEQ ID NO: 19900 - protein, 187 aa, Artificial Sequence; identical to SEQ ID NO: 19899
  Synthetic sequence.

SEQ ID NO: 19901 - protein, 187 aa, Artificial Sequence
  Synthetic sequence.
DAEDILREIKKLADDLKREADKSLKEIEELARRLEEEAERSLREIEELARRLKKRADEKTTDKKAEKIAREALKLAKEAAEENKKVAEEAAELAKRAADEDKKVAEEALKLAREAAEDARRLAEENGGREALKRAAERARELADRARKLSEDTLRKAKKLADDARKLSRETLEKARELAERAERRLT

SEQ ID NO: 19902 - protein, 187 aa, Artificial Sequence; identical to SEQ ID NO: 19901
  Synthetic sequence.

SEQ ID NO: 19903 - protein, 178 aa, Artificial Sequence
  Synthetic sequence.
DEAEEVRERVKKLIEESKRLIEEVRRRVRTISERSAELIEEVERRVDKMARDVERLLKDNVDKRELKRVVDDILRLVETVIARLRDTVRDLDRLVEEVIRRLHETDRRLKEEIDDAFRRLQDDEVLRRLEKLVRDSNDEIRRVLKELKEVVKKNRDEIERVLKEARKKVEDLLREIER

SEQ ID NO: 19904 - protein, 178 aa, Artificial Sequence; identical to SEQ ID NO: 19903
  Synthetic sequence.

SEQ ID NO: 19905 - protein, 178 aa, Artificial Sequence
  Synthetic sequence.
SEVERVRRENEETIRRIDEVIKKIEEDNKRTIDEIRDVIRRVKETVEKTNREIEKVRRDNRDKRDLDKLIKDSNRLVREVIERLRRLVKESLDTVKKAADELKRLVKESKELVEDVIRRVRDDEALRELRKSNEDLERRIRKVLEDLKRSNDELLEEIDRVLKRLHKSDEDVRKRVTD

SEQ ID NO: 19906 - protein, 178 aa, Artificial Sequence; identical to SEQ ID NO: 19905
  Synthetic sequence.

SEQ ID NO: 19907 - protein, 174 aa, Artificial Sequence
  Synthetic sequence.
RELEEAEKTVEELIRRIKEIIDEVLKRDRDVSERSKELIDKVKREAEKIVEEIERLLKNNVDRDELRKMVERLRELVKKVLEELRKTVRELEETSRRALERLRRLLKRLREIIEKDVRSEVLRKLDKKVKDLKREIDDVVRESKELIKRNRRRVEEVAKELERLIKEVKDRIDT

SEQ ID NO: 19908 - protein, 174 aa, Artificial Sequence; identical to SEQ ID NO: 19907
  Synthetic sequence.

SEQ ID NO: 19909 - protein, 174 aa, Artificial Sequence
  Synthetic sequence.
DELERVREEVRRLIKEIEEIIERVERRDEEVSRKSEDLIRRVLKRDEELAKEIEDLKRNNVDKKELRKMVKKLEESSRRALERIRRTVKELEETSREALKRLEDLLRELEDVIRKLVRSRVLEELKRLVEELEREIRRVFEKSKKLIDDNRKKADDVVKRSEDLLREVKKEIDR

SEQ ID NO: 19910 - protein, 174 aa, Artificial Sequence; identical to SEQ ID NO: 19909
  Synthetic sequence.

SEQ ID NO: 19911 - protein, 178 aa, Artificial Sequence
  Synthetic sequence.
SESEEVERLVEDVSRRNTKAVRDIEEHSKDVSRRNKKLVREVEEHTREVIERAKELTKRRKTEEVIKRVLDTLERLMRESVKLLEETVERLRRLVEKSKRLIEKTMKELRDLIKKVVEDITGRDVVERIRRLLRENVEENKKVLKRSDDLLKKNERENREVVKKSEKDARDLVEEIKT

SEQ ID NO: 19912 - protein, 178 aa, Artificial Sequence; identical to SEQ ID NO: 19911
  Synthetic sequence.

SEQ ID NO: 19913 - protein, 178 aa, Artificial Sequence
  Synthetic sequence.
SEEEDVRRKVEKVSRENKDMVRRILEHSRKVSEDNRRLVKEILDRARKAIEDVKELIERLKREEDIERVVRELRKLVKTVLDLIRETVKRLRDLVRKSKELIKETVKELERLIEKVIRDITGRDVVREIKELLDRNREENRKVLEDSERLVDENEKDNKRVLDELRRLLKRAEEEARR

SEQ ID NO: 19914 - protein, 178 aa, Artificial Sequence; identical to SEQ ID NO: 19913
  Synthetic sequence.

SEQ ID NO: 19915 - protein, 184 aa, Artificial Sequence
  Synthetic sequence.
SIDKALRDLKEILDRNRKHSEDLLREAEELVERSNDHSRRVLEEIRKLLRELEEEIRKRVKDEKKLRELKEIVDRIRELAEELFRRSNESDKRIKETVEDMIRKSRESVKRIEELIREVIERIRDEKLVREVEKTVEDLSRENKKLNEDVKRTVDELIKKSEKLNEDAKRTIDELLKRVKERIE

SEQ ID NO: 19916 - protein, 184 aa, Artificial Sequence; identical to SEQ ID NO: 19915
  Synthetic sequence.

SEQ ID NO: 19917 - protein, 184 aa, Artificial Sequence
  Synthetic sequence.
SVEDLLRKLKTIVDENRERVKKSLEELRRILDENRRRVERSLRELRESNERLRKEIEDTVKDEEKLRRLRDLVRRSAERVEDAVRRSRETVREVEDRVEKLADESRKTVERVRELIEEAIKRITDEEVLKKVEETVKRLSDENRELNKRIKEEVDEMSKRNKELNKRIKEENDKLIKEVKDEIR

SEQ ID NO: 19918 - protein, 184 aa, Artificial Sequence; identical to SEQ ID NO: 19917
  Synthetic sequence.

SEQ ID NO: 19919 - protein, 183 aa, Artificial Sequence
  Synthetic sequence.
SVEDVLRELKELIDRNREEAKKTEKELRELIKRNDDEAEKVAKESKKLTEDLEKEAREKVRSRKLEEIKRILDENREVLRRVLEDSKRSVRELKELVDRVIRKSEKIVDDLRKLVERLAREVRDEKVLREAKERAKEISKRNKDVNEEARKRIKEISDKDKRILDEVRRESKEIEKRLKEALK

SEQ ID NO: 19920 - protein, 183 aa, Artificial Sequence; identical to SEQ ID NO: 19919
  Synthetic sequence.

SEQ ID NO: 19921 - protein, 174 aa, Artificial Sequence
  Synthetic sequence.
DDEERVREVVKRVKEDNERVDREIREIVKRLLEHDRELLEEIKKEVDRVAEELRKLKEDGVPEEDLRKVVKDIEELVRRLIDELRKSTDDARRTVEDLIERLRETVRKALELIERVVRSEVLERLRKTLEELEKRNEELLEEARRLLEESREEVRELLERAKKILEDLEREIRR

SEQ ID NO: 19922 - protein, 174 aa, Artificial Sequence; identical to SEQ ID NO: 19921
  Synthetic sequence.

SEQ ID NO: 19923 - protein, 174 aa, Artificial Sequence
  Synthetic sequence.
SREERVREVVKRMLERDEELLRRIREEVERALRRNDEVLREIERVVEEMEERVERLKREGVDRKDLERLVEEALRVVREAIKELERTTRELEDLIRKLIEELRDSTRKVDELIKRKVTDEVLEDLRRLLEESVRRVEDLLKKLTDIVRESRKRVRDILRKAKRIVDKLREEIKK

SEQ ID NO: 19924 - protein, 174 aa, Artificial Sequence; identical to SEQ ID NO: 19923
  Synthetic sequence.

SEQ ID NO: 19925 - protein, 182 aa, Artificial Sequence
  Synthetic sequence.
DVEREAKRLLEEVAEHVRRSIKELRKLLEDVARHVEKTLRELEKLTDDVRKRVEKLKRDVKEEEKLKEVVERLKRELDKVSEDAKKLVDENRRLLKTVVDTVRRLVEENRRRLEEVVRRVEEAGVDRKVVEDIREKVKDLKRKHDTVLEEIKKEVRRLEKEHKEVLDKSNEDARKLEEDLRR

SEQ ID NO: 19926 - protein, 182 aa, Artificial Sequence; identical to SEQ ID NO: 19925
  Synthetic sequence.

SEQ ID NO: 19927 - protein, 177 aa, Artificial Sequence
  Synthetic sequence.
SEREEAKKLLRENEEDNRRVDREVEKLTEENERINRRVNEEVRKLTEDIKRKVESVKRLSDKRMLDKAIKEVEELSERSKDTIRRVIEESKRLSEESKRTIKEVIKRSTDLMRELDKRVTTRDIVEDIRRKADRLRERNEETLKRDEDKLKKLEESNRKVLKEDEDELRRLADKLRK

SEQ ID NO: 19928 - protein, 177 aa, Artificial Sequence; identical to SEQ ID NO: 19927
  Synthetic sequence.

SEQ ID NO: 19929 - protein, 177 aa, Artificial Sequence
  Synthetic sequence.
SEAEEAAKRSRDTAKRAEEIAREAAERLKKNAEDAERIAREAKKTSKKTAKEAEDAARSNAPEKAIEDAARKNEELARRAAELIERAARTNRKIAEDAARLVREAAERNKELADRAIKTRDADELRELAKRTEDKARKLADELRKLADETEKKARKLAEEVKKLADDTRRKAEEARR

SEQ ID NO: 19930 - protein, 177 aa, Artificial Sequence; identical to SEQ ID NO: 19929
  Synthetic sequence.

SEQ ID NO: 19931 - protein, 177 aa, Artificial Sequence
  Synthetic sequence.
DEVEKAKEESRRTLKKIEDRVRKVAEDLKKNLEDIERRVREVLEELRRLLEEIEEVVRRNIDKKEIDRLAEEIKEIAKRIIDEIRELLETNRKIVEEILEEIKRLVDENKKLVDRVKETSDKEELERLVEKTEDKIRKLLEEIKELLKETEKKIRKLLKRIEELMKEIEDKIDEDKK

SEQ ID NO: 19932 - protein, 177 aa, Artificial Sequence; identical to SEQ ID NO: 19931
  Synthetic sequence.

SEQ ID NO: 19933 - protein, 177 aa, Artificial Sequence
  Synthetic sequence.
DEVERVKEELKRNLKEIREDVERVKEESRDTVRKATEIVKRVLEELKKSLEEIKKLVDDNAPERMIEEVLRHNKKLVERIEREIRRLVEENRRLVERVLRRVEELLESNRDIVRDIIRRRDVEELRDTLRKSAEDIERLLREIEDLVRKTTEDAKRLADEVRRLVKESERTIKERAD

SEQ ID NO: 19934 - protein, 177 aa, Artificial Sequence; identical to SEQ ID NO: 19933
  Synthetic sequence.

SEQ ID NO: 19935 - protein, 177 aa, Artificial Sequence
  Synthetic sequence.
SEVEKVDRELKDNLRRIEEEVRKVDEELRRLLEEIRRTVEEFKERSKRTVEEIEKVARENAPEEVIKEVLRRNRDLVRKVLKTIKDLLDEIRRRAEEIIKKVEDLLESNRRIVEEATKTRDVEELRRTLEESERRIRKLLEDLKRLLEEIEKDIRRLEEEVDKLVRDTEKRIDDLRR

SEQ ID NO: 19936 - protein, 177 aa, Artificial Sequence; identical to SEQ ID NO: 19935
  Synthetic sequence.

SEQ ID NO: 19937 - protein, 183 aa, Artificial Sequence
  Synthetic sequence.
SLEDELRRRITEAEKRIRDLLRRVRELVERSKKTIKDLLRKLEETARETKDEIRKLEEEVKEEELKELIRRVLEESDKTLEKARKELKEALDRSERSVEKIERLIEEVVKRLREVIERVRDVKEEEKVRRVEREIKEILKKIEEDVTRLLEENKKILKEVEDLVRELEKEDRDVLKKVRDDVK

SEQ ID NO: 19938 - protein, 183 aa, Artificial Sequence; identical to SEQ ID NO: 19937
  Synthetic sequence.

SEQ ID NO: 19939 - protein, 183 aa, Artificial Sequence
  Synthetic sequence.
DLRERLEEEIERARRDIEDLLRKAEELAKRSKDDIKRLMDEVRRLVEKTRRDIEKLLREVKDKSVKERIKEVLRESEKTMRDIEREIKEVLDKSDESLKKVKEDLERVVRTLDKLIEDVRRVTEEEKVRKVEEEIRRVLEKIRRDARKLLEENKRITDEVRKRVKELLEENRKVLKRIKDEVD

SEQ ID NO: 19940 - protein, 183 aa, Artificial Sequence; identical to SEQ ID NO: 19939
  Synthetic sequence.

SEQ ID NO: 19941 - protein, 183 aa, Artificial Sequence
  Synthetic sequence.
KLREELEKLAEEAKKRIEDLAREAREAAKRASESNKDLARRLRELAKRTEDEIKRLLDDAKEERAKKLAEDALRRSRETAERADKLAKDADKHDKEIAEKAEELAKKALKDLEEAARRARRADKEEAARKAAEEIKKILEEAERLAREALKELERSNEESERLARRAAEEDKRVADEARERAR

SEQ ID NO: 19942 - protein, 183 aa, Artificial Sequence; identical to SEQ ID NO: 19941
  Synthetic sequence.

SEQ ID NO: 19943 - protein, 183 aa, Artificial Sequence
  Synthetic sequence.
SLREELRKKIEEAKKRIEKLMDDVRKEAEKAKRSNEELLRRLRKLAKETKRRIEELLERVKDESVKERIRRVLEESDRTLREAEELIRRVNEHDDRILRKIEEEIKRVLEKLEKVIKDVERVDDEEKVRRLLKEIEEILRRIEDKVRKLLKELRDSNRDSKRLVDELMRRDKEVLRRIEEEVK

SEQ ID NO: 19944 - protein, 183 aa, Artificial Sequence; identical to SEQ ID NO: 19943
  Synthetic sequence.

SEQ ID NO: 19945 - protein, 183 aa, Artificial Sequence
  Synthetic sequence.
DLERELEELIKKAEKKIRDLRKEVEDVVRDASRSNKELLREAEKLAEETRKRIDDLRKEVKDRSVKERIKEVLRESEETLKEVRETLKRMDEHDRTIMREIEERIRRVVEELRRLIEEVRRVDKEEKVRELEKRIRDVLRRIEEEVRRLLKRLKDSNDDSRRRLEELLRRDKKVLEDIERETK

SEQ ID NO: 19946 - protein, 183 aa, Artificial Sequence; identical to SEQ ID NO: 19945
  Synthetic sequence.

SEQ ID NO: 19947 - protein, 183 aa, Artificial Sequence
  Synthetic sequence.
SLREELERLIKEAEEKIRRLLKEVKDLVRELSRTNKKLLKEVRDLAKRTKERIKRLLDELKEERAARLIEEALEASDRTLKKIEDLIRRVNEHDEEIARRIEEEIKKAVDELRRLIDTVRRVTDEDKVRKLLEDIERLLREIERLVRELLEELKDSNRRSEELVRRLLKEDKDVLEKAERDVR

SEQ ID NO: 19948 - protein, 183 aa, Artificial Sequence; identical to SEQ ID NO: 19947
  Synthetic sequence.

SEQ ID NO: 19949 - protein, 174 aa, Artificial Sequence
  Synthetic sequence.
DEEEELRRLVRRLMEEVKRLLEENKKLADELRKTVKKLLEDNEDLARRLREEVERKVKSRIMEEVKRLIDEVLRHSKKVIEEVEKEIRDVLRKSEKIIKEAEDLIRRVLELAESGRRDVEEVKKELEELLREVEELSRRSLKELKELLERVKKRSEESLKELEDLLREAERKSR

SEQ ID NO: 19950 - protein, 174 aa, Artificial Sequence; identical to SEQ ID NO: 19949
  Synthetic sequence.

SEQ ID NO: 19951 - protein, 174 aa, Artificial Sequence
  Synthetic sequence.
SEKEELKKEVDRLAEEVERLLRENEKRARDLERKIRKLLEENRRAADEVRKEVDRTVDSEKADRVRKEIEKVLRHSEKVIREVTKRIRKLLEDSERIIRTAKRLIDEVLRAAEAGEVDVEEVKKRLEDLLEEVKELSKRSEDTLRKLAEDVKRLAEDSNKKLEDLLEEAKERAR

SEQ ID NO: 19952 - protein, 174 aa, Artificial Sequence; identical to SEQ ID NO: 19951
  Synthetic sequence.

SEQ ID NO: 19953 - protein, 174 aa, Artificial Sequence
  Synthetic sequence.
SEKEELRDLVRRAKEDVDRLRRENEELNRRIEEDIERLLKENEDRNREVKDDIDKRVSSEIVKDARRLNRENHERSKRIIERAKRLNEENHRTSRKIIEEAKKLIDDVLKKAESGSVDVEEVKKELEELLRRVRKLSEDSLKHLRELLKEVRELSERSLRHLDELLRRVREKAR

SEQ ID NO: 19954 - protein, 174 aa, Artificial Sequence; identical to SEQ ID NO: 19953
  Synthetic sequence.

SEQ ID NO: 19955 - protein, 174 aa, Artificial Sequence
  Synthetic sequence.
KDEEDAERRARESDKSIEELRERNEREAKRLKEEVEKLLEENEKKVDELRKRVEKTVTSEIVDEVRKLIEEVLENSKRIIDEVRKRIEDVLRESEEIIRRVKKLTKRVLDLVKSGSRDMEEVKEELDRLNKEAEELSRRSLRKLEELLREARRLSRESKERLKKLLEDARRKSN

SEQ ID NO: 19956 - protein, 174 aa, Artificial Sequence; identical to SEQ ID NO: 19955
  Synthetic sequence.

SEQ ID NO: 19957 - protein, 174 aa, Artificial Sequence
  Synthetic sequence.
SDEERAREEARRSKESIERLLEENRRLAKELKKEIRRLLKENEDLVRKLKEDVDREVDSEIAREARKLIKEVLDESEEIIRRVDKKIDDVLRNSERIIREAKRLTERVLRLVDSGSRDIEEVLEELDRLNKEVEELSRRSLKRLEELLEEVRKLSEDSLRKLKELLDRVREKSR

SEQ ID NO: 19958 - protein, 174 aa, Artificial Sequence; identical to SEQ ID NO: 19957
  Synthetic sequence.

SEQ ID NO: 19959 - protein, 181 aa, Artificial Sequence
  Synthetic sequence.
DERERLRKALEEVRRTVEKLVRENEELLKKVEERVRRLNDEDRRLVEEIKRRADELRKRGEATDEVIERIRKVLTDSERISREILRKLEEMLDRSRKIVEEILRELERVLREIEELVKRVTNDEVIRRVEDELRKVLEDIKRLSDKNKRDLEEALRDIERLVKENNKRLKEALDDLERAAT

SEQ ID NO: 19960 - protein, 181 aa, Artificial Sequence; identical to SEQ ID NO: 19959
  Synthetic sequence.

SEQ ID NO: 19961 - protein, 181 aa, Artificial Sequence
  Synthetic sequence.
SEREDLKRELDEVRKDVARLNEEDRRLLEDARRDLEKLVRDNEELVERVKKTLKELEDRGELTEEVVEELDRVLDESRKIVEEILREAEKVLKESEEISKAIVKRAEDVIREIEELVKRVKTDEVIRRVRDRLRRVDEELKELVKRNNERLREVLERIRKLSRDNSERLKAALEKIKEEVR

SEQ ID NO: 19962 - protein, 181 aa, Artificial Sequence; identical to SEQ ID NO: 19961
  Synthetic sequence.

SEQ ID NO: 19963 - protein, 181 aa, Artificial Sequence
  Synthetic sequence.
SLKEKIEKLLEESRKDIEELNERDKKRVKESEDTVRRLNEEDEELVKRVREELEKLRKEGRLDDRVVEDARRMLERSRRISEEILKENRRVLEESKETSKRILEDNERAVREIKELIDRVRTEEVIKEVEKRLRDVTKTSREKVRENNRRLEEMTEDTKRLVEENNKDLDKALKDIRKKAE

SEQ ID NO: 19964 - protein, 181 aa, Artificial Sequence; identical to SEQ ID NO: 19963
  Synthetic sequence.

SEQ ID NO: 19965 - protein, 181 aa, Artificial Sequence
  Synthetic sequence.
KEREELEKLLEEVERDVARLNKEDKDLVDEIRRRVDELVKRDKELLDRVRDRLRELSERGDLDERVEEKLERVLRESEKITREIRERVREVLRESEKISEEIVRRARKVIEEIERLLRKVTDSRVIEKVKRDLRRVLEELRRLAEENNRRLDKALKELEDLVRKNNKKVEDALRKIEEEVR

SEQ ID NO: 19966 - protein, 181 aa, Artificial Sequence; identical to SEQ ID NO: 19965
  Synthetic sequence.

SEQ ID NO: 19967 - protein, 184 aa, Artificial Sequence
  Synthetic sequence.
ELAEDLRRLLKEVEDRSRDLLRKNRKLLEEVRERTERLIKELEDLLEEITRRVKDLIRKIKDEELLKKLEDLLREIEKLVREALERSRKTLEDIRKRVEDMVRRSKEVLERIRRLVKEAIEKLRDEELVRRVKEEIKRLMEEDKKLNKKSVEEIRELLKRDRDLIEEVKKEAERLLKEIEDEVR

SEQ ID NO: 19968 - protein, 184 aa, Artificial Sequence; identical to SEQ ID NO: 19967
  Synthetic sequence.

SEQ ID NO: 19969 - protein, 184 aa, Artificial Sequence
  Synthetic sequence.
DLERELEKLLDEVRRRVEELNKRNEDLARKVAEDTKELLKELRELLEEVKRRVRDLIRKITDEKLARELEDLLRKIEEDVKEAIKRSEETLERIIRDIERMIRESERLLREIEELVKEVIAKLRDREVAERVKEEIRRLLKEIEELNKRSEERIKKLLEDDRRLIERVKERIEDLLRRIEERTR

SEQ ID NO: 19970 - protein, 184 aa, Artificial Sequence; identical to SEQ ID NO: 19969
  Synthetic sequence.

SEQ ID NO: 19971 - protein, 179 aa, Artificial Sequence
  Synthetic sequence.
DEVDELLKRLEDSSRKAEEDVKRMLERLEDSTRDAARRVKEMIKRNEEVSDEAEKRIRTEEVVERVLRTSREIIERIREVVKETNKRDKEIVDEVKEVVRETNERDKDIAKKLRDRVRNLDKVVKEIDDLLRESERRNRELLREIEELLKESERINRELLKEVDKVLRDSEERVERRRE

SEQ ID NO: 19972 - protein, 179 aa, Artificial Sequence; identical to SEQ ID NO: 19971
  Synthetic sequence.

SEQ ID NO: 19973 - protein, 184 aa, Artificial Sequence
  Synthetic sequence.
DLERRLDKILRDIEEAARDNIRRNEELLKRSEENVRRNLEENKKKLEEIKREVEELERRVKDKDLLKEIRDVLERIRRVVERALKEIKDLLRRSEELVRKSIEDIRRVLERIRRVVKDVKERIRSEELAKRAEERLRELLKELHEISKKMLREIKRVNDEINKVSKESLDELDELVKEIKERTR

SEQ ID NO: 19974 - protein, 184 aa, Artificial Sequence; identical to SEQ ID NO: 19973
  Synthetic sequence.

SEQ ID NO: 19975 - protein, 184 aa, Artificial Sequence
  Synthetic sequence.
SLEEELRKMLEKVERDVRRNIERNKRLLDRSRENVKENIKKNRELLKEIEKDVRKLETDVKDKKLLDEIRKILEEIAKLVEESIRRIEEALEKSERLVERSIREIKRVLDEIRRLVEEVRKRIRSEKLAEDAKRRLEELVREIHKISEDALEEIKRVNKEINDVSKEMLDRLRELLKEIKERTR

SEQ ID NO: 19976 - protein, 184 aa, Artificial Sequence; identical to SEQ ID NO: 19975
  Synthetic sequence.

SEQ ID NO: 19977 - protein, 184 aa, Artificial Sequence
  Synthetic sequence.
SLEEELEKLLDEVRKEVKKNIDENKRLLDKSREEVRKNIKTNEDLLRRIEEKVRRLLEEVKDKDLLEKIKEMLKRIKELVEESIRRIREVLKRDEELVKKSIDDIRRVLKRIEDLVEDAKRKIRSEELAERAKRELKKLEEEIHRISREALERSKKTVEELHEISKRMLDELKRVDKRLEDETR

SEQ ID NO: 19978 - protein, 184 aa, Artificial Sequence; identical to SEQ ID NO: 19977
  Synthetic sequence.

SEQ ID NO: 19979 - protein, 184 aa, Artificial Sequence
  Synthetic sequence.
DQREDLDRRLREIEERVEENLRTNEELLKEVEKNAKENIDRNRKTLEDIKRRVDDLRRRVKDKDLLKRIEEMLRRIERMVRESIKKIKKVADDIRRLVKKSIDDIRRILEEIRRVVEEVKRRLRDDELVERVKDELRKLVKEIHDVSKKALEDLERLLRELNEISERALRTLEKLLRKLEEDTR

SEQ ID NO: 19980 - protein, 184 aa, Artificial Sequence; identical to SEQ ID NO: 19979
  Synthetic sequence.

SEQ ID NO: 19981 - protein, 184 aa, Artificial Sequence
  Synthetic sequence.
SLEETLKRILDKVREEAKRNIKENEDLMRESRRNVEENIRRNEKTLEDIEEEVRRLREEVKDEDLLRKIEKVLKEIRDLVRESIRKIRELLEEDKKLMDTSIRIIEKLLKELEELVDDIIKRIRSEELAKRVKEELDKIVRRVHEISRRALEESRKTVEELNRESEKVLRELERLLRRLEEEVR

SEQ ID NO: 19982 - protein, 184 aa, Artificial Sequence; identical to SEQ ID NO: 19981
  Synthetic sequence.

SEQ ID NO: 19983 - protein, 184 aa, Artificial Sequence
  Synthetic sequence.
SDEDDLRRILEEIRRNVERNIRENERLLDEIKKRVDENIKTNKKTLEDIREEVRKLEEEVKDKDLLRTIREMLRRIEEMVRESITRIRKVLDDIRKLVEESIKEIKRVLEEIKRAVEEVARRLRDRELVKRVEDTLRDLLRKLNEISKRALEELKRAVERIHRISRDALRELDRLRKELEERTR

SEQ ID NO: 19984 - protein, 184 aa, Artificial Sequence; identical to SEQ ID NO: 19983
  Synthetic sequence.

SEQ ID NO: 19985 - protein, 184 aa, Artificial Sequence
  Synthetic sequence.
DDEERLDKILRDIEENARRNIERNRTLLERSRENVKRNIDENRRKLEEIRRDVEDLKRKVKDEDLLREIEDVLRKIEEVVKRSIDKIRKMLEDDERLVEESIRRIREVLKRIRDLVEDVKRRLRDKELVKRAEDELRRLLKELNEISERMLRRSEETVRRLNEVSERALRELDRLRKKIERRTR

SEQ ID NO: 19986 - protein, 184 aa, Artificial Sequence; identical to SEQ ID NO: 19985
  Synthetic sequence.

SEQ ID NO: 19987 - protein, 184 aa, Artificial Sequence
  Synthetic sequence.
SLEETIRRILEESERNVKRNIDENRKLLKEIRDNAKRNIDENRRLLEEIERTVRDLERRVKDKDLLKEIRDVLERIRKLVEESIKRIEDLVRDVERLVEESIREIKRVLDEIRKLVKEVEDRIRSEKLAEDVLRELDKANKDINEISKKMLEDLKKAVEDVNRVSKEMLERLKRLREEIEKRTR

SEQ ID NO: 19988 - protein, 184 aa, Artificial Sequence; identical to SEQ ID NO: 19987
  Synthetic sequence.

SEQ ID NO: 19989 - protein, 184 aa, Artificial Sequence
  Synthetic sequence.
KDEERLDEILDRSRRNAETNIKRNKDLLDESRENVKENIKKNEDLARRIRERVEDLERKVKDKDLLKEIRDILREIEKVVEDSIRRIREMLRRDEKLVKDSIDEIRRVLKRVEDLVEDVKRRLRDEELVKRVEDELRRLNEEVNKISEEMLKRSKDTVRELNKVSEDALRKLDELRERIERRTT

SEQ ID NO: 19990 - protein, 184 aa, Artificial Sequence; identical to SEQ ID NO: 19989
  Synthetic sequence.

SEQ ID NO: 19991 - protein, 184 aa, Artificial Sequence
  Synthetic sequence.
SLEEDLRRILKEIRDNVRENIRTNEELLKRSRENVKENIERNKKLLREIEEEVRRLEREVKDEKLLRDIRRVLEEIRRDVERTIREIKRVLDEIAELVERSIREIKRVLDEIDRMVKEAEDRIRSEKLAKEVKDRLRDLLRKLNKISEDALRELKRLNDEINRISEEALERLKKLLEDLERRVR

SEQ ID NO: 19992 - protein, 184 aa, Artificial Sequence; identical to SEQ ID NO: 19991
  Synthetic sequence.

SEQ ID NO: 19993 - protein, 184 aa, Artificial Sequence
  Synthetic sequence.
SLEEKLRKILEESRENVERNIRRNEDILRKSRRNVEENIKTLEKILEDIKRTVDKLKKDVKDEELLKRIEEELRKIEDRVRRVIREVEKLLRDSEELVKRSIEEIRRALERIKELVEEAERRIRSEELARKVERELREMNKELNRISEEALKRIEEVNRDINRVSKEVIEELERLVEKIREDVR

SEQ ID NO: 19994 - protein, 184 aa, Artificial Sequence; identical to SEQ ID NO: 19993
  Synthetic sequence.

SEQ ID NO: 19995 - protein, 184 aa, Artificial Sequence
  Synthetic sequence.
DLERELRKAAKESRENAEKNKEDNKEAAKRSKENAEKNIRDNEETARKIEEDARKLEKDAEDEDLARTIRKAADEARKAAKESIDEIRRAAKESEDLARDSIRKIDEAAREAKKLADEAEKRARTEDLARKALRDLREANKRANEISKKALDEIRKANEDANRASKKANDDLRRLAEKAKRDAE

SEQ ID NO: 19996 - protein, 184 aa, Artificial Sequence; identical to SEQ ID NO: 19995
  Synthetic sequence.

SEQ ID NO: 19997 - protein, 188 aa, Artificial Sequence
  Synthetic sequence.
DLERELRELLERVRKDVRDNLETNKKLLEESRKNAEDNLRENDRLLKELEKRVKDLLDELRKDKEVLDKIKKLLDKLREVVERSLKLIEDLLREAEEVVRESLRLIEELLERVEEVVKRAAELIKRGLPEEVVKRVLDDIKRIVDEINRISKEMLDKLKRINDEANKISKRMLDELRRIAEEIEREVR

SEQ ID NO: 19998 - protein, 188 aa, Artificial Sequence; identical to SEQ ID NO: 19997
  Synthetic sequence.

SEQ ID NO: 19999 - protein, 188 aa, Artificial Sequence
  Synthetic sequence.
DLEERIKKLLEESRKNVEDNEKKNKDSLRRSREEVKRLSDENEKLLKRIRERAEKLKTDLKDDKDLLERIERALREVEDLVRKSKELNDRLLKKSEEVVKRSLDLIKTLLKRIDDLAKKILELLKEGRDKRVVETVLRELERINEEINDISRKMLKENEKILRDIKKINEDMLKRLKEALERVDREVN

SEQ ID NO: 20000 - protein, 188 aa, Artificial Sequence; identical to SEQ ID NO: 19999
  Synthetic sequence.

SEQ ID NO: 20001 - protein, 188 aa, Artificial Sequence
  Synthetic sequence.
SLEEEIRDILRRAEERVKELTKENERSLRESKKRVEDLSRENEKTLEEIKRDVDRLLKELKDEEEVLRLIEKMLRDARKVVEDARKLNEDLLRESERVVEEVKDKNRRLLEELRRVVEEIKRLIDRGEPEDVVREMLKDLERIVREISEDNARTLEENERILREIEEENKKTLERLREILKRIREEVT

SEQ ID NO: 20002 - protein, 188 aa, Artificial Sequence; identical to SEQ ID NO: 20001
  Synthetic sequence.

SEQ ID NO: 20003 - protein, 188 aa, Artificial Sequence
  Synthetic sequence.
SLEEEIRKILKRIREEVKRLTEENDKTLKDSERNVRENLTEIERILREAADDVRRLEEELREDERVLELIKRADKKLKDLVRDILRRIDEMLKRSREVVREVKRTNKEMLERIERIVKRATDLIREGRPEEVVERVLRELERLLEEIRDRNKKTLDDLRRINEEVNRISKDALEELRRLLRELRELVK

SEQ ID NO: 20004 - protein, 188 aa, Artificial Sequence; identical to SEQ ID NO: 20003
  Synthetic sequence.

SEQ ID NO: 20005 - protein, 188 aa, Artificial Sequence
  Synthetic sequence.
SLEDEIRKILDELRKNVRENLEDNKRVLREAEEEAKKLSEDNRRLLKELKERVKELKDRLRSDKDVLKEIDELLKELERVAKEVEDRNRRLMERVRDVVRRSLEEIKRLLEKLEDVVRRVERLMDEGRPEEVVRRALEEIERINRDINRRSKEVLDELREIVREAKEDNERTLRKLKKILEEIEEKVR

SEQ ID NO: 20006 - protein, 188 aa, Artificial Sequence; identical to SEQ ID NO: 20005
  Synthetic sequence.

SEQ ID NO: 20007 - protein, 188 aa, Artificial Sequence
  Synthetic sequence.
RLKEELERILREAEKNVRENLRRNRESLKESKETVDRLSEENKKTLEEVRTTVEELLKELKDKREVLKRIKEMLDTAKELVERALELNRDLLRKSERIVTESERLIKELEEELRRVVETVTRLLAEGRPEEVVRDALRKLEEINRRINEISERMLKENKRLLEEIKRINKETLDRLKELLEEIKEDVR

SEQ ID NO: 20008 - protein, 188 aa, Artificial Sequence; identical to SEQ ID NO: 20007
  Synthetic sequence.

SEQ ID NO: 20009 - protein, 181 aa, Artificial Sequence
  Synthetic sequence.
SDVERVEKELKKTNDELRKIVDEARKLLEKTNKEIRDINRTMMEELRRTNEDLKRVVERGEDRSVLKEILERSEKLVRESIKKNEDLLRESKRVVDKVIREIERILEKSRELVREALRRLTDRRVIERIREIARKNEEDVKKLLKELKDLLEKNKRDVEKASEENKKLLEDNERDVRREST

SEQ ID NO: 20010 - protein, 181 aa, Artificial Sequence; identical to SEQ ID NO: 20009
  Synthetic sequence.

SEQ ID NO: 20011 - protein, 181 aa, Artificial Sequence
  Synthetic sequence.
KEAEEAAKLLEDTNRRLKEIAEEAEELLRRTNEKAKKINDESREKIKDAARRAEDAARRGRPEKDLEKAARDAEEVAKRAIEESRRAARESEELAREAAKRLKKAADDSRRLAEEAARRLTDEKAIREIKELAKKNKEDAERALERIKRLADKNREDAKRADEDNERAAEEARRKAEELKR

SEQ ID NO: 20012 - protein, 181 aa, Artificial Sequence; identical to SEQ ID NO: 20011
  Synthetic sequence.

SEQ ID NO: 20013 - protein, 181 aa, Artificial Sequence
  Synthetic sequence.
DEAEDVERKLEATNKELNEINERSRKELETSNRELNRINTESEEEIRRIEERIDRVKKRGEPREVLRKIVKEIKDVVKRAIDLSREVLERSERIVREVIKDSERILRESERLVREALRRLDKKELIERIKRLLDKNREDVKRMNEDNKRLLKENRDDVKRMDEKNKKILDEVDEKAKEKEK

SEQ ID NO: 20014 - protein, 181 aa, Artificial Sequence; identical to SEQ ID NO: 20013
  Synthetic sequence.

SEQ ID NO: 20015 - protein, 177 aa, Artificial Sequence
  Synthetic sequence.
SEEEELKKLLDRVRERVERSLDEIRRLAREVEEHVKKVNDDIRRLLDEIRREVEDIERRVKDKDVLKKLREVLDEIEKLVRKVLEESTRSLEKARELVKKALERNERLLEEIEKLARDIPAGDEVRELVRTLEERIDDSTREVKKLIEDLKRENKRILDTVRDLVRRLREKIKRIAD

SEQ ID NO: 20016 - protein, 177 aa, Artificial Sequence; identical to SEQ ID NO: 20015
  Synthetic sequence.

SEQ ID NO: 20017 - protein, 177 aa, Artificial Sequence
  Synthetic sequence.
DEEERLAELLERVKRDVDRSLKRIRDLLKELEKHAKEVNDDIRRLLEEVERRVREMEKRVKDKDVLKKLKDLLDEIRRRVEDALRRSTTSVDKVRKLVERVLENNKRLLEEAEDLVRRIPAGREVEELIRRMLKRIRDSTKKVEDELRRILEENRRILEEVRREIDELKKAIDEISR

SEQ ID NO: 20018 - protein, 177 aa, Artificial Sequence; identical to SEQ ID NO: 20017
  Synthetic sequence.

SEQ ID NO: 20019 - protein, 177 aa, Artificial Sequence
  Synthetic sequence.
SEEERLEELLRRIEKHSRELIRELEKSLEDSEREVRKSLKRIEELLRRAERKVREIRKRVKDKDVLRELERLLREAEKRVREVLRNNERLLREDEELTKEVIKKSKKILDEIRDLVRRIPAGREVKKVLDDLLKRDRDAIDEARKLNEEMLKRIEDSSREVEKLLADMEKTIEDIEK

SEQ ID NO: 20020 - protein, 177 aa, Artificial Sequence; identical to SEQ ID NO: 20019
  Synthetic sequence.

SEQ ID NO: 20021 - protein, 185 aa, Artificial Sequence
  Synthetic sequence.
SIDDKARKDLKRILDENRDIVRRVEELIRRSDELLKRILDDVKRRIDELRKKLEDIARKVKSKDMAELLERVLREIEDLIRRVLERIKKVLDESRKLVEEVLKENKKSLEKVERLAREVKTRIKDDEDVLRDIDRLLKEIKKHAEDSLRKIEKLLRESEEKVKDILRKIKKLLDEARKEVEDRRR

SEQ ID NO: 20022 - protein, 185 aa, Artificial Sequence; identical to SEQ ID NO: 20021
  Synthetic sequence.

SEQ ID NO: 20023 - protein, 185 aa, Artificial Sequence
  Synthetic sequence.
SIAEEVEELIRRLETKNRKIVKDVEDAIRASDDKNRRVLDKVRKDVERLKRELDRIAKEVKSEEALKLLTRILEEAEKLARDAERLNKETLDESRDLIRRVKELNKTSLREARRLAEEALRRIKDDKEVLDRIKELLKKLEKHVKDSLDKIDDLLRKSEKHVRESLETIKRLLEELEREVERLAR

SEQ ID NO: 20024 - protein, 185 aa, Artificial Sequence; identical to SEQ ID NO: 20023
  Synthetic sequence.

SEQ ID NO: 20025 - protein, 185 aa, Artificial Sequence
  Synthetic sequence.
DEKREVERLIRELIEENRDIVRRVEKLVRESNKKLDEILEEIRERLERLREKLKDIKRRVKSKDALKLLEDVLKEARETVTRVEELLRKLLEESRKLVEEAKKRNKDSLRKVEELVRDAETKLKDNEEVLRRIRELLERVEKHVRDSLRRIDELLKRSEERVRRIIREVRERLKRLEEEVREAKR

SEQ ID NO: 20026 - protein, 185 aa, Artificial Sequence; identical to SEQ ID NO: 20025
  Synthetic sequence.

SEQ ID NO: 20027 - protein, 185 aa, Artificial Sequence
  Synthetic sequence.
SISEDAERLVRELLRKNKEIRDRVEELVRRSNDKNRRVLEEVEKRLRDIIRKLEDIERRVKSEEMKKLLEEVLKEAEDLVREVLKLNDDTLRESEELVKKAKEDNERSLEEIRELVERVERRVKDNEEVLRRIRDLLRRVTEHVEKSKRDIEKLLRESRDHVRRSKEKIKRLLDEARERVERSKK

SEQ ID NO: 20028 - protein, 185 aa, Artificial Sequence; identical to SEQ ID NO: 20027
  Synthetic sequence.

SEQ ID NO: 20029 - protein, 176 aa, Artificial Sequence
  Synthetic sequence.
DEEDKLRKLLEEAREAVKRALERVDKLLRDSEREVRRILEEVKKLLDESRKAVEDIRRKATDEEALERIDRVLENSEKIIRDIAELIRKVLEESRKIAKEARELIKAVLKEAEDIIREVSSEEAEELIRRVIRKAEKLLREVEELLRRSNDKLRKLTEKVRTDLERSKKRLEDEAR

SEQ ID NO: 20030 - protein, 176 aa, Artificial Sequence; identical to SEQ ID NO: 20029
  Synthetic sequence.

SEQ ID NO: 20031 - protein, 187 aa, Artificial Sequence
  Synthetic sequence.
SILEKVRELLERIRDTVRKILREIEKSLEDNKRHSDEVLKEIEDLLRDLERRVKEIEERIKDKDVLKKVKEIVDDVRRRVREVLEKNRRIAEDSERLVEEVLRRLKELLDEIKKRVDDVLRKLEERETEEILEEIERLIREVRRRLKKILDDVRELSRRANEKDRKSLEEVRKLVEDVRRELERVAT

SEQ ID NO: 20032 - protein, 187 aa, Artificial Sequence; identical to SEQ ID NO: 20031
  Synthetic sequence.

SEQ ID NO: 20033 - protein, 187 aa, Artificial Sequence
  Synthetic sequence.
DVEEEVKKLLEDLERHSRKVLEEIKKLLKELEDHNRKTVEDIEELLRELEKEVRKLEEDVKDEDVLRKIRKILDKIRKDVDRVLKLLDESMKEIEKLVRDVLRKNEEVLEEAKERVTRVLRKLRDRETEEILEEIRRLAEELEKEDRKTLKEARDLAREVKKRNEEIKRRVEELIKKVDRELKEVAR

SEQ ID NO: 20034 - protein, 187 aa, Artificial Sequence; identical to SEQ ID NO: 20033
  Synthetic sequence.

SEQ ID NO: 20035 - protein, 176 aa, Artificial Sequence
  Synthetic sequence.
DEDEDVRRLLRRLREKVRRVKKKIDDSLRENRKKVRKTNEEVKKLLEDNRRRIEDVKRKRQEKEVLDLLEEVERHVEDIVKKVSELDKESLKLSDDLAKKARELIKRVEEKIEKVVKDRRSEEARKLMRELEKELKEIEDEVDKMSEEINRKNDEILRRARELIKRNNELLEEIRR

SEQ ID NO: 20036 - protein, 176 aa, Artificial Sequence; identical to SEQ ID NO: 20035
  Synthetic sequence.

SEQ ID NO: 20037 - protein, 176 aa, Artificial Sequence
  Synthetic sequence.
SEEEEVRKLLERLERTVEKTNRDVERSLRENEKRVRETNDEVRRLLEENRRRIEDVERKLQDEDVLRLLEEVKKHVEEIVRRVSELDRESLEESKELAKRASKLDEDTRRLIDRVIEERRSEEAKRLIEELEKRNREVKKEVEEMSRRINKKNEEILREARKLIEENNKLLKDIER

SEQ ID NO: 20038 - protein, 176 aa, Artificial Sequence; identical to SEQ ID NO: 20037
  Synthetic sequence.

SEQ ID NO: 20039 - protein, 181 aa, Artificial Sequence
  Synthetic sequence.
SELDEIAKAIRRLLEEVRRKNERIDEDIRRLLDELREHSEKVLREIEELLRRLEDAVRKRKDADDILRKIKKLIEDVAELLRKSLEEARRLLEEVARLLKTSVDDIKRLIDRVAEELSRVKDKDARKRAKDVLRDLEKKVEDLKRRNDKTLTDAKRELDDSRRRVKRVLDELEKVLRDLKR

SEQ ID NO: 20040 - protein, 181 aa, Artificial Sequence; identical to SEQ ID NO: 20039
  Synthetic sequence.

SEQ ID NO: 20041 - protein, 181 aa, Artificial Sequence
  Synthetic sequence.
DEAERILEEVKKLLEEVERLNKKIDDEARRLLREVERENEEIDRDIKRLLDEVRKDVERNKESDEILRKIRELIERVARRLEESVRRIRELVKEVRKLVRTSNEDLRRLIRDVAEKMRRVKDEEVRRRAEEVLRELEKVVEDSRRRNEKTLRDMERRIKELEDRNRDTLRKLREVVKELER

SEQ ID NO: 20042 - protein, 181 aa, Artificial Sequence; identical to SEQ ID NO: 20041
  Synthetic sequence.

SEQ ID NO: 20043 - protein, 174 aa, Artificial Sequence
  Synthetic sequence.
SEEERVRELIERMREMLERLEESNKKVLEEIERVLEKSERDVERVIREIERTLEEVKDNDEVRELVKRVLDDLRRFLDESRKLVKEIVDRLREMAKESKKLVKEVLDRLRELLERNGDTDRVIREAERVLEEVRRRNEKVNKEARDLLKEVEKHSRDVLEDIKRLLEEIRERAR

SEQ ID NO: 20044 - protein, 174 aa, Artificial Sequence; identical to SEQ ID NO: 20043
  Synthetic sequence.

SEQ ID NO: 20045 - protein, 174 aa, Artificial Sequence
  Synthetic sequence.
SEKERIEDVIRRIEKVLKESRDEADRVKKEIEKRLRELEKRHKEVTTEVKRVAEEVKDNEEVLKEIEDALRENERMVEDVRRLVEDILRKLDKFMRESEELVRRIVKRLEDLLRNNGDSETVLREAEELLRRVKKHSKEVLDRVRELLKRVEEKSERVLRELERVLREIREKAR

SEQ ID NO: 20046 - protein, 174 aa, Artificial Sequence; identical to SEQ ID NO: 20045
  Synthetic sequence.

SEQ ID NO: 20047 - protein, 174 aa, Artificial Sequence
  Synthetic sequence.
KDEERIEELLRRNEENLRRLEDSNRKVLRENEEILKELKRRHEKITEDLKRELEKVKDNDEVERLVREVLKKNEELAKKVEDLVRRTTERLKRLVDKSRKLVREITERLRRLLEQNGDTDTVLREATELSKEVHKENRRVNEEAKDLSRRVAEESDRILRELKKLLDEIRKRAK

SEQ ID NO: 20048 - protein, 174 aa, Artificial Sequence; identical to SEQ ID NO: 20047
  Synthetic sequence.

SEQ ID NO: 20049 - protein, 174 aa, Artificial Sequence
  Synthetic sequence.
SDEERIRRVIEDIERKLRELEKRHKEVTRENKENAKELKERHDRVTKDIKKTLDDVKDNDEVRRKVEKVLDENRKMVEKVLELLERISRRNEELMKDVRRLVKEILERLKRLLDNNGDTDRVLEEIKKLLREVEERSDRALREAKKLSKRVHERSKEVIDRLRELLREIKREAD

SEQ ID NO: 20050 - protein, 174 aa, Artificial Sequence; identical to SEQ ID NO: 20049
  Synthetic sequence.

SEQ ID NO: 20051 - protein, 178 aa, Artificial Sequence
  Synthetic sequence.
DSAREMERRIRELLKRVEDKSEKALRDSKKLTKEVEEESERALRRTEKLLREVAELARRVDKKEIEDIAREIIKDNERVLEDIRRLSEESVRDNRRVLDEIRRLIEEIIEDLERVLRKGDLDEKRVRDVLREIEEVLRRLEERHERLTRDDERVLRELEDRHRKLSERVKKLLEELKK

SEQ ID NO: 20052 - protein, 178 aa, Artificial Sequence; identical to SEQ ID NO: 20051
  Synthetic sequence.

SEQ ID NO: 20053 - protein, 178 aa, Artificial Sequence
  Synthetic sequence.
DRAEKAEREIRRLLERVKEDSERVLRESEELTRRVEEESRKILEETKKLTRTLEELSRTEDKRLVEKISRETIRRNEEMLKDLKRLSDESVKRNEDALDDLRRLAEEIIRRLEEVLRRGDLDEERVKRVLEEIERLLRELEERHKRLTERDKEVVKRLADRHREVSEEDRRVLEELKR

SEQ ID NO: 20054 - protein, 178 aa, Artificial Sequence; identical to SEQ ID NO: 20053
  Synthetic sequence.

SEQ ID NO: 20055 - protein, 178 aa, Artificial Sequence
  Synthetic sequence.
DEMEEVIRRIETLLKRVVDESDKVLEDIKRLLDRVVEESEKALETTRKLLEEVAELARTVDKREIAKIIREIIERNRTVLEEIARLIKEIIDRNKKALDELRDLARRIIRDLAEALKRGDLDEDEVRRVLERVKKVLDELAERHKELSKEIKRELRRLEKEHEDLSEEVKRLLRELER

SEQ ID NO: 20056 - protein, 178 aa, Artificial Sequence; identical to SEQ ID NO: 20055
  Synthetic sequence.

SEQ ID NO: 20057 - protein, 178 aa, Artificial Sequence
  Synthetic sequence.
DEMREAEEEIKRLLDTVKTESDRVLEEARKLTRRVEEESERVLRETKKLTDELRKLSRKRDKELVKKISEDTIRRNEEAVKRIRELSKESIKRNEDALERIKRLIKEIIDRLEDVLRRGDLDEERVRRVLKEIREVLDRLEKRHKKVSKDDKEVLERLEKEHKRLSREDEEVLRELER

SEQ ID NO: 20058 - protein, 178 aa, Artificial Sequence; identical to SEQ ID NO: 20057
  Synthetic sequence.

SEQ ID NO: 20059 - protein, 178 aa, Artificial Sequence
  Synthetic sequence.
SRMEKVEREIRTLLKEVEERSRKVLDESRKLTEDVERISRDALKKIKELLEEVRDLARTVDKKILRKLAREIIERNKEMLKEVRRLSKESLDRNERALEELADLARRIIEELEKALRRGDLDEKDVRRVLREIEELLKDLERKHKELTRRDEEVLKKLEDDHRRVSEEIEEVLRRLEK

SEQ ID NO: 20060 - protein, 178 aa, Artificial Sequence; identical to SEQ ID NO: 20059
  Synthetic sequence.

SEQ ID NO: 20061 - protein, 178 aa, Artificial Sequence
  Synthetic sequence.
SRAERVKEEIKKLLEEVRKESKRVLKEVKDLTKEVDDKSKKVMRDIRELLKEVEELARTVDKKEIRDRIRKIIERNERMLEELKRDSEESLKRNEDALREVKRLIEEIIERLERALRRGDLDAEEVKKVLREIEETLRKLEEEHRRLSDRDREKLDELAKRHKKVSRDIEEKLKELER

SEQ ID NO: 20062 - protein, 178 aa, Artificial Sequence; identical to SEQ ID NO: 20061
  Synthetic sequence.

SEQ ID NO: 20063 - protein, 177 aa, Artificial Sequence
  Synthetic sequence.
KEVEDVLDKVKKALEEIRERNKRVNDEIRRLLDEVRRRNEDADREIEEILKRVADEVRDTDLERIIEELKKRVEEVIRRSRRLAEEIKKTIEEAVRRTRKLAEDLKREIDDVLKRVETEELRERIKAVVEEVERVMDELRRSNEKVVREVEDVMRRLEERNRRTLERIEEVLERLKR

SEQ ID NO: 20064 - protein, 177 aa, Artificial Sequence; identical to SEQ ID NO: 20063
  Synthetic sequence.

SEQ ID NO: 20065 - protein, 181 aa, Artificial Sequence
  Synthetic sequence.
EEVERLLTKVRELVRRIEEENKKANDDSRKSLKEIKDRVEKALDDSRKSLEEIEKIVRRDNIKEKVRELAKRDRDLNREVLKEVRELLKRDEDLNRRVIDKTKKLMEDVERKLKEVLDRVDKEELKRRIETVIKEVRETIEELKKSNEESVRDSERTIRELEEEIKRTVRESEKEIKRLED

SEQ ID NO: 20066 - protein, 181 aa, Artificial Sequence; identical to SEQ ID NO: 20065
  Synthetic sequence.

SEQ ID NO: 20067 - protein, 181 aa, Artificial Sequence
  Synthetic sequence.
EEVERMADEVRRLNEEVRRRNEESIEEVKRLNDEIRKTNEKSIEDVKELLKRVKEVRERNQDKRRIRELIKRILERDEALVRKSERLAREVNRRDKEVVEESEKLIRDINKRIDEAVKRVDGGDAREKMKRLVEENTKSVEELKKRNEETSRRNTKSVREVTRRNEKTSDDVRRLVREEEQ

SEQ ID NO: 20068 - protein, 181 aa, Artificial Sequence; identical to SEQ ID NO: 20067
  Synthetic sequence.

SEQ ID NO: 20069 - protein, 181 aa, Artificial Sequence
  Synthetic sequence.
DEVEEAKEKVRRLNKELRRVVKEVEDEVRRLNEEVRREVEKVRDDVRKLRETIREVKARNVDDREIRKLAEEVIRRIRTVIEKIRRLIEEINKRIRRVAEEVKRIAEEINEEIKRVLDRVKSGSLEREIEKISRENTKSLRDLLDRLRRLVEENTKSVEELVRRLEELLERVEEEMRRLET

SEQ ID NO: 20070 - protein, 181 aa, Artificial Sequence; identical to SEQ ID NO: 20069
  Synthetic sequence.

SEQ ID NO: 20071 - protein, 177 aa, Artificial Sequence
  Synthetic sequence.
SRVETMVKDIRRLLEEVKERVERALRDNERVLEDIRRRVDELLKTNEKINRDIERRVRRGLDRDEIRKLLKESEDSVRRALRDVEELLRKSRETVERVKRLIERLLEEVKRIVETVARESDVEEIKEVLRRVEEEAERLKREIEESLKRSEDLVRKLKERIKRSLEESRKRIKKLED

SEQ ID NO: 20072 - protein, 177 aa, Artificial Sequence; identical to SEQ ID NO: 20071
  Synthetic sequence.

SEQ ID NO: 20073 - protein, 177 aa, Artificial Sequence
  Synthetic sequence.
SEVEEAVKRIRKIVKEIEERVRRLLEENRRVIEEVERINKEMLKRNKEINKEVEELVRRGEPRKVIEDLVDRSRRSVEESERLNEELVDESRRTVEEIETEIERLREELKRVVDKVREKREVKEIEDILRRAEETVEDLKRRIRRSLEDSRRVVEELAEENRKSLRESKKKVDELKK

SEQ ID NO: 20074 - protein, 177 aa, Artificial Sequence; identical to SEQ ID NO: 20073
  Synthetic sequence.

SEQ ID NO: 20075 - protein, 177 aa, Artificial Sequence
  Synthetic sequence.
SRVEDFVRRIRDLLRKIEEIARKALKENKDVLREIKRINDEMLRRNEEILKRAEDLVREGRDRTVIERMLEESERSVRDSERLNRELLRKSEETVRKLKKLIDDLLREIEKIVREVARERDVEEIKRILEEAKKTIDELRKEIEKSLREVEKAIRELEERNRRSLERSEDLVRELKR

SEQ ID NO: 20076 - protein, 177 aa, Artificial Sequence; identical to SEQ ID NO: 20075
  Synthetic sequence.

SEQ ID NO: 20077 - protein, 177 aa, Artificial Sequence
  Synthetic sequence.
RRVEEAVKRIKEILERVTRRVEKVLRDNKRVLDDIRRINEEMLKRNKEINRKVEELVREGRPRKVIKDLLKRSRESVEESERLNRDLLRKSEETVRRALKEIEDALKRIEELVREVERESDVEKIKEILEEVRRTIEELKERIRKSLEEVKELIKRMDEENRKSLEESDERARRAEK

SEQ ID NO: 20078 - protein, 177 aa, Artificial Sequence; identical to SEQ ID NO: 20077
  Synthetic sequence.

SEQ ID NO: 20079 - protein, 181 aa, Artificial Sequence
  Synthetic sequence.
SELEEIRERVKRVEEELRKNLKDAERRVREAKRRSEESLKDIEKKVKEVRDELKELARRGADRKDIRRIVKEIEKRIRDAAKRNEDIVRRVEEEIKRLVESNRTLADDISRRVKELLDRVTDGSAREDIKRLLKELEELLKRSEDEARRLLKEVRDLVDTTKKRIDKLLKEIEDLLREIER

SEQ ID NO: 20080 - protein, 181 aa, Artificial Sequence; identical to SEQ ID NO: 20079
  Synthetic sequence.

SEQ ID NO: 20081 - protein, 180 aa, Artificial Sequence
  Synthetic sequence.
KIEEKVEKLVRELLKELETVDREVNERVKRSNEKLEKIDRDVNKLVEDSNRKLKEISDRVKSDEARELIKRVLEESRKLVKEAKDLTKKVLDESEELIRRVLKVSRDVLDKAKKLIEKVLEERDVEKIKRLLEEVKKLVEDSERNIRELLKESRKKVEDSKRNLDRLLKESDDRVDRERR

SEQ ID NO: 20082 - protein, 180 aa, Artificial Sequence; identical to SEQ ID NO: 20081
  Synthetic sequence.

SEQ ID NO: 20083 - protein, 180 aa, Artificial Sequence
  Synthetic sequence.
ETEKEVEELVKRVLDKDKRISDESEERIRRLMEKNKKILEDVKRLVDEVREKLEDIRRRVKSKEMKDLIERVLEEAKELVTRAKKLDEDSLREVDKLVKDVDRLNERSLEEAERLVREVLRKRDVEKIKKLLEDVRRLIKRSKEKNDELLEELKRLSEETRETLDRLLKDLEDKIREAKK

SEQ ID NO: 20084 - protein, 180 aa, Artificial Sequence; identical to SEQ ID NO: 20083
  Synthetic sequence.

SEQ ID NO: 20085 - protein, 173 aa, Artificial Sequence
  Synthetic sequence.
DEKEDVDRLLRELEELVERSERSIRKLLEDNRKLAEDLKRTVEKLLEDNRRKVEEVRRTGADERKVDEVLKHSEEVIRRVKEDIDRVLKHSEEVIDRADKLTKAVLKEARDIVREVDSEELRKLIKRVLKKLRDLNRRVKELSRRSAEELKRLLDEVRKLSEDSLRELDKLRK

SEQ ID NO: 20086 - protein, 173 aa, Artificial Sequence; identical to SEQ ID NO: 20085
  Synthetic sequence.

SEQ ID NO: 20087 - protein, 173 aa, Artificial Sequence
  Synthetic sequence.
DEEKRVRDLLEEVREEVERSDKSIEELLRELEKAVKDSERTIRKLLEDNERMVREVRRKGVDDELVRRVLEHSEKLIREAKRLTDEVLREAKRIITEAKKLTKEVEKKVREIVKKVKSKEAEDLIREILEELKRLNEDVKRLIREVLETLKELNERVKKLVKESNDELRELAR

SEQ ID NO: 20088 - protein, 173 aa, Artificial Sequence; identical to SEQ ID NO: 20087
  Synthetic sequence.

SEQ ID NO: 20089 - protein, 173 aa, Artificial Sequence
  Synthetic sequence.
REEEKLDKLRKDLEKRVEESKRSIDKLLEDNRRRVEESKKTIEKLLEDNKRRVDEIKKRGVDDELVRRALEHSKKLVDEAKELTKRVLEKSKRIIDRAKELTKRVERKVREIIKKVDSDEAEKLIRDVKKELDRLNEEVKKLSEDSLKELDDLNREVKELMERSNRKLDEDAK

SEQ ID NO: 20090 - protein, 173 aa, Artificial Sequence; identical to SEQ ID NO: 20089
  Synthetic sequence.

SEQ ID NO: 20091 - protein, 175 aa, Artificial Sequence
  Synthetic sequence.
KEVEDVLREIKKLIKEIHEKSKRALDETRELLERIHRTTRRVLEEIRRLLKEVEELAKAGMDKREVRRRVKEIIDRLREMLERSRKLWKDIEERDKRLLEEVERLWDEIRRELRERAGDKDRVEDLVRELERVVKEDKDRSKESEERIKKLVEDDTREAEKLIRELEKILEDTEK

SEQ ID NO: 20092 - protein, 175 aa, Artificial Sequence; identical to SEQ ID NO: 20091
  Synthetic sequence.

SEQ ID NO: 20093 - protein, 175 aa, Artificial Sequence
  Synthetic sequence.
SEVEEVLRDIDRLAKEIHKRSRDVLRDIDRLLKEIHERSRRMLERIKRLLDEVRRLVEAGVRKEEIKELIERILRDLKRVVDEVAREWEEVIKKLRKALEESRRLWEEIIKKLEREAGDRDRLRELVERLERLLETDKREIEKLIKKLEEMLEEDERRARELLEDIRRILEEIKK

SEQ ID NO: 20094 - protein, 175 aa, Artificial Sequence; identical to SEQ ID NO: 20093
  Synthetic sequence.

SEQ ID NO: 20095 - protein, 175 aa, Artificial Sequence
  Synthetic sequence.
SEVEEVTKEIKRLVEEIHKRSREALEETRRLVETIHRDSKRVLDEIERLLEEVRKLAEDGVDKRDIKRLAKEILKRLEDMMRRVTELWKEIIERDRRLLEESKKRWDEVIEELRRKVRDEKRVRDLLEKLREDAKRDEDASRKSEEDIRKVVEEDKREAEKLLKRIEDELRKTEK

SEQ ID NO: 20096 - protein, 175 aa, Artificial Sequence; identical to SEQ ID NO: 20095
  Synthetic sequence.

SEQ ID NO: 20097 - protein, 175 aa, Artificial Sequence
  Synthetic sequence.
SEVEKVLKDIRDLVKKIHDESKRVLDEIEELVRRINKRSRDALREIRELLRTVTELAKAGLDKREVEKLAKRILERLREVLEESRELWERVIRRLKEAMERVRELWERVIRELRKKVGDKDRVRKLVEDLERMLRRDEAEAEKLIKKLRELLEKDRDDIRRLLEDIKRILDEIRK

SEQ ID NO: 20098 - protein, 175 aa, Artificial Sequence; identical to SEQ ID NO: 20097
  Synthetic sequence.

SEQ ID NO: 20099 - protein, 175 aa, Artificial Sequence
  Synthetic sequence.
EEVERALDRARRLLERIHETSRDVLRRTEELLRRINEESRRVLKEAKELLDRVEKLVRDGLDKREVRRLIEEIVRRLEKVLKESEDLWREVIRTDKEMLDEVRKLWEEIIERLRREVGDKDRVEKLERELEKVVREDEEESKKSIRRAEEMLRKDREDIRRLLEEIKKILEDIDK

SEQ ID NO: 20100 - protein, 175 aa, Artificial Sequence; identical to SEQ ID NO: 20099
  Synthetic sequence.

SEQ ID NO: 20101 - protein, 175 aa, Artificial Sequence
  Synthetic sequence.
SEVEDVLRKAEELAKRIHDRSRKALKETEELLERINRDSERVLRESEKLLEDVRRLAEAGVRKEEIKKLAEEILREDKRVLDESKRLWEEILRRDRKLLDEVRRLWEEIIRRLRRELGDEKTVRRLVDKLRRLVEEDTDESRKSEERIKKMVEDDKRESEKSLKRIKDIMKEITD

SEQ ID NO: 20102 - protein, 175 aa, Artificial Sequence; identical to SEQ ID NO: 20101
  Synthetic sequence.

SEQ ID NO: 20103 - protein, 176 aa, Artificial Sequence
  Synthetic sequence.
SEVERVLEENERTLKRIEETAKKVLEEIEKLSKEVEDRAREVLDRVRRISEEVRRDVRSKEVERIIREIDKESERVLRELEELIKEISRKIEEVLREIERLARESKDRVRKAMKDIDEEMRDRVRKLIKRNDEVLDRVRREIEKLHRRNKKILDDLRREIERLNRENKRLLDELRK

SEQ ID NO: 20104 - protein, 176 aa, Artificial Sequence; identical to SEQ ID NO: 20103
  Synthetic sequence.

SEQ ID NO: 20105 - protein, 176 aa, Artificial Sequence
  Synthetic sequence.
SEVEEVLKRNEKTLKEIEERAREVEETVRELSERIRKRNEEVNRELEERSKRIRRDVRDKDVERLIRKVDEDSKRTLAETEKLIREVSEVIKRALEEIERLIRDSLEKVKEMMRDVDKEARDRADELLKRNREVLERLRKRIEDLHRDNKRVLDELRRSNEETNRRNRKLLEELRK

SEQ ID NO: 20106 - protein, 176 aa, Artificial Sequence; identical to SEQ ID NO: 20105
  Synthetic sequence.

SEQ ID NO: 20107 - protein, 176 aa, Artificial Sequence
  Synthetic sequence.
REVEEVLKENEKTLREIERRMEEVLKRVEDLSDEVRRRVDEVLRRVEETSKEIAKRVRGEDVKRLIEDVDRRSREALREVEELIKRIDEVSERALRELEELIKRSLDRLAEVMKDVDEEARKRAKDVLDRNRDVLRRLKDAIDKLNKRNKEILDRLRRKIEDLNRRNEELLRRLEK

SEQ ID NO: 20108 - protein, 176 aa, Artificial Sequence; identical to SEQ ID NO: 20107
  Synthetic sequence.

SEQ ID NO: 20109 - protein, 176 aa, Artificial Sequence
  Synthetic sequence.
REVEEVLDKNRKTLREIRKRAKEVLDRVEELSRRVREENERVNRELRKISEEIARKVRDKEVEKLIREVDERSKRTLETTERLIREIDERSKKVLDELRKLVKESLELVERAAKDVDEEMKKEADKLLKENRDVLRELERRIEELNERNRRVLKELEESNRRTNEENKRLLDELRR

SEQ ID NO: 20110 - protein, 176 aa, Artificial Sequence; identical to SEQ ID NO: 20109
  Synthetic sequence.

SEQ ID NO: 20111 - protein, 176 aa, Artificial Sequence
  Synthetic sequence.
DEVETVLDENRRTLKRIRERVDKVLKDVEKLSREVEDEIRRVLEEVEKELKDIERDVRDKDVERLIREIEEKIKRALEKIEELIRRIDERSREALEEVKKLIEDSLKRVEDAMRDVDEDAREKAKRLLEENKRVLKELEERVKRLNDKNRRILERIKKRIEDLRRRVKELLKKLRK

SEQ ID NO: 20112 - protein, 176 aa, Artificial Sequence; identical to SEQ ID NO: 20111
  Synthetic sequence.

SEQ ID NO: 20113 - protein, 176 aa, Artificial Sequence
  Synthetic sequence.
DEVERVLEENERTLRRVREIIREVLEEVRRLSEEVKRRIDEVLKENEDTLKKIKDEVRSEDVRRLIEESLELVKRVLEEVRRLIEAVDRESERVLKEVEDLARESERLVREVAKDVDKKARDRVREVEKRNRDVLEEVKDEIRKVNKDNRDILRRIKKDVEELLKRNEKVLRETEK

SEQ ID NO: 20114 - protein, 176 aa, Artificial Sequence; identical to SEQ ID NO: 20113
  Synthetic sequence.

SEQ ID NO: 20115 - protein, 176 aa, Artificial Sequence
  Synthetic sequence.
RELEELLKRNERTLRELAKRVKRLLEENKETVRRIEERLRRVLTEVEKISRDIRDRVDSEDLRRLLEELDKRSKEVVEEIEELLRRSLKRLKEVLDEIRKLVKESLEEIRRAAKDVDEEVRERVKKVEDENRKLLERAEREIKKVAEENRRLMEKMKDDVRKANKRNKELLERRTK

SEQ ID NO: 20116 - protein, 176 aa, Artificial Sequence; identical to SEQ ID NO: 20115
  Synthetic sequence.

SEQ ID NO: 20117 - protein, 176 aa, Artificial Sequence
  Synthetic sequence.
SEVEKVLRENEKTLREIEREIDRVLRDNERTLKEVRERNEEVNRRVEEDSKRVKDEVRSKKVEEVIKRIDERSKETLRETVERIEESLRRLKKALDDVRDLIRRSLKRVEEAAKDIDEKARERIKRILDENRKVLREIERKIREVLERNKKVLEEVRKSNEETNDRNRKLLEELRR

SEQ ID NO: 20118 - protein, 176 aa, Artificial Sequence; identical to SEQ ID NO: 20117
  Synthetic sequence.

SEQ ID NO: 20119 - protein, 183 aa, Artificial Sequence
  Synthetic sequence.
SVDERVEDLRRDVERVLRELRKSNEESIRRSEEIVTRLEEELKRNSKEVEEVLKRLEDELKDDEDKLREVRELIERVKKTNEDVLRRVRELIERDEEVNRRSLTETDDLIRRVRKVVEEARRLTSKDLEKALRDVEKLIREIRERNKEMLRRSEEILKEIEKRARDMSRESKRLIEDIERRTK

SEQ ID NO: 20120 - protein, 183 aa, Artificial Sequence; identical to SEQ ID NO: 20119
  Synthetic sequence.

SEQ ID NO: 20121 - protein, 183 aa, Artificial Sequence
  Synthetic sequence.
SVEEKVDRLKRRVEEVLKELKKSNEDNTREVREALKRLKKAIEESIDRSRKILEDLRRKLKDDEKKLREVEELIKRDEETNRRVLRRVEELIRRVEEFNEESLRRTERLIEEVKKVVDEARRLTDEDLERALKEVEELIRRIREENKEMSERSKKIIRKIEKDVKKALDDSERVLREIAERTK

SEQ ID NO: 20122 - protein, 183 aa, Artificial Sequence; identical to SEQ ID NO: 20121
  Synthetic sequence.

SEQ ID NO: 20123 - protein, 183 aa, Artificial Sequence
  Synthetic sequence.
DVEKKVKELLDEVRDALRRLRKSNKDNTDEVDRALRELEETNKKSIEDSRRIVEDLKRKLKDDEDVLREVEELIRRDEETNKRSLEEVKDLIKRVRDVNEESLRRTEDLIRRVEEKVKEIERLTDREADKVLKRVKEEIERIERENRRMSEKSERLIREIRKRNKEMLDRSKKLLEDIKRRVT

SEQ ID NO: 20124 - protein, 183 aa, Artificial Sequence; identical to SEQ ID NO: 20123
  Synthetic sequence.

SEQ ID NO: 20125 - protein, 180 aa, Artificial Sequence
  Synthetic sequence.
KEVEEILTESEDMNRKIDKLVKEILDESEEMNRRIRELVKRIVEELRELLREIRRLAEERDKDDVLRRLKELLKEIKEKARKVIDELRRLSEEIKKKIDDVLDELRRASEEVERKIREDKNEEVRDRLRRSHEKNKEVLDRIRKRVKESHEKNEKSLREIEETVKKLERDVERLLREIKR

SEQ ID NO: 20126 - protein, 180 aa, Artificial Sequence; identical to SEQ ID NO: 20125
  Synthetic sequence.

SEQ ID NO: 20127 - protein, 180 aa, Artificial Sequence
  Synthetic sequence.
EEVERILKESRDANERIKKLVEDILRRSKELNERIRDEVRKILAKSEEVNRRIRRLAKERDKEEVLRRLEEMSKKVKKEIDEVIEKLERLSEEIRRRIEEVLERLKRMSEEALEKIKEDKNEEVKEKAKESHKENKKVLDRIKRELEKSHEENKKSLDEIRDRVRRSHEKNRKVLEEIRK

SEQ ID NO: 20128 - protein, 180 aa, Artificial Sequence; identical to SEQ ID NO: 20127
  Synthetic sequence.

SEQ ID NO: 20129 - protein, 180 aa, Artificial Sequence
  Synthetic sequence.
EEVERILKESEDMNRRIRDLVRRIAEESDKVNREIRKLVDEIRRKLDRVLREIEDLIRKRDKEEVLRRLRKLLEEAKEEIERVLKRLEDASREVAKKIRDVLEELRKMSEEVLEKVKEDKNEEVKKRAEKSHRENEKSLREIRKELEELHRKNKKSLEEIRKTLRKLEEKVRKLLEDLRR

SEQ ID NO: 20130 - protein, 180 aa, Artificial Sequence; identical to SEQ ID NO: 20129
  Synthetic sequence.

SEQ ID NO: 20131 - protein, 180 aa, Artificial Sequence
  Synthetic sequence.
SRVEEILRESKRMNDEIREKVKKILKTSRDMNKRIEDRVREILKKSEDLNRKIRKLIDDRDKKEVVDTLRELSKEIEKEAREVIEELERISKEVHDRAREVIKELEEISDDVRRKAERDDKEEAKRELEKSHKTNEKVLRDIERRVEDSNRENEDSLRKIERAVTESHRRNEEVLERLER

SEQ ID NO: 20132 - protein, 180 aa, Artificial Sequence; identical to SEQ ID NO: 20131
  Synthetic sequence.

SEQ ID NO: 20133 - protein, 180 aa, Artificial Sequence
  Synthetic sequence.
EEVERILEESKRLNDEIRRKVDEILRKSEEINERVRRLVEKIRTDLERVLEEIRDLADKRDKDEVLKRLEDALKEALDRARKVIRELEEMSKEIEDEIRKVLEELERLSREVERKLREDDKEEVKRRLEESHKDNDRVLKEIERRVRESLRRNRESLRRIDEKVKELERRVEKLLREIKK

SEQ ID NO: 20134 - protein, 180 aa, Artificial Sequence; identical to SEQ ID NO: 20133
  Synthetic sequence.

SEQ ID NO: 20135 - protein, 180 aa, Artificial Sequence
  Synthetic sequence.
EEVERILDESKKMNDDIRRKVKEILDESEKLNEDIRRLVKEILEKSKRVNDRIRKLAKDRDKEDVLRELKKMSEDVLDDARKVLETLKKLSEDVRRKIREVLKELEKASREVERKVREDKNDEVRRRAEKSVRENDKSLKEIEDEVRRSVEKNEESLKRIEDEVRKSHEKNKKVLDEIKK

SEQ ID NO: 20136 - protein, 180 aa, Artificial Sequence; identical to SEQ ID NO: 20135
  Synthetic sequence.

SEQ ID NO: 20137 - protein, 180 aa, Artificial Sequence
  Synthetic sequence.
SKAEEVLKEIRERIERIRKRAEDVLRHDEESLKRAEEVNRKMEKESRRINEEIRDRVRKEGGRDKEKVDRLLEELHRVDEESIRIVERLLEHNRKSTEDIKDEVRKLLERLKEVIDEVRRAGVDEKDVRKVEDDIRRVIKKLKEELDRSADKSRDVVRRLRDSNKKLNDKNRRDIEEIKK

SEQ ID NO: 20138 - protein, 180 aa, Artificial Sequence; identical to SEQ ID NO: 20137
  Synthetic sequence.

SEQ ID NO: 20139 - protein, 180 aa, Artificial Sequence
  Synthetic sequence.
DSEEEVRERIRKIIEDVKRIIEEVLRRDDKILKEIEKRNRDMLKRSKEINKEARDRVREAGNRLKEEIRKLIKELHDVDRESIKRVEDLIREVRKSSDKAEEEVRRMLKRLKDVVDTVRKAGVDDRSVRELERRIKEVIDELRELVERSKRKVDKLLKDLTRSNEKVNRENREDLERLEK

SEQ ID NO: 20140 - protein, 180 aa, Artificial Sequence; identical to SEQ ID NO: 20139
  Synthetic sequence.

SEQ ID NO: 20141 - protein, 174 aa, Artificial Sequence
  Synthetic sequence.
DDERRAKKAAEDAAKRLKEIAEKAHRISEKALEELKRINDDANKISEDALRRLEKLKKEGAPEEAAERAARDSLRLIREAAERSREAAERSLRLIEEAAKEAEDAARDALEIIKTLAKSEEAKELAKKIKEIADEARKRAEDNARTNKEAAERSKENADRNAEENKKAAEKAKR

SEQ ID NO: 20142 - protein, 174 aa, Artificial Sequence; identical to SEQ ID NO: 20141
  Synthetic sequence.

SEQ ID NO: 20143 - protein, 174 aa, Artificial Sequence
  Synthetic sequence.
KDEDEVRRRVEELLKRNKELVEEIHKLSEDALRDLERINEEVNRISDEMRRRLDKLKKDGIPEEVLEDVVRRSLELIERLLRESRKVAEDSLRTIKEMLKRSEDIVRRVLEEIDRKIKSEEAKKLKERVDRSLKESEKEVRENLERNRKLLDESRRNAEENLRENKRVLDELRR

SEQ ID NO: 20144 - protein, 174 aa, Artificial Sequence; identical to SEQ ID NO: 20143
  Synthetic sequence.

SEQ ID NO: 20145 - protein, 174 aa, Artificial Sequence
  Synthetic sequence.
SEEDEVRERVKRVLDELRKINEDLNRISREMLERNKDILRRIHEISKRALDKLKKLKEDGVPEDDLRRVVEDSLRLIKEALERSERLVRTSLKLIKDMLRRSEEVARRILDDIRKRLKSEEVRKLLEEVKDSLRKSEENARRNLDENRRSLKKSEDEVRRNLEENEDTLRKLEK

SEQ ID NO: 20146 - protein, 174 aa, Artificial Sequence; identical to SEQ ID NO: 20145
  Synthetic sequence.

SEQ ID NO: 20147 - protein, 182 aa, Artificial Sequence
  Synthetic sequence.
DEMDEVRRTIKKLDKDSRDKVRTVEEKIRRLDEESRRENEEIVRKIEELLEEIERRVRSSTDERVLRELVRRLKEVLDRVEKDSRETIKKNKRALDKARREIEEILKENEKALDDAKKVVDELNIDEKEVKKIKEESDESLKEIEKLLREIEEESKRSLREMEKTLEDIERRVRRVLEEIKR

SEQ ID NO: 20148 - protein, 182 aa, Artificial Sequence; identical to SEQ ID NO: 20147
  Synthetic sequence.

SEQ ID NO: 20149 - protein, 181 aa, Artificial Sequence
  Synthetic sequence.
SIEELAKRNEEENEKAAEDVERLAEEVKERAERVARESEKLAREAEKEAERVAREIRRDRSDDKDAARLVEEAAKEARRAAEESARLIEEAAKKAEKAAEDVKREIKKTAEDLKRAADKAETEEAAKRASEENRKAVRDAREKARRAAEEAKKLLDEARKHSEEAAKRAKELLEEAKKRAD

SEQ ID NO: 20150 - protein, 181 aa, Artificial Sequence; identical to SEQ ID NO: 20149
  Synthetic sequence.

SEQ ID NO: 20151 - protein, 181 aa, Artificial Sequence
  Synthetic sequence.
KIEELMKRNEKENREVLERVKELADRNRRENEEVVKKSKKELDDLKRKIEEVLERIKRERKEMKEVEKLVREVLKRIEDLIRESVDRIRRTVEELEEVAKDVERKIRETIRRLRELAKRLETEEVVEKVSRENKKLVADIEDEVRRASTRNKKLVKDIEKHSEDVVRELEKLLKDIKDKVD

SEQ ID NO: 20152 - protein, 181 aa, Artificial Sequence; identical to SEQ ID NO: 20151
  Synthetic sequence.

SEQ ID NO: 20153 - protein, 181 aa, Artificial Sequence
  Synthetic sequence.
SIEDEARRNEKRNREVLKRSKDLLDEIARKIEEVEKRIRDLVKRVKEEIDEVLRRIKRERPDLKDVIELVKRVAKTARDMIEKLEDELRKILEEVTKLIEESEKRIKETVDRLKEAVKNIEDDELLRRVSKENEDLVREIEDHTRRVLETIERKLRRVEEKVETVVREIKRRLEDIERRVK

SEQ ID NO: 20154 - protein, 181 aa, Artificial Sequence; identical to SEQ ID NO: 20153
  Synthetic sequence.

SEQ ID NO: 20155 - protein, 174 aa, Artificial Sequence
  Synthetic sequence.
EEVDRVIERIKRLLEEVERKIRRASEKNRRLIEKSRKELEKVSKENKDLIDRVRELRDAGVDKREIKDLLRRISEEMKKVIDELKRSNEKVSEELRRMLKEIREDLKRIVDEARERVKGEKVKTVEKEIREVIERADEIIERNERENKKSVEEIEEILERNKRRNEEALREVDK

SEQ ID NO: 20156 - protein, 174 aa, Artificial Sequence; identical to SEQ ID NO: 20155
  Synthetic sequence.

SEQ ID NO: 20157 - protein, 170 aa, Artificial Sequence
  Synthetic sequence.
DELDRAIEEVKRLLDEIRRRLEKVVREVRKLNEEIREDLRRVVEEVRRTNKEIRDRVRSEEARRLAEESLRLLEEALERIRRLIERSLRRIRRLLEEIEKLARDILEEIRRIIDSDKVRRLEREVEELLKTVEELIRRLEEHTRRVLKEVDEEIKRLKEHTEKVLRDVEK

SEQ ID NO: 20158 - protein, 170 aa, Artificial Sequence; identical to SEQ ID NO: 20157
  Synthetic sequence.

SEQ ID NO: 20159 - protein, 187 aa, Artificial Sequence
  Synthetic sequence.
SAEELVKELERRIEELLKELEEIVRRNRKHSEDVLRKIKELVRDVLRRVKEALKDLTKKVRTREVRKLVEELIERLEELIERIDRTAERLITESRRTLEEIRRRIKELIDDLRRLLREIKKEVDRGLDEDVVRKLIKEIDDRLKEVKKEVEKLSDENRRLNEDVERRIKELLDDIERLLKEIRDTVT

SEQ ID NO: 20160 - protein, 187 aa, Artificial Sequence; identical to SEQ ID NO: 20159
  Synthetic sequence.

SEQ ID NO: 20161 - protein, 187 aa, Artificial Sequence
  Synthetic sequence.
DVEDIVRRIRERVKEALERLRKTNDDNRKHSEEVLRKLAESDKRTMERIERVLEELRRRSRTREVTKLVEDAIEKLRRRVRESHERVKRLFEDSKRTVDESLERVERAIEELKRVIDEVEELARRGLPKEVVREMKRKIEELLKRIEDENKRLSDENRELNKRVEEDNRRLNKEIEDELRKVEEDVK

SEQ ID NO: 20162 - protein, 187 aa, Artificial Sequence; identical to SEQ ID NO: 20161
  Synthetic sequence.

SEQ ID NO: 20163 - protein, 187 aa, Artificial Sequence
  Synthetic sequence.
DLEELVKELEKRIEDVLRTLRKTNKDNEKAVEESLRKLEDELRKLKEKIDRLLDKLTKESRTEEVEKLVRELIRELREVVRRIEELIRDMARRSKESVETSLELVERLIKKLEELLRRVLELVAKGLPEEVVRRIIEDIRRLLEEVKKVNEDLSEENERLNRDAERRVREAIKEVEDLLDEIEKTVR

SEQ ID NO: 20164 - protein, 187 aa, Artificial Sequence; identical to SEQ ID NO: 20163
  Synthetic sequence.

SEQ ID NO: 20165 - protein, 187 aa, Artificial Sequence
  Synthetic sequence.
SVEDELRKLEEKIRRLLEELRRTNDENRRHSEKVLEELRRELEKLKRRIEELLRKLREESRTREVTKLVEDLIRKLRELVERIEREVEKLVRDSRRTVEESDKLVKDVIKRLRELVREILKLAREGRPEEVVERLIRDVERKLREVKKENDRASKENEDLNREVKRRAEKLLRDVERLLREVEKTVK

SEQ ID NO: 20166 - protein, 187 aa, Artificial Sequence; identical to SEQ ID NO: 20165
  Synthetic sequence.

SEQ ID NO: 20167 - protein, 187 aa, Artificial Sequence
  Synthetic sequence.
SAEDRLRELEERIRRALKELEDTNRRNEEHSKKLLEELARSDRETEEEIKEALKRLTERKRDEEVEREIKEMIRDLERVVRESHRTVRELVKESERTVKESLERVKRAIDELRRIVEEIRKLIEEGLPEEVVDRLIREVEERLRDVRRLNEELSKRNKELNDRVREVNEELNRRIKKRLEEIKRRVE

SEQ ID NO: 20168 - protein, 187 aa, Artificial Sequence; identical to SEQ ID NO: 20167
  Synthetic sequence.

SEQ ID NO: 20169 - protein, 187 aa, Artificial Sequence
  Synthetic sequence.
SLEDLVRTIREEIERLMKEAEDTNRRNKEESEESLRRLKKLVEDIDREVKEVLDRAEKNTRTDEVREKVRRMIESLRRDIEEIRKRIEEAVKKSEDVVRKSLEEVRRAVKRLRDLVDKILELVEKGLPEKVVEELIRRIKDELKKIRERNKELSDRDKKLNEDVEREVRKLIDEIRKKLEDVERTVK

SEQ ID NO: 20170 - protein, 187 aa, Artificial Sequence; identical to SEQ ID NO: 20169
  Synthetic sequence.

SEQ ID NO: 20171 - protein, 180 aa, Artificial Sequence
  Synthetic sequence.
REVDKVREDVKRLIKEIEDRVRKVLKEDEDLIRELRERVKKVSKENKEVVKTLRELVRDLRGKRERIREVIKRADELLERAEKEVRKVIDDLRKTTEDALRDLERIIREAKKTVDDVLRRRGIREELVKELEKRIREVLERLRRLIERSKEEIDRVLREVEEDVRRNKEENKRLLEEAER

SEQ ID NO: 20172 - protein, 180 aa, Artificial Sequence; identical to SEQ ID NO: 20171
  Synthetic sequence.

SEQ ID NO: 20173 - protein, 178 aa, Artificial Sequence
  Synthetic sequence.
DEKDKVRKTVEDILREIEKIVEDLVRRNERVDREIRERVRELLRRDDEILKRMEEVKRRRAPEEVLEEIAERLRRSSEEVLKLIRELIRRLKETVKDAERLIRELIKRLAEVVDTARKEGVEEREVTKLKEDIDRLLEKLERDLDELRKRNDELLKELEDRVRKSKEKVEKILRDVRR

SEQ ID NO: 20174 - protein, 178 aa, Artificial Sequence; identical to SEQ ID NO: 20173
  Synthetic sequence.

SEQ ID NO: 20175 - protein, 181 aa, Artificial Sequence
  Synthetic sequence.
SIEDKLRELKERHKELSKRIKEELERLTEEHRRVSEKIRKSLEEDKRRADKVLERIRRERSDSEKLVRDLEKVLRDVERLYREVIKRNEEALDRVRRLVEEIIERNERMLRKVEELARRIKTEDVLRKVEEDSREVLKDSKRLLDEVATRSEEMLRRSEELLKRIHETSKKVLDEIKTKLK

SEQ ID NO: 20176 - protein, 181 aa, Artificial Sequence; identical to SEQ ID NO: 20175
  Synthetic sequence.

SEQ ID NO: 20177 - protein, 181 aa, Artificial Sequence
  Synthetic sequence.
SIEDLARDLERRHKELSEDDKRKLDELRKRHKDVSDEARRSLERDERRVEKVEREITKRRSDDKDVVTELRKVLEEIRRLYETVVRDNERVLRDIERLSRRTIEENKKVLDELRELARRIKTEKVLDDVRRRSDKMLEDSRRLTREVEETSKEMLERSRRLLEEIHKESDRVLREARERDR

SEQ ID NO: 20178 - protein, 181 aa, Artificial Sequence; identical to SEQ ID NO: 20177
  Synthetic sequence.

SEQ ID NO: 20179 - protein, 177 aa, Artificial Sequence
  Synthetic sequence.
RIEDILRRLEEHHRRLDKENKEILERLKKHHEEVLRKIKEILERLEREARDIERKIRELEEVLRKIREILERVKELADRLLEEVERSLREVEKLIRTSSDLIRRSLETVKRAAERLETDEVVEKVVREVEDTNEKIRRRSDEVRKEVEDTNRRIDKRLKEVEEEVRRLLDEVRKESE

SEQ ID NO: 20180 - protein, 177 aa, Artificial Sequence; identical to SEQ ID NO: 20179
  Synthetic sequence.

SEQ ID NO: 20181 - protein, 175 aa, Artificial Sequence
  Synthetic sequence.
SELEDVAKKAEDLLTKSAEILKEVVDRHRRLNERSEDEARRVEEEHRRTNKKLLDLARRGDRDKEEVKRIIERSLDRVREVFKRVKRLNDESLKEVERVIEEVRRLNEEILKTVERDVDSEELRKLKKRIEDISREHERILRELREHVERVSDKHRKILKELEEDVERILREVTK

SEQ ID NO: 20182 - protein, 175 aa, Artificial Sequence; identical to SEQ ID NO: 20181
  Synthetic sequence.

SEQ ID NO: 20183 - protein, 175 aa, Artificial Sequence
  Synthetic sequence.
SEIEKVVEDIKRLLEESKDRLRKAEEEVRDLSRRSREKLRRAEEDIKRLLDEIERMLRAGERDKKEVEDIIKEIVDKVRTVATDVERLNKEILERVDRLIEELRRLNEEILDRVRKDIDSDELRKLAEEIERVSEEHKRILDELRDHLRKNTKDVRDILRELEKEAERLLRELRR

SEQ ID NO: 20184 - protein, 175 aa, Artificial Sequence; identical to SEQ ID NO: 20183
  Synthetic sequence.

SEQ ID NO: 20185 - protein, 175 aa, Artificial Sequence
  Synthetic sequence.
KDVEDVLKRVKDVNREVEKRLEKVIRDDEKINEEINRRLDEMAERVKRVNETVEDIARKENIREKLEELIKESEDTIRKVLREVEELVRELRKTVDDALEEARDLVRKSEELIERIVRKEKLVEELRRESDTSKKRVEKLIRELKEKNKRSEERARRIIEKLKKESKDSLKRVKD

SEQ ID NO: 20186 - protein, 175 aa, Artificial Sequence; identical to SEQ ID NO: 20185
  Synthetic sequence.

SEQ ID NO: 20187 - protein, 174 aa, Artificial Sequence
  Synthetic sequence.
EEKEILDELEKEVRDLNRKNKEILRRLEETARDLHRRNEEILDRIRKRVEELKRRVREVRELLDEIRRILEEIKRLIEAVSRKIKKVLDDVRRLIKEVDDKSRDVLRRVERLIRQNVDKDTVAKEAKRLIRDLERLSREIEERVRRLIEEVKEESERIRERVTRLIKEVEDRRK

SEQ ID NO: 20188 - protein, 174 aa, Artificial Sequence; identical to SEQ ID NO: 20187
  Synthetic sequence.

SEQ ID NO: 20189 - protein, 174 aa, Artificial Sequence
  Synthetic sequence.
DDEEILKELEERVKKLHEKNKRILEKLKREVERLNDENRRILKEVKEDVDRLLKEVKEDKDLLEEIKRALERIERLMREVDKRSREALERVKDLIRKVSRRIEEALEEVRKLITQNVDSETVARRVEEMIKEVEELSKEIEERAKRLIDRLRELSKRILEELKRLLEEVREKRR

SEQ ID NO: 20190 - protein, 174 aa, Artificial Sequence; identical to SEQ ID NO: 20189
  Synthetic sequence.

SEQ ID NO: 20191 - protein, 174 aa, Artificial Sequence
  Synthetic sequence.
REEDEVLEDARRLSEESRKKLREVERRAKELSDRSRKRLRDVKRRVDDALRKIEDLRRRGVDKRDVLRVVEKVRDDVEKLIREVKDLNRRILEEVRRLIKEVEDLNKEVLDKVRRELKSEKLRELEEEIRRNSKDVKEVMKELDKHIKRNSEEVDKVLKELEERLKRLLDRVRK

SEQ ID NO: 20192 - protein, 174 aa, Artificial Sequence; identical to SEQ ID NO: 20191
  Synthetic sequence.

SEQ ID NO: 20193 - protein, 174 aa, Artificial Sequence
  Synthetic sequence.
SDEDRVKDKAEELSRRSREELERVKEEAKRLSDESKKRLEEVTRRIEKVLREIRELRERGVDKREVKRVVDEVVDTVRKLIKEVEDLNREVVERIKELIKEVERLNKEVLDEVERELKSEKLRRLREEIKKNSDEVKKVLRRLEENLRDNTRRVREVLERLEDEARKLLKDVKK

SEQ ID NO: 20194 - protein, 174 aa, Artificial Sequence; identical to SEQ ID NO: 20193
  Synthetic sequence.

SEQ ID NO: 20195 - protein, 174 aa, Artificial Sequence
  Synthetic sequence.
SEVDDVLRRLKELSERSEKTLEDIRDEAEKLSKESEDLLREVLRRSEKVNEDIRRLREKGVDKRDVAKVVEDALRESEDLIRKVEKRNEEVLRRVEELIKRVEDLNREILRRVDEELKSRRLEKLRREIEDNSRRVREVLKRLKENIKRNTDRVREALKRLEREHEEVLREVET

SEQ ID NO: 20196 - protein, 174 aa, Artificial Sequence; identical to SEQ ID NO: 20195
  Synthetic sequence.

SEQ ID NO: 20197 - protein, 183 aa, Artificial Sequence
  Synthetic sequence.
SIEEAITRLRKEVEDSNKRSEDVIRELHERDKESLEEVREIIKRLKDKVRTLLEEVDKRVKSERLERVRRLLERVDRVVDKVLRELKKLVEDSNELVKKVATESHKINEDIKKVVDDAARRIETEEILKEVLKRLRKLLEDNERVLDEARRRVEKTNEEIKEVLKRVAEEVDRLIKEVREEVE

SEQ ID NO: 20198 - protein, 183 aa, Artificial Sequence; identical to SEQ ID NO: 20197
  Synthetic sequence.

SEQ ID NO: 20199 - protein, 184 aa, Artificial Sequence
  Synthetic sequence.
SIDEIIEELRRRIEELRKEAEKIIRDSKKHLEDNKRDADRVIKESKEEVDKLLKEIEEAPISEELLRRVRDVIRRIEESTKKALEDIKRTIDEIKKSTDDALRTVREVIKRIRDLVDDVRKRIRTEELLEEVRKRIEDLLRELRDILRKLLERDKRLSKESERLVREMLREDRRLLDELRKEVK

SEQ ID NO: 20200 - protein, 184 aa, Artificial Sequence; identical to SEQ ID NO: 20199
  Synthetic sequence.

SEQ ID NO: 20201 - protein, 184 aa, Artificial Sequence
  Synthetic sequence.
SIEEIIRDLRRHIKENAEEAEKVIKESEDHLRENKKRAEDVIRRLEEELRKLAERVRRAPISEELLRRLEELIEELEKLVRDALRAIEKTIKDIEDSTRRVLEKIKETVKRLKELVDEASRRIRDEELLKRAVDAVRKLSEDSKRLVEEALRRDEELSKRSRDLVEEVRRRAEELLRRIEETVK

SEQ ID NO: 20202 - protein, 184 aa, Artificial Sequence; identical to SEQ ID NO: 20201
  Synthetic sequence.

SEQ ID NO: 20203 - protein, 178 aa, Artificial Sequence
  Synthetic sequence.
SSKDDVRRRMKEINERDKRLLDEVLRRLEKLIEELKRHTEEVERDADRIIEEIERMLRNGASEETAKRLLEELREKLEDVRRRDEKILEDIRRDVERALRESEKSLDELRRALEKVKDDGSVEERIIKEIRDLIRENEERNKEIVRRIEELLRELEKRSRDVIKRIREKLDRLRKRVE

SEQ ID NO: 20204 - protein, 178 aa, Artificial Sequence; identical to SEQ ID NO: 20203
  Synthetic sequence.

SEQ ID NO: 20205 - protein, 178 aa, Artificial Sequence
  Synthetic sequence.
SKVEEIERRIREEVTRSEKEDRDNVREIRKLVEELRRESKRILDESRRLVKRLIDEAKDLEELIRRIREMLKRSEENNKRIIDDLTRALEELEREHRENNKRLRELLRELEEKAKRIKDDEILKRIEEEVRKILEDSRRSTEESHEKVRRIITKIRKLLEDDERRNRKVVREAEEAMR

SEQ ID NO: 20206 - protein, 178 aa, Artificial Sequence; identical to SEQ ID NO: 20205
  Synthetic sequence.

SEQ ID NO: 20207 - protein, 178 aa, Artificial Sequence
  Synthetic sequence.
SKLEELLRRAREVARRLKEELERILKEVEDRVRKSEKEDEDNVKRITDEMRKLKERVPDLKELLDRIDEMLERLRKLHEDNNKRLRDEIKKLEDVVEEILRRLEKVLRELEEKVARVKEDRVIKRIEEDVRRVIEEIKRLLRELEEEIRRILDESRESTERSHRTARKIVEEVERAAK

SEQ ID NO: 20208 - protein, 178 aa, Artificial Sequence; identical to SEQ ID NO: 20207
  Synthetic sequence.

SEQ ID NO: 20209 - protein, 178 aa, Artificial Sequence
  Synthetic sequence.
SKMETIERRVEEAIRESEELNERDEERVKKVIDELKKLIDDIRRRLEEALRELKKVTDDGSPREDIDRKIKTVLRELEELIKRIRERIKEILRENEKTVRDDRRRNEELRAELKKLVDEGAVTEEILKKVRELIEETKRRTDDLHKKVKERVDDIKRRLDELLEEAKRALDEIRERVK

SEQ ID NO: 20210 - protein, 178 aa, Artificial Sequence; identical to SEQ ID NO: 20209
  Synthetic sequence.

SEQ ID NO: 20211 - protein, 178 aa, Artificial Sequence
  Synthetic sequence.
SAVEEIKRRLEEIIRDLERLIDDDRKRVEEMVKRIEDLIKKDEEDVREALKKLEEVVTRGEPREDIKRKIRELLARNRDTLRRIKEELEKILEENKESVREIEKKIEDAKRELRKLVEDGVLEEEILERADRLVKEIKEKLDRLVKTSEELIRRLEEELRRLHEKVKELMKRAEEKVR

SEQ ID NO: 20212 - protein, 178 aa, Artificial Sequence; identical to SEQ ID NO: 20211
  Synthetic sequence.

SEQ ID NO: 20213 - protein, 181 aa, Artificial Sequence
  Synthetic sequence.
SREDVLREIRRLVEETKKENEKILERLRRLVRTVERRNDEVVKKVRTLVKRLEEEIDKTVKDKDKVEKLRRELDKIRRKLEELARRSKEDLKRILEEVDRLSEEDKRKNDRVLEEAKKAIDNDVDLDELLRKLKEDLDRSKEELKEIEKRVRELLERNKRKTEEVEKEVKRDLDDIRRKLK

SEQ ID NO: 20214 - protein, 181 aa, Artificial Sequence; identical to SEQ ID NO: 20213
  Synthetic sequence.

SEQ ID NO: 20215 - protein, 181 aa, Artificial Sequence
  Synthetic sequence.
SEKEALDEVRKRVEDVRRDNKRILEESERLNRESRKRNRDILERLRKEAEDLKREIDETVKDKDKVKELDDRLKKVLKEVEDLVRESERDLERIHKRSRDLVRESERDLDRIEKEIKDAADRDVDLDKLLEDLERLLKENLDRLRKILEEDRRLNKENNDKLKEIEKRVRELLKDIKDKLK

SEQ ID NO: 20216 - protein, 181 aa, Artificial Sequence; identical to SEQ ID NO: 20215
  Synthetic sequence.

SEQ ID NO: 20217 - protein, 178 aa, Artificial Sequence
  Synthetic sequence.
KEVEDVLRKIRDLVRKNLEDAERVVEEAKRLIDENRERLREVLREDEELNREILKRLRELKDEDALRDLERKLKEVHDRTKKLIEDSERHLEEVLRKVEKVIKDSEKHLREVLDEVEKAGLDEEALKEVRRLIDELRKANKRILEEIRDLVRRLREENEEILRRLKRKNERTADEIRK

SEQ ID NO: 20218 - protein, 178 aa, Artificial Sequence; identical to SEQ ID NO: 20217
  Synthetic sequence.

SEQ ID NO: 20219 - protein, 178 aa, Artificial Sequence
  Synthetic sequence.
SEVEDVLRRIRELLEEIKRRLEDVRRRIKELLDRNRRESEDVLRRDKELNDEVRDKLRKRKDEKVLEELEREIKKIHDDTKRAVDRSREDNKRILDEVERAIEELERELERVLDEARKAGVEERMLKTVEDLVREVSKEVRRILEELRDEVRKSEEENRRILDKLEKENRKTAEDVKR

SEQ ID NO: 20220 - protein, 178 aa, Artificial Sequence; identical to SEQ ID NO: 20219
  Synthetic sequence.

SEQ ID NO: 20221 - protein, 178 aa, Artificial Sequence
  Synthetic sequence.
SEVEEVLRRIKELLDRNREELKKVRERIKRLLDRNREKSEEVRERDKRLNDEIKKRLDEDKDEKVLRKLKRLLEEVHKRTKEMADRSREDNKRILDEVEDVARRSKEDNERILKEAEEAGVEKRVLEEARRLVKKSEEDNRRILKELRELVKESERENEEILRELKKLNEDTKKRIED

SEQ ID NO: 20222 - protein, 178 aa, Artificial Sequence; identical to SEQ ID NO: 20221
  Synthetic sequence.

SEQ ID NO: 20223 - protein, 178 aa, Artificial Sequence
  Synthetic sequence.
DEVEEVLRKIEELIRENIKRAREVLEEDKRLNERNKRESEKVLEEDERLNREIEKELRKLKDEEVLRRLKEKIDEVHKRTREMFERSRDDNRRIHEKTRRAIEKSREDNKRILDEVRKAGLDEEVLRRIKKLIEESMEDNERILRDAERLNRESKERNERILKRLKKRNDETRKEVEK

SEQ ID NO: 20224 - protein, 178 aa, Artificial Sequence; identical to SEQ ID NO: 20223
  Synthetic sequence.

SEQ ID NO: 20225 - protein, 179 aa, Artificial Sequence
  Synthetic sequence.
SSAEEVKERSKRINEEIEKTLEKMLRESRRTNEEIKKTLKRLAEEAEKLLRDVERLVRAGVPKEDLKRLLKEIKERVEKLLRELEELIKRDNDRVEKALKDLRDLIKDDTDKVEDVRRRGDLDEDIIREIRELNKRTRDKIEEIIERIRKLNKETRDRIRKIMREIEKKIRDLAEEIRR

SEQ ID NO: 20226 - protein, 179 aa, Artificial Sequence; identical to SEQ ID NO: 20225
  Synthetic sequence.

SEQ ID NO: 20227 - protein, 179 aa, Artificial Sequence
  Synthetic sequence.
KSMEEARKKSKEINDRILDRLKKVLEESRKINKDIKDTVERLRERSEDINRRIKELVDSGRDKKDLRRLIEDDNTKVRKALEDLRELIRRDNERVKKVLRELRELIKRDTEEVEDVLRRGDLSEEIIKEIRKLNEETRKEIERIAREAEELNKRTADKIETIIREIEKLNKKLKDDIEK

SEQ ID NO: 20228 - protein, 179 aa, Artificial Sequence; identical to SEQ ID NO: 20227
  Synthetic sequence.

SEQ ID NO: 20229 - protein, 176 aa, Artificial Sequence
  Synthetic sequence.
DEVRELVKEIEELIERIERTLRKMTKDSRDLNRKINEKLKKVLEDSRRLNEEIKRTIDSNPEKKERARELLERDEELIRRVREELKRLLEEDNERIKEAEDRLARLLEEIERRIREIDVDESILRRLEKLLEELRKRVEDIIRELEKLNKESREEIDKIIREAERLTEETERRARK

SEQ ID NO: 20230 - protein, 176 aa, Artificial Sequence; identical to SEQ ID NO: 20229
  Synthetic sequence.

SEQ ID NO: 20231 - protein, 178 aa, Artificial Sequence
  Synthetic sequence.
DEMEELLERIRRLIREIDERLKEMLKRSRELNRELNERNKDVLRRIKELIDRIRRLIERDNDKKLVERLLEELERVIREDHKRVRKLLDENRKLSKELEDEARRLLKELEEVIDRVRRAGADERILRELKKLVDDLRRRIKKILDESKELLERSEKKADESNKELRKLVEELRKEADD

SEQ ID NO: 20232 - protein, 178 aa, Artificial Sequence; identical to SEQ ID NO: 20231
  Synthetic sequence.

SEQ ID NO: 20233 - protein, 178 aa, Artificial Sequence
  Synthetic sequence.
SRVEEIERRIRELIKRIEDRNRKMLETSRRLNEDINRRLRELLERIRKLIEEIEELIKRDNDKDTARKLLKEIEDLIRRLSEEAKELLDENRRLSEKDHREARRLLKEIEDLIRRAEEDGVDEKILRDLEELLKELARRLERSNEESRRLLEDSRRKMEKIIRELEKLLDDLRRKIEK

SEQ ID NO: 20234 - protein, 178 aa, Artificial Sequence; identical to SEQ ID NO: 20233
  Synthetic sequence.

SEQ ID NO: 20235 - protein, 177 aa, Artificial Sequence
  Synthetic sequence.
DEKEIDEEIERLVRDSKRRSRKVLRDIEELAKRVKEENDRVLEKLRKLIEDLKRKIDETIEDKDTVKRLTEKLETALRELEELSKENRRRLEEITKRVRELVRRDEEKNRDVERRVKEIPVSERLKEEVDRVIADSRRLNKEILDEVKRELDKLRKHLEDVLRRAEKMIRDIDEELR

SEQ ID NO: 20236 - protein, 177 aa, Artificial Sequence; identical to SEQ ID NO: 20235
  Synthetic sequence.

SEQ ID NO: 20237 - protein, 175 aa, Artificial Sequence
  Synthetic sequence.
SEVDKVREDVERLSARSEEKVREVLERVKRLLDKSKRDNEDVKRRVRELAERLRDLRRKGVPKEELKKRLEDIRREVEDLARRDKEKNKKILDEAEDLVKKLRDDNRRVEREVERAGIDKEVLDRIRRRIEENSKKIDDMVKKVRTLVKRSEEESERVLKELRDLMRDVERRIRE

SEQ ID NO: 20238 - protein, 175 aa, Artificial Sequence; identical to SEQ ID NO: 20237
  Synthetic sequence.

SEQ ID NO: 20239 - protein, 177 aa, Artificial Sequence
  Synthetic sequence.
SEVERVEKEIRDLSRKSNEDLKRILDEARELSKKSNEDTKRVLKETRDLLKEIADRLREVRDKRLKDRLREDLRRILERHKKLSEEDKRKNDEVLRDLRRKLEELKRRNEKVRDDVEKKGLDEEVKKRVEESLRENEKLLRTIAKEIEDLVRENRKVNEDVNREVEKLVRELEERIK

SEQ ID NO: 20240 - protein, 177 aa, Artificial Sequence; identical to SEQ ID NO: 20239
  Synthetic sequence.

SEQ ID NO: 20241 - protein, 183 aa, Artificial Sequence
  Synthetic sequence.
REVEELLKRIRELVKRNNEKTKRLLDESRRLNEEANRRLDKVLKELRDLAKRIKEELDEKGGEDERAKKRVEDMLRRLEELLREATKDSERMLKENRELVDRIREEDKRVLEELDKLVKEILERNKEDEDLEREVKKLLDENRESSERVIRESEKSLRDHAERTRKVREEIRKLLEELKRAVE

SEQ ID NO: 20242 - protein, 183 aa, Artificial Sequence; identical to SEQ ID NO: 20241
  Synthetic sequence.

SEQ ID NO: 20243 - protein, 174 aa, Artificial Sequence
  Synthetic sequence.
SEKEDIKRKLDDLLRRHREVSRESNRELKRLLEEHRRTSKRLDDEIKRLLREIEEAGASEELRRELEEIVTEVKKLIEEINRRLEDAVRKVHENNRKLDRELEEVVKTLRDLLRRNVDTETVRKEIEDIARRSKEKLEKNTRDVKRMVDRSKEELKRILKELEDAIREIKKKVD

SEQ ID NO: 20244 - protein, 174 aa, Artificial Sequence; identical to SEQ ID NO: 20243
  Synthetic sequence.

SEQ ID NO: 20245 - protein, 177 aa, Artificial Sequence
  Synthetic sequence.
SEKERILERLKELVERSNEKLERILRRSEKLFTDSNKELKDILDRARKLIEEIDDRIRKVKEKELKDELRKRLEEILKEARDLSEEDKEKSERVHRESRELSERDEEESRKVLEEVRSRDLDKKIRDDAERLITENKERNERVNKRDEDLLRRNRKENEELNRELERLVKEIREKLK

SEQ ID NO: 20246 - protein, 177 aa, Artificial Sequence; identical to SEQ ID NO: 20245
  Synthetic sequence.

SEQ ID NO: 20247 - protein, 177 aa, Artificial Sequence
  Synthetic sequence.
EEKERILETAKKLAEEIKRRAEEILKRSEELVRDSNKKLREVLEEARRLIKKIEDEIREIREDELKRRVREKLERILRRLRELSKEDLKRSEEVHRRSRRLLEELLEKLEEILRRLKSKPLDKEIEDEVRRLVREIEELLRDIERRDKELLDENRKLNEEVNRDAERLVRKIRKALE

SEQ ID NO: 20248 - protein, 177 aa, Artificial Sequence; identical to SEQ ID NO: 20247
  Synthetic sequence.

SEQ ID NO: 20249 - protein, 177 aa, Artificial Sequence
  Synthetic sequence.
SEVEELLRRIRELSKRSKDEIKRMLKEIRELSEKSKRDIERMLRRNEDLARKIKELIDRDNNDELVKRLNEESEKLAREARKRVERSIREIERLLEEIRRRVEESLRTLKEVLKEVEKNGVTEEIKREVEKLLEENRKLLEDLEEDVKRLIEENKRALEEVERESKRLNDESRERTK

SEQ ID NO: 20250 - protein, 177 aa, Artificial Sequence; identical to SEQ ID NO: 20249
  Synthetic sequence.

SEQ ID NO: 20251 - protein, 178 aa, Artificial Sequence
  Synthetic sequence.
DDLERVLKEIKKAADKIREDNKRTADKIRKRVKELDDETRDMLRRIRKLVKEIKERVRGREEARKVIEELKKLVDEVRKRNEKSIEELKKLLKEDRDLMRRVIEELEDLVRRLREEVRDDEALRRVEEEVERLIRDLRRVLKETSDRVRELIDKHRRLSEEVEKDVKRLIDELKKKTD

SEQ ID NO: 20252 - protein, 178 aa, Artificial Sequence; identical to SEQ ID NO: 20251
  Synthetic sequence.

SEQ ID NO: 20253 - protein, 187 aa, Artificial Sequence
  Synthetic sequence.
SEIEEILERIKKISEDSKRRLEDILRKAKKISDESRETNKKTLEDVRRIADEIRKRLEEAGGRDERDLRRLMKEVKERLEEMLKRDDELAKESIKILKDVLKELRELVKRSETELRRVIEELRRRVRDKDKLERVEREIRRLIKENKDIVERIERAIEELVRRNEKSVEDSKKDIKRLVDELDREAR

SEQ ID NO: 20254 - protein, 187 aa, Artificial Sequence; identical to SEQ ID NO: 20253
  Synthetic sequence.

SEQ ID NO: 20255 - protein, 180 aa, Artificial Sequence
  Synthetic sequence.
SEVERIKERIDKLVEENRKLVEEIEEEDRRLLEENREIVKRIEEEIEKLLRDLERRVKSEKAKEIRKKIKKARDELREVLKRSEEISKETIDRLKRLLEESKKELERLKRTLDEMAKRNEPEDVLRDILREIERLSKESKDRLKDLLRKSEELSKESKKLLKDILKKVEDLIREAREEAR

SEQ ID NO: 20256 - protein, 180 aa, Artificial Sequence; identical to SEQ ID NO: 20255
  Synthetic sequence.

SEQ ID NO: 20257 - protein, 184 aa, Artificial Sequence
  Synthetic sequence.
EEKERLKKSLEDLAKRIRDILRKHEEDSRRLSKEIRDVLRRHREASRKLVEEIKELIKSVRDEELVKELEKLLRELEKRSEDLLRELEKRLKELEDRSRDILRRLEELLRRLEERVKKALREVDGEEMLKRVLEELERIVRDIERRIKEASERIRKIVEDIKKRIKEADDRIKDIVREIAERIR

SEQ ID NO: 20258 - protein, 184 aa, Artificial Sequence; identical to SEQ ID NO: 20257
  Synthetic sequence.

SEQ ID NO: 20259 - protein, 177 aa, Artificial Sequence
  Synthetic sequence.
DEEEEALKDVERLLRRNEKLIEEHERRSEKLLRELEDVVRRHEERSKELLERIRERIKRLTDEDRVRDIERLMRELEEESRRTAKTARELLEELRRRSKETVERIEKSLEDLRRTVEREGVDEEVLKKLRKLSKESEDDIRKMSEEVEEIVRRIKRLLEEATRKLEELVKRIEERID

SEQ ID NO: 20260 - protein, 177 aa, Artificial Sequence; identical to SEQ ID NO: 20259
  Synthetic sequence.

SEQ ID NO: 20261 - protein, 177 aa, Artificial Sequence
  Synthetic sequence.
DEDEEAKREVERLLRENEKLIEDHKRLSEELVRRLEDLIRRHEETSERLLRELREIIKRQTDEKRVREIEDLLRRLKKRSDDTVRDIKRLIKELKDKSERIVREAEKSLKKLKEVVDRKGVDEDVLRELRDLSRRSKEEIKKMSEEIEKLARDILKRIREMTEEAKRIVKEIKDRIR

SEQ ID NO: 20262 - protein, 177 aa, Artificial Sequence; identical to SEQ ID NO: 20261
  Synthetic sequence.

SEQ ID NO: 20263 - protein, 186 aa, Artificial Sequence
  Synthetic sequence.
SEIERVLKELDEVSKKSLEEIRRMSEESRRLSKESIDRIREMLERAREKADRIRETIKREGGESEEARDRIKKLIDELRELLREVDERIKKSIEDLERLARETEERIKTSIRDLEEKVKEIAKRITDKDKLRRLRERVEELKKRNEDLLKEHRDENKRLIDENRDLVDKLRKTIKRLIDDLERRVR

SEQ ID NO: 20264 - protein, 186 aa, Artificial Sequence; identical to SEQ ID NO: 20263
  Synthetic sequence.

SEQ ID NO: 20265 - protein, 179 aa, Artificial Sequence
  Synthetic sequence.
SKVDELRKTVEKLLRELRDSLRRYEEESKRLLEELDDSLRRSKKTVEDLLREIKEILKRVRDEEVRKTVERVLRELKEILDRDKERVDRVKEENKRLLEKDRKTVEDVLRELEDLLEKIRKRPDDRAKERLERLVRKIKEDNKRSLTENERLVRKIKKENEDAIRRLKDVAKKIKEELT

SEQ ID NO: 20266 - protein, 179 aa, Artificial Sequence; identical to SEQ ID NO: 20265
  Synthetic sequence.

SEQ ID NO: 20267 - protein, 176 aa, Artificial Sequence
  Synthetic sequence.
SEKEELKKEIRRNLEENKDVLRRHEEENRRLKKRIKELLERHARTNKRLKEEIDRTIRDKDTAERVKRELDKLHKEAEELIREVLRRLDELHKTAEDIVRTSEKLLKEVEEELKDLDSRLLEELLRKLEKLSRDSKEKLKEISKRSKELVKRIERELEKMTKKSRDLVKKIKEEEK

SEQ ID NO: 20268 - protein, 176 aa, Artificial Sequence; identical to SEQ ID NO: 20267
  Synthetic sequence.

SEQ ID NO: 20269 - protein, 178 aa, Artificial Sequence
  Synthetic sequence.
SEVEELRKELERIVKETKDVAEELSRESEEVLKKSEENLRRLTEKSDDVLRRVAELIRSNRDTDTVVTEARDLLRRSDEHLEENLRRTDKELRDSDEKLKRLEEEHRKLSEEIKRRLDERGGVKELKERIERVNREVREEARKHHDKNRDIRRRVTELHKRHKERNEEIRRKVEEDAK

SEQ ID NO: 20270 - protein, 178 aa, Artificial Sequence; identical to SEQ ID NO: 20269
  Synthetic sequence.

SEQ ID NO: 20271 - protein, 178 aa, Artificial Sequence
  Synthetic sequence.
DEIEDLRRKVEKVVRDAEKVLRDLSRKSRKVHEDSRENVDRLLKEVEDVVKRVADLIRSNQDRDTVVKEAREVAKRIKEHLDRNLERVKKMMRDSDKELRDLLETIKRVVEEIKKRLEDKGGVEELKRTLEELLKRVEDLVRRHHEENKKLTDDNRRLHRRLRERLKEVLREVERRRD

SEQ ID NO: 20272 - protein, 178 aa, Artificial Sequence; identical to SEQ ID NO: 20271
  Synthetic sequence.

SEQ ID NO: 20273 - protein, 182 aa, Artificial Sequence
  Synthetic sequence.
SDVERIEEELRKLTEENRKLTETLKTELRKIRREVEKILKELEDRLRELSERVKDLIRKRNVPEDLKRKVDEIRKTIKTLLEEIERRVRKVEEEIKELLKDSNRKTERVIREIKRLLKDLGDKKEVLDDIRRKLKKLHDESKKTHRDILERLKEALKRLLELAERVLEELERRAEELRREIK

SEQ ID NO: 20274 - protein, 182 aa, Artificial Sequence; identical to SEQ ID NO: 20273
  Synthetic sequence.

SEQ ID NO: 20275 - protein, 182 aa, Artificial Sequence
  Synthetic sequence.
DDVERLEERLKELDKRNKELTKDLEDKLRKLTRDNRELLKKIEKRLEEVRREVKRLITERNVPERLEDKVREIEKEIRDLLDELRKRSDKVIRDIERLLEESNEKTERVIERIRRLLEKLGSLKEVAERIREELERLHEESKRLHEKILEDLERAHDETRRIVEDILRRLEKVARELKEEIR

SEQ ID NO: 20276 - protein, 182 aa, Artificial Sequence; identical to SEQ ID NO: 20275
  Synthetic sequence.

SEQ ID NO: 20277 - protein, 177 aa, Artificial Sequence
  Synthetic sequence.
DELRELIKTLREILERLLDRSRRLNDKLKEILERIERASKKMNDDDRRRVRRLEEEVRTEDLAREAEKTNKKTLEESEELIRRVEDELERVLDRSRTLIKEAKRIIEKLLDEIRKTVDSRRLEDVERVVEEAKRALERSLRENEKSVEDIKKRIRESVEENKKSVRDTLERLKRTLE

SEQ ID NO: 20278 - protein, 177 aa, Artificial Sequence; identical to SEQ ID NO: 20277
  Synthetic sequence.

SEQ ID NO: 20279 - protein, 179 aa, Artificial Sequence
  Synthetic sequence.
STEEEVRKRVEEIERTLRESLERNRETVERSEERLEELLRRARRVVEESKKRLDKEIKDERLLREVTDLNRKSLERIEELIKEADERNKRSLERSERIIRRAEELLRDVLRKAEELSDVTDEVMRDLIRKLEDILRRLKEESDRLNEEHKEILKELVRRLEEIIKEHREIVERILKKTR

SEQ ID NO: 20280 - protein, 179 aa, Artificial Sequence; identical to SEQ ID NO: 20279
  Synthetic sequence.

SEQ ID NO: 20281 - protein, 174 aa, Artificial Sequence
  Synthetic sequence.
DEEEEVKRLLDRIREEVKRLHDENKKRLDELRRTVDKLLRESERENKRVNDEVRKDGIPKEVLDELKEMSDRDREENERIVRDARKKIDDIERRSKKLLDDVEDALRRLEELLRRNTDVETLKRRIEDVLRRVEEESRRLNKELEDVLRRAKELVDRSKKKLEEVLRRVKEKAK

SEQ ID NO: 20282 - protein, 174 aa, Artificial Sequence; identical to SEQ ID NO: 20281
  Synthetic sequence.

SEQ ID NO: 20283 - protein, 174 aa, Artificial Sequence
  Synthetic sequence.
DEEREIEELLRTLTREVKRLLDESRKLNEEILRKVKRLHDENRKRIREVLEDVKRRGLPEEVVREVKRVLEEILRKSEKLLRDVERLSEEDKKRNEEIVDRAREVLKRVEELLRRNTDVETLKEEVKRALEEVEKRVRDSKRDLKRVAEEVEETSRRLNDELRKVREDVRRRAT

SEQ ID NO: 20284 - protein, 174 aa, Artificial Sequence; identical to SEQ ID NO: 20283
  Synthetic sequence.

SEQ ID NO: 20285 - protein, 188 aa, Artificial Sequence
  Synthetic sequence.
EEAERIADEARKVEEDVRRMVEESKRKLKKVLDDSKRLIDELKRRLEDIRRKVAEMAKRLRDDRDVVREVVRRVEELLDDIRRRLEDIHRRSRELSERDKEENRRVLERVERVLRELRKKLEDVKDRIDERVLRDIERLLEEIRRELERLARESEKVNERVNREDRRLLEEIRELLERIRKELEERTR

SEQ ID NO: 20286 - protein, 188 aa, Artificial Sequence; identical to SEQ ID NO: 20285
  Synthetic sequence.

SEQ ID NO: 20287 - protein, 179 aa, Artificial Sequence
  Synthetic sequence.
SLKEEVDELLRRIEEEIRRLADKSRRTNERVKEEIDRLARESEETNKKLKKKIEDIDVDEEIVRDARRLLEESHRRNRKLLEDAKKLLRESHEKNKKILKDAERLLDEIRKRAEANKDKDAKIVKKLLEDLKRLLKEVKELMERINKETKELLERVAREVKRLNTDTERLLKEVEDRVR

SEQ ID NO: 20288 - protein, 179 aa, Artificial Sequence; identical to SEQ ID NO: 20287
  Synthetic sequence.

SEQ ID NO: 20289 - protein, 176 aa, Artificial Sequence
  Synthetic sequence.
SEREEIEELSRRSRRSLEELKKEIRKVNERNKRLLEELEREIRRVSKESRDRLRELRRRLSEELAKRVDEVNRRVKREVEELVRRNEEVDKRSKEVVEKLAREVEKMNKDAKDLVDRNVDTKDLIRRLRELTRTIERRATELIKRLEEVSREIAERVRKLIKELRDMTRKIDEDAR

SEQ ID NO: 20290 - protein, 176 aa, Artificial Sequence; identical to SEQ ID NO: 20289
  Synthetic sequence.

SEQ ID NO: 20291 - protein, 182 aa, Artificial Sequence
  Synthetic sequence.
SEVEKLLERLKKILEEIARLVDRSNTEDDKILRKAEEDVRRLLDKLKKILERAAELLARNEEKERLIEEIERRLREVLKEVRRLLKKLKEDNKKSLEDNKKLLDDVRKTLDDLLRDAERTVRDEKLRREIRKLVKELKETIKRLEKKSRDTVKRTEDELRRLEEEAERLITELKERLDELRK

SEQ ID NO: 20292 - protein, 182 aa, Artificial Sequence; identical to SEQ ID NO: 20291
  Synthetic sequence.

SEQ ID NO: 20293 - protein, 175 aa, Artificial Sequence
  Synthetic sequence.
REDEEMLKDLKRVLEDAERVSRDTLRELEDAVRRLHELSEDTLDKLRKVLEEADRLIRSNQDKDEVVKRLEDILRKILEETKRIIDEARKILKKVEDDTRKLIKDVERLIERIKKDLEGNEDVRRILERVRKELKRLLEENEKLLRRVEKELEENERRNEEEIRRVKKTVEERAK

SEQ ID NO: 20294 - protein, 175 aa, Artificial Sequence; identical to SEQ ID NO: 20293
  Synthetic sequence.

SEQ ID NO: 20295 - protein, 181 aa, Artificial Sequence
  Synthetic sequence.
SRVEEVLKENRDTNEELKDTVRKILETNRRTLERAEEEVRKILEDLRDIARKIEEMVENGASEKTLKDLLDELRRTVEEVLRKLEKLLRKDEEDVRRALEKLEKLLRDDERRVKEVEDEIKDKEMLERLRRSLEESKETVKRLLEELRKSLEKSKRDVERLLKELEDLLRELEKKVDDRRR

SEQ ID NO: 20296 - protein, 181 aa, Artificial Sequence; identical to SEQ ID NO: 20295
  Synthetic sequence.

SEQ ID NO: 20297 - protein, 178 aa, Artificial Sequence
  Synthetic sequence.
DEAREILTRIRKLLEEIRKEAEEVSERHKRLVDELDKEVKDINKRAEDLLRELAEIVKRGDVDKRRIEEEVRKINEEHKDRVRRIADRVKKINKELEDIVRELKKKVEDVLRELARLIKDVDEKEVRKVLEEIKRVLEELKRHAEDNLRRAREVLKKLADEAKRVNERSEELLRELKK

SEQ ID NO: 20298 - protein, 178 aa, Artificial Sequence; identical to SEQ ID NO: 20297
  Synthetic sequence.

SEQ ID NO: 20299 - protein, 178 aa, Artificial Sequence
  Synthetic sequence.
SMADEILRELKELTEEIERRVREASREHRERLEKLRREVREINKELKRRLDELREIVERGEVDKEEITRTVEEINKEHKELLKRIEERVKKINEDLRRLLEKLTDESRRVLERLKRLLKDVDKDRVEKILRENKERTDRLRRHIEKNLEDARDLLRKLKEEVKRVNEESEKSLRDLRK

SEQ ID NO: 20300 - protein, 178 aa, Artificial Sequence; identical to SEQ ID NO: 20299
  Synthetic sequence.

SEQ ID NO: 20301 - protein, 181 aa, Artificial Sequence
  Synthetic sequence.
SLEEDIRRILDENRRSTERIKEEIREINERDKRSLEDIERRIRKVLEDLRKLLEDLAREGLDEEIRRRVKEILDEIRRLLEELKRRVEEINKRTTDLLKTLERESEKILRRIEDLLRKLKDIEEAVRKILKEVRDVNEELKRRVEKILEDIRDANRRLRETVEEIIRRAKEAVDKLRDEVR

SEQ ID NO: 20302 - protein, 181 aa, Artificial Sequence; identical to SEQ ID NO: 20301
  Synthetic sequence.

SEQ ID NO: 20303 - protein, 179 aa, Artificial Sequence
  Synthetic sequence.
SEKERVDDLLRRVDELLKRSKREVEKLLEDNKRLLERIERENRRLTKELEDKVRRLKEKGLVDDEVLKEAEKLLEENNRKSKEILEENKRLLEELKKEVEEIHRKTKKVLDELADIVRRGERDVEEIAKEIRDVLREHKELIDEIRKKAKKISDKSRKLMEELERHLRRVIKELDEKAR

SEQ ID NO: 20304 - protein, 179 aa, Artificial Sequence; identical to SEQ ID NO: 20303
  Synthetic sequence.

SEQ ID NO: 20305 - protein, 179 aa, Artificial Sequence
  Synthetic sequence.
SEEEEVEELLRRNRKKAEEVDREIDRLLKEVEKLVKDSRKRIEDLLRRAREKVEDLRRKGDVSEEVLKRAEDLLREIEEKVERIHETTKKVLEDLKRRVEEVLRDNERLIRELEKIVRAGKRDVREISEEIERITRETEDRIRKIAEEIRRVLKRHKELIEELEKEIRDVLKKLDDDVR

SEQ ID NO: 20306 - protein, 179 aa, Artificial Sequence; identical to SEQ ID NO: 20305
  Synthetic sequence.

SEQ ID NO: 20307 - protein, 178 aa, Artificial Sequence
  Synthetic sequence.
SEIEKLLKDLRDLLKKSEETVREMLKRLEEIVRRAEEDHKRLLEKLKRLLEKLRRDVRTDEVIKRAREDIERVLREIRKLNKEVEDEIRKIIEDLEDILRRSHETIERILREIRRRSRREEVRKRLEDLADEVDKRNRDIERKIRELMKRAKEVSERLNKELEDLAREAEKLLRELKK

SEQ ID NO: 20308 - protein, 178 aa, Artificial Sequence; identical to SEQ ID NO: 20307
  Synthetic sequence.

SEQ ID NO: 20309 - protein, 178 aa, Artificial Sequence
  Synthetic sequence.
DEIEELLKRLRDIVRKIREDHERLSRESERINKDARRRHDEMLRRLEELLRKVEKEVRTEELIKRVEEEIRRIIEEARRINEEVDKRSEDVVRTMKELNDRVDKDIDRVIDELRKRIRDEKVKRDIERIRKEVKEESKRLNDHIRDNERRNKESSEELNRRIKKIADEVRELLEKLKT

SEQ ID NO: 20310 - protein, 178 aa, Artificial Sequence; identical to SEQ ID NO: 20309
  Synthetic sequence.

SEQ ID NO: 20311 - protein, 175 aa, Artificial Sequence
  Synthetic sequence.
REEERLRELMDESRKRIEAVEKRARDLKRKSDRLIEDAARKIKTILDKIRKLIEDLRTDERVLEKIRKLLEELEKEARDVLERWKKLLEDSLRELEELLKKWRELTERLKEELDAGEKDLKDVEKKIREVNKTVKEEVDRLVEKNERLNDEARRVVKELLDKVERMLEEVEREAR

SEQ ID NO: 20312 - protein, 175 aa, Artificial Sequence; identical to SEQ ID NO: 20311
  Synthetic sequence.

SEQ ID NO: 20313 - protein, 174 aa, Artificial Sequence
  Synthetic sequence.
SEKEDMARKIKELIDRDRERIERVIREIEKLIKELRDHNKRVLETDKRLLDDLKRVADDGIDRSELERLAEEIIRHTERVTERDKRIVDEIRKKIKEILEDNERTNREIRDELEKAPKDEDLRRLKEEVDRVAEETRRLLEEIKKKVDKVVREVETSNRRSEEEVRRLLDEIRR

SEQ ID NO: 20314 - protein, 174 aa, Artificial Sequence; identical to SEQ ID NO: 20313
  Synthetic sequence.

SEQ ID NO: 20315 - protein, 174 aa, Artificial Sequence
  Synthetic sequence.
DEKEEAARRVEKLITELRKHNEDVLRDIKRLIDELRRHNEEVLKRDRELLERLRKVAEEGVDKDTLDELAKRIKDHTDEVTKRDRKILKDIKKKIEEVSRRDEKIFREIERVLAELPKDKELDDLRKRAEDVLRDLRRTNRKILEDVRRVIEELERSNERSLTEVERLLREVRK

SEQ ID NO: 20316 - protein, 174 aa, Artificial Sequence; identical to SEQ ID NO: 20315
  Synthetic sequence.

SEQ ID NO: 20317 - protein, 174 aa, Artificial Sequence
  Synthetic sequence.
SEKERVLTELEKILEELRRRVEEILKEIEKLIEELRRHNERALERDKKLLEELKEVRERGVPEKEIEKLLKELEKHTRDVTRRDREIMKRIEKRIEDVKDEIRRMIKKARDRVRSLPKDRELEKVKEKLDRLMKDIKEKLDRVKEKVRRVLKELEESNRKSEKDAKELIDRIRK

SEQ ID NO: 20318 - protein, 174 aa, Artificial Sequence; identical to SEQ ID NO: 20317
  Synthetic sequence.

SEQ ID NO: 20319 - protein, 178 aa, Artificial Sequence
  Synthetic sequence.
SEVEDLLRDIERLIEESRRLVERLLERLEELIRRHTRLVEELIRELERMLKKVADEVDKRELIERAEEEIRKLVKDLRRINDEANKRVEKLVRELEKILKESHDKVDEIRKRVEKDIRRDEIRTEIKKVVDKAREVNKRIKELIDKIKREAEENSKRANELIERITREIRRLLEDLRR

SEQ ID NO: 20320 - protein, 178 aa, Artificial Sequence; identical to SEQ ID NO: 20319
  Synthetic sequence.

SEQ ID NO: 20321 - protein, 186 aa, Artificial Sequence
  Synthetic sequence.
SELEELRKRVKDLIRETKKLVEEVAEKVERLNKETKKLLEDVARIVEELIRRAEEVAERIREDEKLKRALERLEEEIRRLVEEAERLLRESHEKNERLVREAKELLDRSHELAKELIEDAKRKLKDLEEVLRDIERLAREIEKVNREAEERIRRLKKKSEETNERVKRAIDKLAEELRRVLEEIRR

SEQ ID NO: 20322 - protein, 186 aa, Artificial Sequence; identical to SEQ ID NO: 20321
  Synthetic sequence.

SEQ ID NO: 20323 - protein, 186 aa, Artificial Sequence
  Synthetic sequence.
SELEELAKAVEKLLEDLRRMTREVEEKVKEINERTKKLLKDVAERVKTLLREIEELAKKIKEDKKLDDALRRLEEKIRKLVEELKRLLDESHKRNRDLVREARKILDDIRRRAEKLIRDAEEKLKELREVLKAIKELMERIKKTLDEIRKRIKELEDESEKTNRELKKKIEDLKRELEELLREIKR

SEQ ID NO: 20324 - protein, 186 aa, Artificial Sequence; identical to SEQ ID NO: 20323
  Synthetic sequence.

SEQ ID NO: 20325 - protein, 182 aa, Artificial Sequence
  Synthetic sequence.
SEIDEVIKTLEKLLEDLRRELEELSRRNKKVLEDILRRVKRLSDENRRLLERIKRTVDKRGTTEEILEELKRAVEKTRRDAEKLLDEIRRATKKLRDDIEKLKEDIERIERDAKDKIDKLSRDEKIEKKVKEVRERVKEVLERIERLVDENRRENKEVVDRIKKLLKENEEEVREVLKRIRD

SEQ ID NO: 20326 - protein, 182 aa, Artificial Sequence; identical to SEQ ID NO: 20325
  Synthetic sequence.

SEQ ID NO: 20327 - protein, 182 aa, Artificial Sequence
  Synthetic sequence.
SEIDDLVKKNKELVKKIREDVERLSEENKEVLKDIERKVRKVSEENDRLLEEIKDTVRKRGTTEDILRKLKRALERTTEEIKKILRELEEADKRLDKAIEELKDRIRRVSEDMRDKIEKIRRDRKVEKKVRENKKENEDVLRDIERLVKENKDRNREVLKRIEDLLRKNAERVKRVADEIRR

SEQ ID NO: 20328 - protein, 182 aa, Artificial Sequence; identical to SEQ ID NO: 20327
  Synthetic sequence.

SEQ ID NO: 20329 - protein, 176 aa, Artificial Sequence
  Synthetic sequence.
KEVEDIVDDVRRVIEELKRKVEEVSKKNEKLVREIEERVERISRRNKKLIKELKEIVDRGDRDKREIREELKRISKEMRDLARKLVKELKDVNRELDEDIREIDREIEEVLRELAKKLGKEELLRKIARDLEKVREEIKELVKENRKTNEEVVRRIEKLAKENDDENRKVLKEIED

SEQ ID NO: 20330 - protein, 176 aa, Artificial Sequence; identical to SEQ ID NO: 20329
  Synthetic sequence.

SEQ ID NO: 20331 - protein, 176 aa, Artificial Sequence
  Synthetic sequence.
DEVERIVEDIRRLLDEVRREVEKVSRENKELVDRVREKVKEISKRNKKLAKDLTDLVREGSRDKRELERDLERINEEMRKLIRDLERELREIDKRMDDLVREIEEKLRRIIEKLERELGDKELLDRIKEEIERVIKEIRELVEENKRTNEEVLRRIRELARRNEEENKRVLEDIRR

SEQ ID NO: 20332 - protein, 176 aa, Artificial Sequence; identical to SEQ ID NO: 20331
  Synthetic sequence.

SEQ ID NO: 20333 - protein, 183 aa, Artificial Sequence
  Synthetic sequence.
SVEELIKEVKDRLRKVLREIEELIRENEEENRKNVEDVKRTADKLRRDLEKVVDEIDKRVDSDKLERLRKKAEEIIRTLDRMLEESKKINREIDERLKRAADRLRRRVEKVIREVDRVAREVKEKEVIDKVVKRVEDLVREIKEEVDKISEENKELVKRDTRRVEEVRERIRKLVEELRREVT

SEQ ID NO: 20334 - protein, 183 aa, Artificial Sequence; identical to SEQ ID NO: 20333
  Synthetic sequence.

SEQ ID NO: 20335 - protein, 175 aa, Artificial Sequence
  Synthetic sequence.
SEIDRVIEKSDKTNEEIKRDVDRAVRRSEETLKRIRETVEEIVKTVEKLIRDLRRRVEDKGQDKEIEEIVKKIKKDIDDAKEELRKLAEEDKERVKAVKKKVEDLVREDKEEIDRRLTDKDKAKELRDRLERSLREIAKKIKKVLDDTDRVLRDIERTIEELKKRLREVLERVRK

SEQ ID NO: 20336 - protein, 175 aa, Artificial Sequence; identical to SEQ ID NO: 20335
  Synthetic sequence.

SEQ ID NO: 20337 - protein, 175 aa, Artificial Sequence
  Synthetic sequence.
SEIDDVIKKLKDLIEELEREVKEMSDENKRLLEEIEERVKEAIKRSKDTLEEIADRVRKKGPDKEIEELIREDKKRIKDVLKELRELVARTKKRVDDVTKKLREEARKIEEEIRRRLSDKDKATKIEKDLRDVLRKIEKTMEDNRRENEELLKKVEEEVRRLEEETEKVLRDLRR

SEQ ID NO: 20338 - protein, 175 aa, Artificial Sequence; identical to SEQ ID NO: 20337
  Synthetic sequence.

SEQ ID NO: 20339 - protein, 179 aa, Artificial Sequence
  Synthetic sequence.
SEVDEILKRIEELIRRIEDEVEKMIRESEDTIRRDEKEVKDAVRELADLIRRIEKRVRERKDSREEVEKLITDIADALRRFLERNEKSVTDDLDKNRRLLEKVERLIERIERVIREARKRNIDEKKVREIDKRLKDALREIRKLIERSKEESRRALKRSRELMKRLEEELRRVLKEIRD

SEQ ID NO: 20340 - protein, 179 aa, Artificial Sequence; identical to SEQ ID NO: 20339
  Synthetic sequence.

SEQ ID NO: 20341 - protein, 179 aa, Artificial Sequence
  Synthetic sequence.
DEVDKVLKRIKELIDEDKKEVEKVIRDSKRTLREDEERVRRAAKEVEDRIRDIEDIVRRRKEAREDVEKLVDDLRKKIKRLLDENEKSFKDDERKNEEVVRRNEKSITDIKRVIKEAEDRNLDKKKLEDIDRELDRVLEESKKEIEKSKRESEEVLKKSRDLVKRLAEELKRVLDEIRR

SEQ ID NO: 20342 - protein, 179 aa, Artificial Sequence; identical to SEQ ID NO: 20341
  Synthetic sequence.

SEQ ID NO: 20343 - protein, 179 aa, Artificial Sequence
  Synthetic sequence.
SRVEEVLKEIDKLIKEIKERVKRLIEESKRLNREDEERVRKVIEESKKTLEEIREVMERNKESREELEKLIEDDKEKNRKAKKDNDDSLRDDKRKNDEVEKEVRKRAKDIERAIKEIAKRNVDKDLLREIERRLREMLKEIEERIRRSKREVEESAERSERLIRKSEEDSERVLRELRR

SEQ ID NO: 20344 - protein, 179 aa, Artificial Sequence; identical to SEQ ID NO: 20343
  Synthetic sequence.

SEQ ID NO: 20345 - protein, 179 aa, Artificial Sequence
  Synthetic sequence.
DEVERILERIEELLRKIRKDVEEAIKDSERLNKDDLKRVRDAVETLRELIRRIEEEVRRRRESREEVEKLIREIEERLRRLLEENEKSVREDKERNRKLLKEVEELVKTVKDLIEEAKKRNIDKDLARDIDEKVRRLLEDIRRLVEESEKKVDESTEESRRLVTELERELREVLKRIRD

SEQ ID NO: 20346 - protein, 179 aa, Artificial Sequence; identical to SEQ ID NO: 20345
  Synthetic sequence.

SEQ ID NO: 20347 - protein, 178 aa, Artificial Sequence
  Synthetic sequence.
SRVDELVKEAEDLLEEAKKANAESIRRIEELLKRVAEEIRRLSEEDKKLVEEVRKRVKDKDAIDEVRERSRESLDRIRRIIDEIRRRAEKLLREDEELIRRLAEELRKLLEKLKRELRDKRAEDKLRRVEEDARRVLEDLKRTLKRLEEEVRRVLEEARDILRKNAEENRKVLEDLRR

SEQ ID NO: 20348 - protein, 178 aa, Artificial Sequence; identical to SEQ ID NO: 20347
  Synthetic sequence.

SEQ ID NO: 20349 - protein, 178 aa, Artificial Sequence
  Synthetic sequence.
SRVEELVEELKRLLRTVEKENEDSIREIERLLREVKRRNEESSREDEKTIRTVRREVRGEELIEEVRDRSRKSLDDDRKLIEDIKRRLEKLLREDEELIKEIRDRARRILEKIKRELREKRAEEILERLRKEAEEVLKKLEDTLRELRKRAEKVLRDMEETLKKNKKDNEKVLRDLRK

SEQ ID NO: 20350 - protein, 178 aa, Artificial Sequence; identical to SEQ ID NO: 20349
  Synthetic sequence.

SEQ ID NO: 20351 - protein, 178 aa, Artificial Sequence
  Synthetic sequence.
SEVDKIIKEIEDLLDEARKTNEKSSRDDKRLVEEVKELNKESSERNKRLVKEAREKIRGDEMIEKVRRDSEELLKDDRRLIEEVKRRSEKTLKEDKELIEDLARKLKKLLDDLRKDLKDKRAEDKIRRIAKDAEDVLRTMEKTLRDNERENREVLKELEKTLRENEKENEKVLRDLKR

SEQ ID NO: 20352 - protein, 178 aa, Artificial Sequence; identical to SEQ ID NO: 20351
  Synthetic sequence.

SEQ ID NO: 20353 - protein, 172 aa, Artificial Sequence
  Synthetic sequence.
EEIERVEEKVRRLIKELEDELRKIEERIERLLRRSRERNKEISDRNRRLLEEMRRSDRDKDVLRKRLEDIDRELRKLLKDDEDLMREIKRELRELLERLRKVAEDIRDEIRKDLSSEEKARELEEELRRAVERVDRKIEELEERLDRVLKESRDTVDENEKRNEKVLRELET

SEQ ID NO: 20354 - protein, 172 aa, Artificial Sequence; identical to SEQ ID NO: 20353
  Synthetic sequence.

SEQ ID NO: 20355 - protein, 172 aa, Artificial Sequence
  Synthetic sequence.
KEIEDVVETVRRLLRTSEELNERISRDNEKLLRDSEKLNREISERNRKLLKDLKDSDRDKRVLEEEARRIDEILRELLRRDEELAKRVNDRLKDLLRKDEELNRRVLDRIRKDLSMEEAARDLARKLKEVHDRSRETIKRNEDKNRRVLEESKKTARENEERNKRVLDELRK

SEQ ID NO: 20356 - protein, 172 aa, Artificial Sequence; identical to SEQ ID NO: 20355
  Synthetic sequence.

SEQ ID NO: 20357 - protein, 177 aa, Artificial Sequence
  Synthetic sequence.
SEEDRVLEDVERLLRELKKETDRIAEKNKKLNEDVTRETEEIVRRVRELLERLLDLVRKVRDDRLRKELEERLKEVVDRVRELSKTTKRKLDEITKDTRRASRETEERLKKIVDEARKRIDSEKAREVEREVRRIREEDERILRELEERNRENKKRDEDILKELEDRAERVLEEIKR

SEQ ID NO: 20358 - protein, 177 aa, Artificial Sequence; identical to SEQ ID NO: 20357
  Synthetic sequence.

SEQ ID NO: 20359 - protein, 177 aa, Artificial Sequence
  Synthetic sequence.
SEEDRVLKEAKDLLEEIERELDEVAERNKELNKRLTDETRKIERRVRELLRELKDKVRKVKEDRMRERLEEELEKIVRELEEASKETEKKLEEITRETRELIKRLEDKLRKVEKELREKIDSRKLEKLEKEVREVEKRIRDILKKLEDDNRANRKRDEDIIDELRKEADRVREEIKR

SEQ ID NO: 20360 - protein, 177 aa, Artificial Sequence; identical to SEQ ID NO: 20359
  Synthetic sequence.

SEQ ID NO: 20361 - protein, 175 aa, Artificial Sequence
  Synthetic sequence.
SEVEELVRRVEKSNRDIEEMVKKIDKRNRDLLRKIEKDLREADRRNEELLREIDDLVRRGTDKRDLERLIRRVTRELEDMVEKLERLIEEVSKELEDAARELEERIRDSLRRVKEAGIDEKLLKEVEDRNRESAKEVKRLADENRKANEELKRRVEKLVRDNRRKNEELKKKVKD

SEQ ID NO: 20362 - protein, 175 aa, Artificial Sequence; identical to SEQ ID NO: 20361
  Synthetic sequence.

SEQ ID NO: 20363 - protein, 175 aa, Artificial Sequence
  Synthetic sequence.
REVEELLKEIRKRIEDVRRRVEEIDRRNRKLLKEVEERLEKVRREVEKSNTDIKELAERGTDKRELAKEIKKSRERVERLVRELRRRLKRISDELEKVARDLKRKLEEILDRAEKAGIDEDLLRRVREEIERVIREVKRLLEENKKRNDEVRKRVEDIVRRLEEHHRELKRRVEK

SEQ ID NO: 20364 - protein, 175 aa, Artificial Sequence; identical to SEQ ID NO: 20363
  Synthetic sequence.

SEQ ID NO: 20365 - protein, 172 aa, Artificial Sequence
  Synthetic sequence.
KDIEDILKESEKTNREILKRAEDASEENERINKRITDRVDRVRKEIERLLEELTRRDEDREELDRVLKKIEDDLKKAMEELRKLIKELDERLEKVLEELERLIRRDREEIERRLRVKKLVDELRRRVEETLKRLRKLIADNREKNKDNLRRIEEEVKKLEEEIKKIKDEMKR

SEQ ID NO: 20366 - protein, 172 aa, Artificial Sequence; identical to SEQ ID NO: 20365
  Synthetic sequence.

SEQ ID NO: 20367 - protein, 172 aa, Artificial Sequence
  Synthetic sequence.
KELEDIARESEKTNRDIKRRVDEVRKTIEDLLRRIDEEVKRAAEESKDTNRRIREEDRRKEEVEKLLRDDNKRIDDMLERLRKLLEEVERRLDKALKDLEKLIRDDKERIDRLLRSEDLMRKLKREVEETDKEIKDIIRRLKEEIEKIKRKIEEIIKKLKKENEDTRREADK

SEQ ID NO: 20368 - protein, 172 aa, Artificial Sequence; identical to SEQ ID NO: 20367
  Synthetic sequence.

SEQ ID NO: 20369 - protein, 172 aa, Artificial Sequence
  Synthetic sequence.
SDIDDILRESRKINKEINDTVTEMMKRSKKTNDEIREKVKEVREESEKTNEEIRREPRRKEEVRELIKRDKERIDKALRELRELIKKDEEEIKRALRDLERLIRENRERIKKLLKDEKLVKELEDELRKSEERARRIIERLKEELKKTRKEIEDIIRELRKKLEDTLRDVEK

SEQ ID NO: 20370 - protein, 172 aa, Artificial Sequence; identical to SEQ ID NO: 20369
  Synthetic sequence.

SEQ ID NO: 20371 - protein, 172 aa, Artificial Sequence
  Synthetic sequence.
SDIEKILRESKDINRRINERVDRVVERSKKTNEDILKKVKDAAEESKKTNDDIRKSPDSEEDVKRKLDDDNRKIRKAMEELKKLLEDDERDVRRALEELRKLIEDNADDIRRKLKVEELVRELRRLVEESLKRIEKIIKDLEELIKETKRRLEEIIERLEKKNEDTEREARK

SEQ ID NO: 20372 - protein, 172 aa, Artificial Sequence; identical to SEQ ID NO: 20371
  Synthetic sequence.

SEQ ID NO: 20373 - protein, 172 aa, Artificial Sequence
  Synthetic sequence.
DEIREIVKESKRINEEINRKVEEVVRRSEKTNEDIRDTVRRLVRESDETNRRIEESPQDREEVKKAIKDDERRIEEALEELRKLLKEDNDLIEKAARELEELIRRNKKRIEDLLKDEDLVRELRKEVKRSEDRIRKIIRDLDELNRRSKEDIKRKIDELRKRVEETKRRVTK

SEQ ID NO: 20374 - protein, 172 aa, Artificial Sequence; identical to SEQ ID NO: 20373
  Synthetic sequence.

SEQ ID NO: 20375 - protein, 172 aa, Artificial Sequence
  Synthetic sequence.
DDIEEILKDVKRLLDEILAKVKKASDDNKRILDEIERKVEEMVRRSEKTNEDIRRSDRRREEVRKLLDEDNRRIEEAFKELDELIKRLDKTLTDLMRDLERLIKEVKDEIDKKLKVEELVRELKKRVDEIKERARRLIEENRERNKEIKERAERIIERLRKINEDTKREAEK

SEQ ID NO: 20376 - protein, 172 aa, Artificial Sequence; identical to SEQ ID NO: 20375
  Synthetic sequence.

SEQ ID NO: 20377 - protein, 172 aa, Artificial Sequence
  Synthetic sequence.
DEIEDIVRRVKKLIRDLEERVKKLEEDSDRTNERIRREAEKASKRNKEILDKLRKSDRRKEEVREVIKTLDEELKRVAKKLRELLKKDNEEIDRAAEELKRIADEIKEAIDRLLKVEELVKELRKELEEVKEEIRKIIEELKRRNDKSRRDLERLIRDNEDKNRRLKKEAED

SEQ ID NO: 20378 - protein, 172 aa, Artificial Sequence; identical to SEQ ID NO: 20377
  Synthetic sequence.

SEQ ID NO: 20379 - protein, 172 aa, Artificial Sequence
  Synthetic sequence.
EEIERIIRESEKINKEINRTVKEVEKRSEETNRRIREELKRISKRNKEILDRLRKEPRDKEVVEREIRKLDEELKRALEELKRLLEDDNRKIEEAMRRLEKLIRENEDRIRRLLRDEKEVEKLKRKVEKSEEDIRRIIEKLREENKRSEEEVRRLITENEKRNRKLLEEAKK

SEQ ID NO: 20380 - protein, 172 aa, Artificial Sequence; identical to SEQ ID NO: 20379
  Synthetic sequence.

SEQ ID NO: 20381 - protein, 172 aa, Artificial Sequence
  Synthetic sequence.
SELEKIAEDSERINKEINERVKRISDENKRILEEIEKAVEEASRDNKRILDELRKSPRRREEVKRVIEELDKRLEDALRRLRELIKELDDRLRKALEDLRKLIEDNEREIRKLLKAEELVRELERRVDESRKRAEDLIRDNKKKNDEARRRVEELIRRNREENRRIAEEARK

SEQ ID NO: 20382 - protein, 172 aa, Artificial Sequence; identical to SEQ ID NO: 20381
  Synthetic sequence.

SEQ ID NO: 20383 - protein, 179 aa, Artificial Sequence
  Synthetic sequence.
SDAERIMRESEELNERINDVVRRVAEESKRLNDRINDVLREVSKRNKDLIKRIKEVVDRNPEKKEEIKRLIDKLDKVLEDVERRIRKLIEDDKRRIEEVKRRLERLIKEDKRKIDEARKEGVEERIIERLDRLTKKSLEELKRIIEDLKRRTKESEDRARELIKRNREENKRLLEEAEK

SEQ ID NO: 20384 - protein, 179 aa, Artificial Sequence; identical to SEQ ID NO: 20383
  Synthetic sequence.

SEQ ID NO: 20385 - protein, 179 aa, Artificial Sequence
  Synthetic sequence.
DEAERIREESEELNERINREVDKMIDEDRKLNEDIRRTVEEMVREIKELLDRIRKVLEENPEKKEEIEKLIRRVKEKIRKAKEDLERLLRELEDRNRKVKKKLEDLIREDEERIRRAEEAGVDKEIIKELRETTERSRKRLEELIRDSEEKNRRTEDELEKIIRELDERLRRLEEEARK

SEQ ID NO: 20386 - protein, 179 aa, Artificial Sequence; identical to SEQ ID NO: 20385
  Synthetic sequence.

SEQ ID NO: 20387 - protein, 179 aa, Artificial Sequence
  Synthetic sequence.
DEAEDIARKSRELNERILRRVKEMIDEDRDLNREIEKTLRRVSERNRELVEEIKREVERNREKREEVEKLIKRLDDELRRILEELTRRLRELEKKNEEVRREMEKLLKEDRDRIRRAEEAGVEERIIEELRRLTEDTKRRADKLIKDSEDENRKTLRRARELIEENRDRNRKLEEDVRR

SEQ ID NO: 20388 - protein, 179 aa, Artificial Sequence; identical to SEQ ID NO: 20387
  Synthetic sequence.

SEQ ID NO: 20389 - protein, 179 aa, Artificial Sequence
  Synthetic sequence.
DEVREIVKRSDDLNDTIREVLKRVADDSRRLNEEIRRKVTEASRENEELIKEIEDRARKNPEKKEDLRRLVRELDEKLKEVKRDLERLIEEDKRKIERVLEELRRLVEEDRKRIDEAREAGVDEEIIKRLRDRTKKTLDEVRKIIEDLKDESRKTSEELRELIKRNKEKNDELLERLER

SEQ ID NO: 20390 - protein, 179 aa, Artificial Sequence; identical to SEQ ID NO: 20389
  Synthetic sequence.

SEQ ID NO: 20391 - protein, 179 aa, Artificial Sequence
  Synthetic sequence.
SEAEKIERESRDLNRRIREVVERASEDNERLIREIRKRLEEVVRTIEKLIRDILERVRKNPEKKEEVKKLIDDIRREIDRIKKELEELVREADKRLEEVLERLERLLEEDKRRIDEARRAGVDEEIIKELKKITDKTRRELERLIDENRKRNEELLKRVEDIIRELKRRLEKLDEEVKR

SEQ ID NO: 20392 - protein, 179 aa, Artificial Sequence; identical to SEQ ID NO: 20391
  Synthetic sequence.

SEQ ID NO: 20393 - protein, 179 aa, Artificial Sequence
  Synthetic sequence.
SEVERIEKESRDLNREIKEEAKRASEDNRRLLEDIRRKLEKVSEENKDLLRKIEEEMRRNSEKKEELRRLVKELDDKLTEILKDLTRLVEELDELLKEVLKRLKDLLREDREEIDRARKEGVDEEIIKKLKRLTDETEKELEKLIRKNEKENRDLEREIRRLIKENRDRNRELKKRAED

SEQ ID NO: 20394 - protein, 179 aa, Artificial Sequence; identical to SEQ ID NO: 20393
  Synthetic sequence.

SEQ ID NO: 20395 - protein, 179 aa, Artificial Sequence
  Synthetic sequence.
SEVEKAVREIEELIKRIEDRLREMARRVEETNKTLLRDVERLSKENEELVREIKERVRENPEKKEEVEKLIRELDKKLKEAEEEVRRLATEDAEDIKRAMKEITDLIEELRERLKRIRERGLREELVRELERKIKTVLDRVEEIIRRLDKKTKDTVRRVRELIEDNKRKNKKILDEVRK

SEQ ID NO: 20396 - protein, 179 aa, Artificial Sequence; identical to SEQ ID NO: 20395
  Synthetic sequence.

SEQ ID NO: 20397 - protein, 179 aa, Artificial Sequence
  Synthetic sequence.
SEVERIVKESEELNEKITRDLEEAEKEVRKTNDEIRRVVEEMSRRNEKLIRDIDDEVRKRPEKKEDVDELIKRVDELLERALRELEKLIRDDRELIEEVSRRIEKLVRDDEEKIRRAKEAGVDDEIIKELEKKTRDNLDKVRKIIERLRRETDKTEKELRDIIRKNEDENRKLEEKVRR

SEQ ID NO: 20398 - protein, 179 aa, Artificial Sequence; identical to SEQ ID NO: 20397
  Synthetic sequence.

SEQ ID NO: 20399 - protein, 179 aa, Artificial Sequence
  Synthetic sequence.
SKVEKLAKEVEETNRRILDEVRRASEENKDLVRRIEETVKRAVEEIKRLIEKIDDVVTKNPEKKERVKELVEEIRERIKRILRELERLIEEADRRLEEVLRKLKKLIDDDRRKIDRVEEAGVDEEIIKELRKRSEDSEREARKLIRRNEEENEKLRKKLKEIIDRLREELEKVLDRVRK

SEQ ID NO: 20400 - protein, 179 aa, Artificial Sequence; identical to SEQ ID NO: 20399
  Synthetic sequence.

SEQ ID NO: 20401 - protein, 181 aa, Artificial Sequence
  Synthetic sequence.
SEVERAAEESKRLNKTIRDENREVLREIRDLIRRMKEENRRMVKRVDEVLKEIRELFRRDKIDKLVEELLRRVRDIIRRDHERVRRVLERIERLIRKDHERVRRVLKEDERLIRELEKKRTDEKVREILERLERESRKTAKELDESNREAEELLKRVADEAKKSNETLRERLERLAREAEK

SEQ ID NO: 20402 - protein, 181 aa, Artificial Sequence; identical to SEQ ID NO: 20401
  Synthetic sequence.

SEQ ID NO: 20403 - protein, 181 aa, Artificial Sequence
  Synthetic sequence.
SELEELIRKIEELIRRIEEENKEMVRRSRKLNEDLERRLDEVRRRVEKLIREIEELLKRDKIDELIKKLVRELEEVIKRIEEEIRKLLEEDKRLIDADHERVKKVVEDLDRELKRIADERRDERAKRLLDELKRLIKELEDKLRESNEELKRRSDDSARKAEKILRELKKKVDEMADRARK

SEQ ID NO: 20404 - protein, 181 aa, Artificial Sequence; identical to SEQ ID NO: 20403
  Synthetic sequence.

SEQ ID NO: 20405 - protein, 181 aa, Artificial Sequence
  Synthetic sequence.
DEAEKLAEDVRRVIKRIREDNKRLSDRNKELLEEVEKDNKKSEEDVKRVIEDIERRVRELRDDRGVDELIKRVLEELEKLSDDDRRRLKRMIEESRRSLEEDRERIERVTTELRELLERLKEKVSRELLDELRRRIEELRKRLEDSNRENEEELRKIADKVRKTNKRLNEEVEDMFRRAKT

SEQ ID NO: 20406 - protein, 181 aa, Artificial Sequence; identical to SEQ ID NO: 20405
  Synthetic sequence.

SEQ ID NO: 20407 - protein, 175 aa, Artificial Sequence
  Synthetic sequence.
DEARELLRDDERLNRELNDLDRDSSKKDEDLNRKLNEDDKESVERADTLLERIKREVRTEDVVREVRRRLREMLEENRKLTKKAKDDVKRSLDENRELTKKMEEDVRRTLRRIEKDGVDRELIRELEERNRDSVRKSRKSNEDNERTNRESIERSRRSNEELRRRAEELIKDLRR

SEQ ID NO: 20408 - protein, 175 aa, Artificial Sequence; identical to SEQ ID NO: 20407
  Synthetic sequence.

SEQ ID NO: 20409 - protein, 175 aa, Artificial Sequence
  Synthetic sequence.
SEVEELLERDKDLNRRVNELNEKTSREDEKLNDEINKRIDRLVERARELLERIRREVRTEDMVRKVLEELKRLLEELRRLIETADKEVEDSLRDDERLLKKIKEDAERTLKEARDRGLDERLIRELEERNRESVERVRRSLKENEDRNRESKKRLEDLLREVKRLMDKLEEDLRK

SEQ ID NO: 20410 - protein, 175 aa, Artificial Sequence; identical to SEQ ID NO: 20409
  Synthetic sequence.

SEQ ID NO: 20411 - protein, 175 aa, Artificial Sequence
  Synthetic sequence.
SEVEELLERDKRLNDEANRLNRELVERDKRLNEELNKELKRMADEIKRLLEEIRRKVRTEEVVEKVTRELRELLERLRRLLEEMSKEARKSLETDKKLLKELKRRAEETLREIRERGLDERLIEKLERENRESEKRARDSNKELEKRNRESEDRARRILKKLEDDVRRLKKELET

SEQ ID NO: 20412 - protein, 175 aa, Artificial Sequence; identical to SEQ ID NO: 20411
  Synthetic sequence.

SEQ ID NO: 20413 - protein, 174 aa, Artificial Sequence
  Synthetic sequence.
SELEKVRTDVERVIRELEKELKEIDEENKKVNKDVEEEVKRIEEENKEMNDRLDDLRRRGLDKKDLLREIEKAHRESRKKIEDIKKKIEDALRETEKKIKELEKKIRDVLREAEKRIKSKEMEEVREELERLLRRIKKILEELRDENRKSLERLEDVLRRLEKRNRDTLEEVKR

SEQ ID NO: 20414 - protein, 174 aa, Artificial Sequence; identical to SEQ ID NO: 20413
  Synthetic sequence.

SEQ ID NO: 20415 - protein, 174 aa, Artificial Sequence
  Synthetic sequence.
KETEDVERDVERVIREIDTKLKEIEKKNDKANKELEEKLKKIEEDNKRVNERLKRLREEGLDKRDLERELRDVLRRTRDLIRELEEELERIVRDTRRLAEEIERELKRIVEELDKKIKSEEMRRVREEAKRLLDKVKKILRDLERRNEEVLKKIKDIMRRLEKRNRDTLEEIRT

SEQ ID NO: 20416 - protein, 174 aa, Artificial Sequence; identical to SEQ ID NO: 20415
  Synthetic sequence.

SEQ ID NO: 20417 - protein, 174 aa, Artificial Sequence
  Synthetic sequence.
SEEEKVLEEVKRAIDELKKELEEVEERNKRVNDDIRRLTDEIRKENKTANDRLRKLLEEGLDKKDLLKEIKEILERTERLSEETREKLKDVLRKTEKLIKEIKDKIDEIKKRADEKIKSKKLEEVRKEVKRLKDEVEKILKDLRKRNKDLLEEDKRVLDRLRETNEKTLDDVRR

SEQ ID NO: 20418 - protein, 174 aa, Artificial Sequence; identical to SEQ ID NO: 20417
  Synthetic sequence.

SEQ ID NO: 20419 - protein, 178 aa, Artificial Sequence
  Synthetic sequence.
KEEEDITRRIDKILRDLREKLRDVNRRVEELSKRLHDKLEKVLKRIKDEAERLRKEIREKLRDERRVREIEREVREIVERVEEVVRRLKEENKEIEKENRRNSTRLKEEMDRVKEDIDRKRVTKELEDKVEKDARDVERHIRKDLTDVRRRHEDLDRKIKELLDRVRKAIRDVEEKIK

SEQ ID NO: 20420 - protein, 178 aa, Artificial Sequence; identical to SEQ ID NO: 20419
  Synthetic sequence.

SEQ ID NO: 20421 - protein, 178 aa, Artificial Sequence
  Synthetic sequence.
SKAEELLRRVEELLKRVKDKVDDIVRKIEKSNRDLERRDEEVLREVEETNRRLEEELRRRGSDEDKLRELKEESDRSKERLDDAIRKSRKLSEESERELREITKELRKELDKIREELDRDGADEEVLRRLEELIRRAERKLEKMLEDLTRLNKEWEDRTRKLLEDLRRINEEIKRKIK

SEQ ID NO: 20422 - protein, 178 aa, Artificial Sequence; identical to SEQ ID NO: 20421
  Synthetic sequence.

SEQ ID NO: 20423 - protein, 178 aa, Artificial Sequence
  Synthetic sequence.
SEKDELLRDVRRLLKEVEKELEEIRRRVTESNRELEKLVREVLEESKRSDDKLREDLERAGLEKERLDKLEEDLKRHNEKLKKAVEDLKRTSEDSRKKLEDLARDVKRLLEDVERKLRKDGADKDLLERLKELIKRLKDKLKEIADRLRRINEDIERKIREILEDSRRFNEEIKKKID

SEQ ID NO: 20424 - protein, 178 aa, Artificial Sequence; identical to SEQ ID NO: 20423
  Synthetic sequence.

SEQ ID NO: 20425 - protein, 184 aa, Artificial Sequence
  Synthetic sequence.
STLETLEDEVRKIVTDIERVIRESNKHLKKSIDDVERVIEEIERRAREIVKKVRDVISEDRSEDDVRDLKRELEELLKRLEELVRDLERKAEEDLDRLRKEYEKLKEDLERLLKELKDKADRDGTDEKLERILREIKRIVEDLKKKVEDSLKRYEEELERLKEDLRRLLKRIRDEVEELKKESD

SEQ ID NO: 20426 - protein, 184 aa, Artificial Sequence; identical to SEQ ID NO: 20425
  Synthetic sequence.

SEQ ID NO: 20427 - protein, 184 aa, Artificial Sequence
  Synthetic sequence.
DEEEKLRDEVEKIVKKIEKAIEDLRRHAEKSVTDIRKVLKELEDHIRESVKDAERFISEDRSEESVERLVRKLERNLDELRRRAEELKKRIDEDLERLKELVRRLKEELEKMLRDLREKVRRLGTSEKLEKILREIERIVEKLKEDLDRLLKRYEDELRRLKEELERILDTYRRLLEELERRLR

SEQ ID NO: 20428 - protein, 184 aa, Artificial Sequence; identical to SEQ ID NO: 20427
  Synthetic sequence.

SEQ ID NO: 20429 - protein, 184 aa, Artificial Sequence
  Synthetic sequence.
DTARELEREVKKIVDEIEDVIRRLRRHIEESVKRAEKVLREIEKHARESAKRIADVVSKDTSEETVEKLKEEIRRDFKRLEDEVRRLKKELEDNLERLREIVKELEDRLREALKKLREKVRRDGTTEELKEILERIEEIVKRLEEELRRLLEEYKKRIEELAKRIKEVLDEYRKILKRLEDETK

SEQ ID NO: 20430 - protein, 184 aa, Artificial Sequence; identical to SEQ ID NO: 20429
  Synthetic sequence.

SEQ ID NO: 20431 - protein, 176 aa, Artificial Sequence
  Synthetic sequence.
DEAEELRKDVKRVLDEIKKRHEELLRKVREDLDRIRRKLEELAKRHRELLKEVKKIVDRDGTTEKLKRELDELNKETEKRLRDLKRELEELLRELKKRLKDSNDELKREVERLRRENLVDDKIRREIDELIKKLEEESRRIEEEIKKLVEDLKREADKIMEELERETDKLKKELDK

SEQ ID NO: 20432 - protein, 176 aa, Artificial Sequence; identical to SEQ ID NO: 20431
  Synthetic sequence.

SEQ ID NO: 20433 - protein, 172 aa, Artificial Sequence
  Synthetic sequence.
SEKEKILEEIREVLKRILDRLKKELEDDKKSLDDNKRRTEEALREDKKSLEEIRRANVREDEVKKLLEDNKRRNEEVRKRSEDDLKKNKERNERLAEELKKEVDKLREDIERANLDDKILRDLEKALDKLRRDIEEILKRSRDLNKKLEDDNREALRRSEELNRELEERERK

SEQ ID NO: 20434 - protein, 172 aa, Artificial Sequence; identical to SEQ ID NO: 20433
  Synthetic sequence.

SEQ ID NO: 20435 - protein, 172 aa, Artificial Sequence
  Synthetic sequence.
SEEERIRREIKKILDDIKEEAERRLEEDKKSLDENRKKTEEVLKKIRDDLKRIEEAKIPREEIKDELDRLRREIEKIARESEKDLRRNKEENKRLAEDLKRKLDKLKEDLDRANLDDEILRRIEKLIEDLKRTIDKILEDSERLNRKLEKENREALKELRDLLRELEERLKK

SEQ ID NO: 20436 - protein, 172 aa, Artificial Sequence; identical to SEQ ID NO: 20435
  Synthetic sequence.

SEQ ID NO: 20437 - protein, 172 aa, Artificial Sequence
  Synthetic sequence.
EELERILRKITEMLREIARKLKKLLEDDKESLDRNKEKTEDDLRRDKESLDRLRKSNIPEEEVRKRLKENKDRLRKRSKESKEDLERNEDENDKAAKDLKRLLDELREEIERRNLDDKILRDLEELLKDLERKIRRILDESRKLNDELRKENKKAEDTSRRLNEELEERLRT

SEQ ID NO: 20438 - protein, 172 aa, Artificial Sequence; identical to SEQ ID NO: 20437
  Synthetic sequence.

SEQ ID NO: 20439 - protein, 172 aa, Artificial Sequence
  Synthetic sequence.
SELEEILKRVEDVLRDILRKLKEVLDRAEKVIRDNKRKTKKMLDDDKRSLDEIRKAKIPRDEIKDVLRRNKDRNRKLAEESDRDLERLREELERIAKELEDLADELRKEIEKANLDDKILRELEKRLEDLRKRIKDILDDLKRKLEELKRENEKFLRRSKKLNEDLERELET

SEQ ID NO: 20440 - protein, 172 aa, Artificial Sequence; identical to SEQ ID NO: 20439
  Synthetic sequence.

SEQ ID NO: 20441 - protein, 172 aa, Artificial Sequence
  Synthetic sequence.
DELEEIRDRIKRKLEKLKEETKRTLEEDRKSLDDNRRKTEEALRRDRESLERIERAKIPSDKIREVLERNKTELRKIFERSREDLRRNKERLKKANEDAKKKIEDLREEIKKNNLDRDILEELTRLLDKLRRDHERVSEESKRRNDELEEENRRVLKESEDRNRELEERLRQ

SEQ ID NO: 20442 - protein, 172 aa, Artificial Sequence; identical to SEQ ID NO: 20441
  Synthetic sequence.

SEQ ID NO: 20443 - protein, 175 aa, Artificial Sequence
  Synthetic sequence.
SELEKLLDDVKKDLKRIEEHLRRDEEDSKRRIEELERHLERDKKEVEKAIRELDKKPRDDDLKRELEEILDRNKKNLDELRRELEKIDRDNKKNLDELKRELEEIEKKIREIVKRDKVDEKVVRTIEKLLTDLERKIREIEKRSKELLTRLEEKIKKAERESRKLLRELTERIDR

SEQ ID NO: 20444 - protein, 175 aa, Artificial Sequence; identical to SEQ ID NO: 20443
  Synthetic sequence.

SEQ ID NO: 20445 - protein, 174 aa, Artificial Sequence
  Synthetic sequence.
DELKKLLDDVREVSKRLNDELRKIMEEIRKVSEDLNKELDDIVRKIKKVIDDISEKIKRDGPREEVKEELKRLEEELRRLLKRLRDEHRRLRERLERLLKELEEKHEELADRVRKANVDEEIEKEIRELLKENRRRADEIRRRAEKSLKDNERRVEKVEREAERLLREIEKELK

SEQ ID NO: 20446 - protein, 174 aa, Artificial Sequence; identical to SEQ ID NO: 20445
  Synthetic sequence.

SEQ ID NO: 20447 - protein, 174 aa, Artificial Sequence
  Synthetic sequence.
SELEKLAEDVKRKLTEIREKIKKLLKETRDVSRELNKELEDLLRRTTEVIDEIRKKIEKEGPREEVRELLKKLEKDHRKASEEVERKHEDLRRRHDKASKEVEKELRDLKDEVDKANVDEDIKKEIEDLLRDLERLLRDVNREVEELLKENRKRLEEINRTVERLLEEIEKRLR

SEQ ID NO: 20448 - protein, 174 aa, Artificial Sequence; identical to SEQ ID NO: 20447
  Synthetic sequence.

SEQ ID NO: 20449 - protein, 174 aa, Artificial Sequence
  Synthetic sequence.
SELEELVRRLREVSKRLNEELDRILDRTRRLAERISEDIKRLADETKEVIERIKEEIKKKGPDERVKRKLEELKRRHDEASKTVRKKIEDLLKEHRDLSKELEDKHRDLEDKLRKANVDEEIEKEARELLRDNRRRIEEINREVEELIRRLEKLLKEVNETVKRLLEEIRKDLD

SEQ ID NO: 20450 - protein, 174 aa, Artificial Sequence; identical to SEQ ID NO: 20449
  Synthetic sequence.

SEQ ID NO: 20451 - protein, 174 aa, Artificial Sequence
  Synthetic sequence.
SELEKLMKDVKEVIDEIRKKLRKILEDTTRVAKRNEEKLKRIADEAEKVIREIRDEIEKKGPRDEVERRLRRLETELRRLLDESRKENERLRREHEKLSKELRDLLDDLRRRVEEANVDEEIKKRIDDLLRRIEKEIEEINRRVEELHKRLEDLHKEIEDKVRELLTRIEERLK

SEQ ID NO: 20452 - protein, 174 aa, Artificial Sequence; identical to SEQ ID NO: 20451
  Synthetic sequence.

SEQ ID NO: 20453 - protein, 171 aa, Artificial Sequence
  Synthetic sequence.
SEVEEILERIERLIRDDNRKLKDVERRNRENIKEDNERLKRMMEELKKIADEIRKADVDKDTLEKLLRDLRRKVEKIKRDNERHNDEDRKTLKRIHEDNKRILEEIKDRIDKAPVDDSIRRTVEKLLEDNRRRNEEILKESEDLLRKNREKTKEIVERAERLLDKLRRERK

SEQ ID NO: 20454 - protein, 171 aa, Artificial Sequence; identical to SEQ ID NO: 20453
  Synthetic sequence.

SEQ ID NO: 20455 - protein, 174 aa, Artificial Sequence
  Synthetic sequence.
DEAEELKERIERLSRRIDEEYRRLLEDYERLLRELEKKIEDLKRELEKLVEELRREGTDEKLDRRLEEMLRELERELRELVERLRRDLEEIRKHIKRSRDRHERANRELERELKETGVTEELKEKVKEIVKRSEEDIRRLKKHLDESIRTAEEVIRRLREKIKRIIDTVRDAKR

SEQ ID NO: 20456 - protein, 174 aa, Artificial Sequence; identical to SEQ ID NO: 20455
  Synthetic sequence.

SEQ ID NO: 20457 - protein, 174 aa, Artificial Sequence
  Synthetic sequence.
SELEELEKRIRRLSEEIKKLLDDLRREYEELVKELRRRLEELRKEIERLSEELKAEGRREELDRELRKLEKELEDKLRELKKRLDEDKERVEKMIRDLEERHRRANKELEDELRRDGVTDEMREKVDEIVKRSRDVIKELREHIEESIRRAEKVLRDLEREVRKIIEDARERTR

SEQ ID NO: 20458 - protein, 174 aa, Artificial Sequence; identical to SEQ ID NO: 20457
  Synthetic sequence.

SEQ ID NO: 20459 - protein, 174 aa, Artificial Sequence
  Synthetic sequence.
REVDELRKEIERLSRKIEDDLKKLEDRYEELLEKLERDLEKLKEDYDRLLRKLEEDGDDEKLKRELDKDREKIERDLEDLKRKLRTDEKEVRDRVKELRDRHREMNERLKTRLRRDGVTEKAEEDVRRTVTESKKVIDELREHIKKSIREVEEAIKRLREHVERSIRRAEEATK

SEQ ID NO: 20460 - protein, 174 aa, Artificial Sequence; identical to SEQ ID NO: 20459
  Synthetic sequence.

SEQ ID NO: 20461 - protein, 177 aa, Artificial Sequence
  Synthetic sequence.
SEEEKLDEDLERLREEIRELHRELEELIKKLREEVRRIIEKVRTHLKRDRDRAKEVIEKVRGEKDLTKVDEENERNTRDLERKLEEVKKEIKKLADDLKRRNEEIKKELKRKAEELKKRIKDERMREKLEKIKKDVDKLSKELHDKLDKVLKEIEELLRDVKRAIKKVNDDIKERLR

SEQ ID NO: 20462 - protein, 177 aa, Artificial Sequence; identical to SEQ ID NO: 20461
  Synthetic sequence.

SEQ ID NO: 20463 - protein, 182 aa, Artificial Sequence
  Synthetic sequence.
DEIRELVRRFEELVRRNVEHLKKLLRDAEKLVKENEKHLEDLLREIEETVKRLLDKIRREGPTEELKREAEKKAKELEERLKKNKEDHEERDKRIRDALKRNEDEHRKRSERLKEELDRDIKDKDKARDVEKRIEDLNREIKEIIRRVEERLKELNKRIEKLLEEVRDTLRRLKEELDRAMT

SEQ ID NO: 20464 - protein, 182 aa, Artificial Sequence; identical to SEQ ID NO: 20463
  Synthetic sequence.

SEQ ID NO: 20465 - protein, 182 aa, Artificial Sequence
  Synthetic sequence.
SEIEELLKEVERRVRENKKHLKRLLEDIKRLVERNAEDLERILRDAERIVRELIKKIRRDGTDKKLRDEAKEASDRIREKLEENERRHREESERLKEKLERNKRTHDDEDRRVRRRLERDIKDKDKLRRIEKALEDLNREIEEILRRVKEEIERLNREIEELLKRVEEELKRLEKELEEELK

SEQ ID NO: 20466 - protein, 182 aa, Artificial Sequence; identical to SEQ ID NO: 20465
  Synthetic sequence.

SEQ ID NO: 20467 - protein, 182 aa, Artificial Sequence
  Synthetic sequence.
SEIEELLKEVRKRVKENAEDLKRLLDEAKKLADDNVKHIEDLIREVEDIIRRLKERIKRTGNTEELRKEIKDKADEVREKLERNKRRHDELDKRLKDELRRNKKEHEEESKEIEDRLRRDIKDKDKARRLREELRKLNEDIERLLKRVEDELRKLNKKIKDILEEVEEVLERLLRELREEER

SEQ ID NO: 20468 - protein, 182 aa, Artificial Sequence; identical to SEQ ID NO: 20467
  Synthetic sequence.

SEQ ID NO: 20469 - protein, 187 aa, Artificial Sequence
  Synthetic sequence.
REKEELKKELKKLIEELKRSHDELKEELKRLLKRIEDILRENRKTTEDLSRELKKLLEELRKKVSEEELKRLRDELERLKKEDEEMNRRIEEKLRRLSKRVKDYLDTSRKRLEDLVRRVDEAASQDRRREELKRLLEELRRMIKELKDRNRKALEELEKVIREIEEEIKDINRRLREEIRRLEEEAR

SEQ ID NO: 20470 - protein, 187 aa, Artificial Sequence; identical to SEQ ID NO: 20469
  Synthetic sequence.

SEQ ID NO: 20471 - protein, 187 aa, Artificial Sequence
  Synthetic sequence.
SKEEELRETLKRLVDEIRRMLEEDRRSDEELVRRIERVLEEDKREDDRLHKRLRDELRRLRKDVDEKTLKEIEEKIRELNKRNEDSLKKIEDDLRRLNEENRKSLEELEKKLEKLARDAEEVLKRDKREDELRRLLRELEEMAKKLEKELRDNNRDLRRVAEELKELIDDNTRKLKEVIEKLEREIK

SEQ ID NO: 20472 - protein, 187 aa, Artificial Sequence; identical to SEQ ID NO: 20471
  Synthetic sequence.

SEQ ID NO: 20473 - protein, 187 aa, Artificial Sequence
  Synthetic sequence.
SEKETVRDELRKLVETIRKLLEEDKESDKRLADRIRELNEENKEDTERLIRELEKVLEELRKKVSEDELRKLRKRIEDLRRRDEELNKRSREKLEDLNERNKDSLRRIEDELRKLVEEAREVEKRDNDEERLRKLLERLERVIRDLLRKIEENNKRLRKAIKELLDELRKINKELREVIKKLLDDAR

SEQ ID NO: 20474 - protein, 187 aa, Artificial Sequence; identical to SEQ ID NO: 20473
  Synthetic sequence.

SEQ ID NO: 20475 - protein, 187 aa, Artificial Sequence
  Synthetic sequence.
SEKERLKEELEKLSKEIEDILRDDKRSDDELRRRLRELLEKDRREDERLNEELKRMLEEARKRVSEDELRAIKKEIEDLNRRNEESLRAIEEKIKRLNDENRKSLEEIRRRLKRLVEEVDELRKRDNREELLRRLLEKLKRMAEKLKRDIEDNNRKLRKVATELAKEIEDNSEKLREDAKRLSEKIK

SEQ ID NO: 20476 - protein, 187 aa, Artificial Sequence; identical to SEQ ID NO: 20475
  Synthetic sequence.

SEQ ID NO: 20477 - protein, 187 aa, Artificial Sequence
  Synthetic sequence.
DEEEELRKRLEKLSKEVRELLRRDEEEDRRLNRELEELLKDHERTVRDLSREVEDLLRKARRKVSEEELTRLRKKLRDLEEESKEALRELRRRVEELNKENKKSLDDLERRLKELEDRAREVEKRDRREDELRELLRRLEDVIRKLAEDLKRNTEDLRRVIKELAERLEELNKRLKREIRRLKEELR

SEQ ID NO: 20478 - protein, 187 aa, Artificial Sequence; identical to SEQ ID NO: 20477
  Synthetic sequence.

SEQ ID NO: 20479 - protein, 181 aa, Artificial Sequence
  Synthetic sequence.
EKSERLRERLRDLLRKHKELLDRNEKTLEEAERRVEKLLEDNERELKKIEDEVRELLKRLEDDETLRRLLEEAKEVLERIRRKNKKLREDLKRVLERIKEENDRHHEKVKEDLKRIEDRIRKDGVTKEILREIEERFKRLAEDLKRSNDKVRELVDKAEKDIRKSNEELRKLARDVRERVR

SEQ ID NO: 20480 - protein, 181 aa, Artificial Sequence; identical to SEQ ID NO: 20479
  Synthetic sequence.

SEQ ID NO: 20481 - protein, 181 aa, Artificial Sequence
  Synthetic sequence.
SDEDRLRELLRKLREDHERIVRELRKRLEEVLREIERLLKKNEEDLERIRREVEELLKRISDDEELRRLEKRAEEALRKIREENKKLRKEVRDTLRDILRRIEEHHREVDERLRRIEDRIRKEGATEDIEREIRDTLRRLREDLERIKEDVERLRREIKKRIEDSNRKVRDLLRRVKEAVR

SEQ ID NO: 20482 - protein, 181 aa, Artificial Sequence; identical to SEQ ID NO: 20481
  Synthetic sequence.

SEQ ID NO: 20483 - protein, 181 aa, Artificial Sequence
  Synthetic sequence.
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRRDGADEKILREVEDLLRKVAEDLKRSNDEVKELAERLEETIRDLLRRIEEILKEIEERVR

SEQ ID NO: 20484 - protein, 181 aa, Artificial Sequence; identical to SEQ ID NO: 20483
  Synthetic sequence.

SEQ ID NO: 20485 - protein, 181 aa, Artificial Sequence
  Synthetic sequence.
KDEERLKRFLEDIRRRHRELLERNERALDEIRRRHEELLRRNEEAIKDIERRVRELLKRLEDDDTLRKLEKKVRDDARRSRKRNEEHHREVKEELDRSRKRNEDHHREAEREMRRIEEKIKKDGATEEILKEIEELLRRLEENLRRNHKEVRELLEKVRRNIEENHREVRRLLEEVERRAR

SEQ ID NO: 20486 - protein, 181 aa, Artificial Sequence; identical to SEQ ID NO: 20485
  Synthetic sequence.

SEQ ID NO: 20487 - protein, 181 aa, Artificial Sequence
  Synthetic sequence.
DEEETLEDVLRELEERVEKLLRDLTRDLERVEKEHKELLKRNKEAIDEIEKRIEELLKRIEDDEKLRRLKEEVRKLVEESRERNKRHHKEVREVLERIRELLERLEKELRRALEEIRDKIRKDGATDEILRKIEELLRRAEEVIRDLERKVRKLERDIRENIKKNHREVREILRKIEEDVR

SEQ ID NO: 20488 - protein, 181 aa, Artificial Sequence; identical to SEQ ID NO: 20487
  Synthetic sequence.

SEQ ID NO: 20489 - protein, 175 aa, Artificial Sequence
  Synthetic sequence.
KDEERLRELIKRINTEVKKSLDENKERLDKVEEDIRRSLKENEDRMERVRREVEKANVDEKVKKEAEDALRELKRKHDELRKEVEKLVKELEDKHKELEERHREASKDVERVLDKEIDKIEEIKKRLEDILEETRDMSRRLNEELRRILERVKEVSKELNRELEEILKRVEDARR

SEQ ID NO: 20490 - protein, 175 aa, Artificial Sequence; identical to SEQ ID NO: 20489
  Synthetic sequence.

SEQ ID NO: 20491 - protein, 175 aa, Artificial Sequence
  Synthetic sequence.
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESDKMEEIKKEIEKILRDIERVSRELNKKLEEIVRRLKKVSDELNRRIEEIAERVRRRRK

SEQ ID NO: 20492 - protein, 175 aa, Artificial Sequence; identical to SEQ ID NO: 20491
  Synthetic sequence.

SEQ ID NO: 20493 - protein, 175 aa, Artificial Sequence
  Synthetic sequence.
KDEERLDEELKRVNDEVRRLLARNEETLERIEREVKRLLDENEKRAEDIRKEVEDSNVDERVKTEAKKALDELRERHRELKKELEKLAEELRRKHEELEKRHRDKSRRIKEMLDKETDKIEEIEKTIREELKETRKVSEELNRELERILRELRKVSEELNKDLEKILRRVKKERK

SEQ ID NO: 20494 - protein, 175 aa, Artificial Sequence; identical to SEQ ID NO: 20493
  Synthetic sequence.

SEQ ID NO: 20495 - protein, 175 aa, Artificial Sequence
  Synthetic sequence.
SEEERLREILKDINRRVEELLKENEERMERIREELEELLERLKEELERIRKRVEEENVDEEVKRRFDEVAEEIKRRLEELKKEAEDKLRRLREEHKKLKEEHERASERIEEVLDKESDKVEEIEKDIRRLLRETERVSEELNKKLEEIARELREMIKEIKERLKRILEEVEKRRR

SEQ ID NO: 20496 - protein, 175 aa, Artificial Sequence; identical to SEQ ID NO: 20495
  Synthetic sequence.

SEQ ID NO: 20497 - protein, 175 aa, Artificial Sequence
  Synthetic sequence.
SEEDELRRLLKEVNERVERLLDEIRKELEKIAEELRDLLKKNEDKLREIKRRVEENRVDEEIKKDAERALTELKEEHERLDREAKKDLDRIRKELERLEEEHRRVSERIEEVLDKESDKTEDIAREIRELMERTRRVIEEIKKELRDILEKLRRVSEELNKKLDEILKRIEDRTR

SEQ ID NO: 20498 - protein, 175 aa, Artificial Sequence; identical to SEQ ID NO: 20497
  Synthetic sequence.

SEQ ID NO: 20499 - protein, 182 aa, Artificial Sequence
  Synthetic sequence.
REIEKLIRDYRRILRELSEKIRRLAEEHEDIVRKLIETLKRLIDEIRKIMEDLSRLLRRDGSTEELRKRARKSLEDLRRKIREIKKRLEEEHKKTRKKVKELEDEAREKTKELEKRLKDANVPKKLMDELRRVSEEVNTRLEKLLRDLEKKLRDSEERAKELIRRIEKTLEDIDRRLKEEEK

SEQ ID NO: 20500 - protein, 182 aa, Artificial Sequence; identical to SEQ ID NO: 20499
  Synthetic sequence.

SEQ ID NO: 20501 - protein, 184 aa, Artificial Sequence
  Synthetic sequence.
RELEKLMEDAERYAKRSMEAFEDLIRKHDELLKRLEKKLRDLIKRIEKLLREIKEKIERTGTTEDLEREVREIVKRIREFLERLDRDAKRIEKENRDVDERLKRENEKVSRRLREVLEELRKDVSEELLKRAKELIETIEERSKRVVDENKRVVERSRRRLKKLLEDIERVLERIERRLTEAKK

SEQ ID NO: 20502 - protein, 184 aa, Artificial Sequence; identical to SEQ ID NO: 20501
  Synthetic sequence.

SEQ ID NO: 20503 - protein, 184 aa, Artificial Sequence
  Synthetic sequence.
SELEKLLEDIERYVKRSKEKARELIKRHKEYVRRSEERLRRLIEKLEKLAEKLKELIRRTGTTEELEKELKDIAREVREVLKKIKEDNKRAEDKNREEDERLKRENEKMKEDVRKILADLKKDVDDSLLKEVEDLLRKVEEESRRVIEENKRVVEESRKRSERLLREIEKELRRVEKEFRDEKR

SEQ ID NO: 20504 - protein, 184 aa, Artificial Sequence; identical to SEQ ID NO: 20503
  Synthetic sequence.

SEQ ID NO: 20505 - protein, 184 aa, Artificial Sequence
  Synthetic sequence.
SELEDLMRDVKRYADESARRIEEIIKRHRKLVREISKKIEELIRELRKLIERILELIRRDGDTEELKKEVEKIREEVEEMLERIKREVDKVKDENRRLDEKVRRDNERKKRDLERLLRELRDKVDEELLDRARKLIREIEERSKELSKRNKEEVDRSEERIRRLLKRAEEELRRVREELKEASR

SEQ ID NO: 20506 - protein, 184 aa, Artificial Sequence; identical to SEQ ID NO: 20505
  Synthetic sequence.

SEQ ID NO: 20507 - protein, 181 aa, Artificial Sequence
  Synthetic sequence.
SREEEIRELLKRSKESLEKLLRELDKEHKESEKSARELLKRNEKRLREIREEIRRLNITEDLLKEIEDLLKRLEDKNRKVAKEYEDLLRESKRHLDELRKEYERLLKELEDKLEDLRRRRKSEEVMKRLLKEIRDVNKEITERLEEHRKRLEEINRDVERIIRELNEEHKEVLKRIREKAK

SEQ ID NO: 20508 - protein, 181 aa, Artificial Sequence; identical to SEQ ID NO: 20507
  Synthetic sequence.

SEQ ID NO: 20509 - protein, 182 aa, Artificial Sequence
  Synthetic sequence.
SEREELRKLLRRIEEEAKRLLEELKRTTDDTRRENEELLRRLEELSKETKKRVEDLLRELDRDKTVKDRLRTELERLERRDRELLERNKKHNKDLEDTDRDLIRKLKKLLDELKERAERVEKTGEDVKDVLKKLEDVLRELKKAVEKIKRDNKRAVDENRELVERIMKENKDAMKKLEEDVR

SEQ ID NO: 20510 - protein, 182 aa, Artificial Sequence; identical to SEQ ID NO: 20509
  Synthetic sequence.

SEQ ID NO: 20511 - protein, 182 aa, Artificial Sequence
  Synthetic sequence.
SEREELRDLLRRIKEDAERLLKEHRDLLEEVRKEVEKLLRELRKLSKETEDEAERLLRELRRDETVKEKLKRRLDELRKRDEDVERRLKEELDELRRRNKKIEDDLRKKLEDLEREMREVDRRGEDIKDVLKKLKEVLKKLRDDVEKSKRDTKRVLDRLRDTVRKIMEENRRALKEIADEVK

SEQ ID NO: 20512 - protein, 182 aa, Artificial Sequence; identical to SEQ ID NO: 20511
  Synthetic sequence.

SEQ ID NO: 20513 - protein, 182 aa, Artificial Sequence
  Synthetic sequence.
DDEERLREEVERVERTVRDLLRRLRELTKKTDEDNRKLLKEHEDLLREVVKRVTDLLKDLQRDEEVKRKLKEDLDRLREKNKEILERNKRHNDELRKKDEKLLRELEELLERLKKRIKEVEETGKDVKDVLKEIKEVLREVTERAKEIADDNRRALEENEREVKRSKEDTKRALRKLEEEVK

SEQ ID NO: 20514 - protein, 182 aa, Artificial Sequence; identical to SEQ ID NO: 20513
  Synthetic sequence.

SEQ ID NO: 20515 - protein, 181 aa, Artificial Sequence
  Synthetic sequence.
SSSEELEKLLEEVRRELRRLAEEVKRLNEEIDKDIDRLAEENDRLHKEVKKDLDRLNLPDESLRRIEEELRRNLERTREILEDLKRRLDESRKEAEKILDELRRTLEKLKRDIDDSDTKGNTEEVVKRILDEIRRTLEEIKEIARRYLEKNKKEMREIRETMKRDNDHLEDLLRKIRETAR

SEQ ID NO: 20516 - protein, 181 aa, Artificial Sequence; identical to SEQ ID NO: 20515
  Synthetic sequence.

SEQ ID NO: 20517 - protein, 174 aa, Artificial Sequence
  Synthetic sequence.
SDEERIRKKLREIEERHKKLSEELKELLRRSEESVRRLLEKNRKDLDEVRKRIEDLNLTEDILKKLREELDRHRRELERLAREYEKLLRELEREVREVNKRVEETMREIKRRLRETKVDEEVERRLDRLLDESRRLAEELKERIKRVNKRARELVRESEEHLRELLEKVERDAT

SEQ ID NO: 20518 - protein, 174 aa, Artificial Sequence; identical to SEQ ID NO: 20517
  Synthetic sequence.

SEQ ID NO: 20519 - protein, 178 aa, Artificial Sequence
  Synthetic sequence.
SDKDELKTRLDRVREIIERLARESEELHKELKKRLEDLKRDSERLHRKNLEDIRRSNLPREKLERLEESNRRNLRRSEDTLRKLEEEIRRNEERTKKLLDDLRRLVEELRDKIRRVGDEKEVTDRIREDIKRVIEEVRRLAEEDKESVKEILKKIEKLADEDRRSVEKNHKEVEDTRR

SEQ ID NO: 20520 - protein, 178 aa, Artificial Sequence; identical to SEQ ID NO: 20519
  Synthetic sequence.

SEQ ID NO: 20521 - protein, 175 aa, Artificial Sequence
  Synthetic sequence.
RDEERAEELLKEIKDTVDELKKEVEKVLDESRKRDKKLNDELRKLLEDSRRTIERDVREDDDLRKEVEEKNRETEKRLKEINDDNERLNKESEDKLRELKKEAEEKLKRIRKIIKDGDRGDKLLEELRKILEELRKKVKDLIEEHRRLVKTSADRVKRLLDEHRRILKELKDRRK

SEQ ID NO: 20522 - protein, 175 aa, Artificial Sequence; identical to SEQ ID NO: 20521
  Synthetic sequence.

SEQ ID NO: 20523 - protein, 182 aa, Artificial Sequence
  Synthetic sequence.
DEAEELIKRIEDLLRELARRMEEILRRHEEYVKKSAEDVKRLLEEVEKLADDLRREVERDGTTDELRKKVKKIADELRKVLEDLKRANKKVEDENRKLDDDIRKTVEKIEKDVRDALKDLNLPEEVARKIEEVLRRVKEELTKLVEENERKLRESRERSKKLAKEVEDLLREIKRRVEELER

SEQ ID NO: 20524 - protein, 182 aa, Artificial Sequence; identical to SEQ ID NO: 20523
  Synthetic sequence.

SEQ ID NO: 20525 - protein, 174 aa, Artificial Sequence
  Synthetic sequence.
SERETLEELLERVERLLEKLKRELDEAHKKNKEDLDRLRDKNRKRLEDIKRTIDRIDVREELKKEADRLLKELEELTREIVRRDEDLNRRLAEKVERLKREVERRLEEIRRRVDKDGVTEELLKELKEVLERIRKEVEKLLRTLEEINKTTRKLVEETNEKADRILEKVKRDAK

SEQ ID NO: 20526 - protein, 174 aa, Artificial Sequence; identical to SEQ ID NO: 20525
  Synthetic sequence.

SEQ ID NO: 20527 - protein, 174 aa, Artificial Sequence
  Synthetic sequence.
SEDEKMEELIKRSEDKLRKLEEDVRRLLEEIRRRAEDNTRRNERTLREIERTLREIPNDKELADRLRELLERLRRRNEELKRELDKLLRDLERKLEELKRRHKEKLDRLRDRVRKTGVTEELVRELEKIDRETTEVVKKLLEELKDIMRRVHERSEESLREAKKILREVEERAR

SEQ ID NO: 20528 - protein, 174 aa, Artificial Sequence; identical to SEQ ID NO: 20527
  Synthetic sequence.

SEQ ID NO: 20529 - protein, 179 aa, Artificial Sequence
  Synthetic sequence.
SEEEELDKLLKEVREKDERLKREVEELLRRIKKRLEELKRENDELLKEVREVLKKLAKETDVSDEIIKRIEELLRRLEKTSEELRKDVERKRKELEEEARRLHEESEELLKELRRILERGDLPVEDVLRRIEEVARRIERLYEELLKKLRDVVREIEKRVREHNEDVKRVVREIEKRIK

SEQ ID NO: 20530 - protein, 179 aa, Artificial Sequence; identical to SEQ ID NO: 20529
  Synthetic sequence.

SEQ ID NO: 20531 - protein, 178 aa, Artificial Sequence
  Synthetic sequence.
DEVEKVKEEIKRLNEDVRRLVEEYRKRLEKLNRDHRDYVKKSEKRIRDLIREVRRRPVTDEVVKRVEEELEKIERENREKSKEDEEKNKELEDELRRRKKESEDVLRELKDRVRKAGLDEDATREIDKALEDHRESVERLVRELERLNEENRKSVKKSEEDSRRLLEEVRRELRRKRK

SEQ ID NO: 20532 - protein, 178 aa, Artificial Sequence; identical to SEQ ID NO: 20531
  Synthetic sequence.

SEQ ID NO: 20533 - protein, 175 aa, Artificial Sequence
  Synthetic sequence.
DEEERVEELLRRDRESDKELRERLRKLNEENRDETEKLIRELEDSLRRLKEELEKKGKDIEELLRDVERYLRESRKRVEDLKREDEKLNKESEDKLDELNKRNEKSLRELREKLRRDGATKELEKELRDNNRRLEEVIRRLEEELKRISEELRKVIKKLKRDNEEKLRRLDEATR

SEQ ID NO: 20534 - protein, 175 aa, Artificial Sequence; identical to SEQ ID NO: 20533
  Synthetic sequence.

SEQ ID NO: 20535 - protein, 175 aa, Artificial Sequence
  Synthetic sequence.
DEEERVKDINRRNEEDSRRLERRIRELNRENRKSSKELADRVRELLKRAEERLRTEGKDKKELLEEAEDLLRKLTDDLRKLEEDDERMNRDIERKLRELKKEDKDRNDRTKEELERDGVTEELVKKLEDINRRLREAIKRLEDTIREINKELRKKIKELLDRLKEIVKRLEDRAR

SEQ ID NO: 20536 - protein, 175 aa, Artificial Sequence; identical to SEQ ID NO: 20535
  Synthetic sequence.

SEQ ID NO: 20537 - protein, 175 aa, Artificial Sequence
  Synthetic sequence.
SAEERIKRINKKNRDDSEKLKRRIEESNRENKRSSDELVKRLEELLRKLEEDLKRKGKDDEDLLREVKKRAEEIRERIKRLEDDDRRYNKKSKEDLDDLRREDERLNEETKRELDRDGVDKELEKKLRKINEDLKRAIRKLEEDNKRANEELKKRAEDLLREIEEIIRRLEERTR

SEQ ID NO: 20538 - protein, 175 aa, Artificial Sequence; identical to SEQ ID NO: 20537
  Synthetic sequence.

SEQ ID NO: 20539 - protein, 175 aa, Artificial Sequence
  Synthetic sequence.
DEERRAEEINRRNKKDSDRLAETIEKILKEDEDRDKELHDRLEEILKELRKRLEEEGKDIRELREEAERLIREIREEIKRLNEENKKSLERIRKKLEDLRRKDEKLNRETRRKLERDGVTEELVKELEKINEELRRDIKRLIDEIRENTERLERMIRELEKKIRKILKELDDRAK

SEQ ID NO: 20540 - protein, 175 aa, Artificial Sequence; identical to SEQ ID NO: 20539
  Synthetic sequence.

SEQ ID NO: 20541 - protein, 176 aa, Artificial Sequence
  Synthetic sequence.
DLEKELTDLMKKHAEENDRLRRRLEELLKRHAEENDRLRDRVRRINEEVEEILRRAPRSEELEKLKRDHERRVKEAEDRLRELHRLVEERVREIKDELRKLHEKVKKILEDLKDIKEEDVIREALERIKRISDESKRTIDEVVKEIEKITKESRDLITKYERDVERSIEEAERRAT

SEQ ID NO: 20542 - protein, 176 aa, Artificial Sequence; identical to SEQ ID NO: 20541
  Synthetic sequence.

SEQ ID NO: 20543 - protein, 184 aa, Artificial Sequence
  Synthetic sequence.
SLEERIRELLKRHEDLTRKLKKENDESLRRHRELTKKLRKELEELLKRAEDVLRDLEREGLREEDKEEIERRLKELREKAERLARKDEELLRRAEEKSERLRTEDERLLKELEDEARDLRRKGSDAREVDDLLRKIEDISKKSADRNRELNEELEDISRRSKEEMKKLLDELRRDVEEIKKRTK

SEQ ID NO: 20544 - protein, 184 aa, Artificial Sequence; identical to SEQ ID NO: 20543
  Synthetic sequence.

SEQ ID NO: 20545 - protein, 184 aa, Artificial Sequence
  Synthetic sequence.
DLEDRIRRLLEESKKNLDELKRRNEESLKRSEDLLKDLKRKLDDLLRKAEEVLRELRKRGLDEDLATKIKKELEDLKREIEELVERYKDLNREIKERSDKLVKEYEDLLKELTERAKDLTDKGSDARDVDRLLEDVKRISDTVHKRNEELNRRLREISERAREAVEDLLRRLEEIVRRIKTRTE

SEQ ID NO: 20546 - protein, 184 aa, Artificial Sequence; identical to SEQ ID NO: 20545
  Synthetic sequence.

SEQ ID NO: 20547 - protein, 174 aa, Artificial Sequence
  Synthetic sequence.
EEIERILEKLRRDLEEVRKKVKKVLDELRELTEELKRKVEKVLRELKRLSEEIARRVEKGLSEEELKRLDEEVEERVERIKRELEEDNRRVEEKVREVKERLDDEAREIEERIKKAPETRELRTVAREIREELKKLREELDKLLREHRETSKELEKRLKEVLDRHRELSDRLRR

SEQ ID NO: 20548 - protein, 174 aa, Artificial Sequence; identical to SEQ ID NO: 20547
  Synthetic sequence.

SEQ ID NO: 20549 - protein, 181 aa, Artificial Sequence
  Synthetic sequence.
DELREMIRKVREINERSKDEIRKILEAIKKIVEDHRRVVEKLLRDLKDIVRRARETRSRPTPEELIKTIEKLLEELKRELERLERENKRLLEEIKRRVKELEDRNRELDKELRKEVEKLRTSEEARKRLEDLSRENKRSLDELRKRIDDILDENRRAVEESRERAKRVLDEVRETLKRDEK

SEQ ID NO: 20550 - protein, 181 aa, Artificial Sequence; identical to SEQ ID NO: 20549
  Synthetic sequence.

SEQ ID NO: 20551 - protein, 183 aa, Artificial Sequence
  Synthetic sequence.
SEVDEVEKRIREAIKRHRDRVKKIIDEIKKLLDDHRRRVKKLEDDLKKRADDVRKETKDGDRDKRTLVERVREELERARREIEEDLKRSREELKKIEKKAREVHKKSRDDLERLREEIERKVKGKEARDRIRELLKKYEDDLRRSEKEIEDILRRYERELRESEKRMREVLKRLEDELRRAEK

SEQ ID NO: 20552 - protein, 183 aa, Artificial Sequence; identical to SEQ ID NO: 20551
  Synthetic sequence.

SEQ ID NO: 20553 - protein, 183 aa, Artificial Sequence
  Synthetic sequence.
DEVKEVEKKIRKVLREHKKLVEELIRKIKEMIDRHKEIVERIIRTIRRELKRAEELARKGDKDKKTLLEEIRRRLRELAERAKEKHDKSREDLKELKRDAERKLRESEKRLKELEDEARRKVRGEEMEKRIEDLLREYREELERSRRELERLLEEYEKVVDESRKRIKTILDEVEKLLRDLDR

SEQ ID NO: 20554 - protein, 183 aa, Artificial Sequence; identical to SEQ ID NO: 20553
  Synthetic sequence.

SEQ ID NO: 20555 - protein, 174 aa, Artificial Sequence
  Synthetic sequence.
SSRERFKELSDRNKEVVERSRRRLEKLLEENKREVEKSKKRIEDMLRKADDLLRKLPVSEELLRRAKEMLRRIKEEVDKVEEDNERVDRELRKEVKKIEDDNRREDKRLADEVRRDGVTERLSEEIKRLIETHEKLLRELEKKIRDLIRKHREDVERIIKEIDKLLKKIDEDTR

SEQ ID NO: 20556 - protein, 174 aa, Artificial Sequence; identical to SEQ ID NO: 20555
  Synthetic sequence.

SEQ ID NO: 20557 - protein, 171 aa, Artificial Sequence
  Synthetic sequence.
SEEETLDELNRENEELLRRSKERLDRSHEKLKKILDDISERVKELLKRAEKLLRDENVDEKLKKEFDRRLKELRDKLRRLEEEVKKYLEESKREVRKLEETNRRMDEETRRRRDDKDRVSDRIRRLLEEHERVVRELLESNDRMAERLRRVAEELVKEIKKELDDLRRRTT

SEQ ID NO: 20558 - protein, 171 aa, Artificial Sequence; identical to SEQ ID NO: 20557
  Synthetic sequence.

SEQ ID NO: 20559 - protein, 171 aa, Artificial Sequence
  Synthetic sequence.
SEEETLERLLRKNEEELKKSKERLKELNRTNRKELRDSERRIKRALEEVEDLIRREKVDEDLLRELKRLLEELRRLVEKLKEENERADEETRKKVKELEDRNRKANEDLRRRRDDKDEVTKTIERIIEEHRRMIEELIKEIRKLIKEHRDKVRELLKRIKDILRRLKEERR

SEQ ID NO: 20560 - protein, 171 aa, Artificial Sequence; identical to SEQ ID NO: 20559
  Synthetic sequence.

SEQ ID NO: 20561 - protein, 188 aa, Artificial Sequence
  Synthetic sequence.
SLDERIDELRRTLEEMLDRIRRSNEEVLRDSRRVLEEIDERARRVVEEAEKLLREIDKRKGKNEDAERLLREIKKRIEDLRRRIEKLKKEYEEEDDRLEKELRDLHREIDRLKRELETEADRLKKENVSEEDIKRLLEKVREIIEELKRRNDELNKRIKDLSEEMRRRVKKLLDEIKEDLERIKRRAD

SEQ ID NO: 20562 - protein, 188 aa, Artificial Sequence; identical to SEQ ID NO: 20561
  Synthetic sequence.

SEQ ID NO: 20563 - protein, 188 aa, Artificial Sequence
  Synthetic sequence.
SLEEEIKELIKRAEEVLERLARSNKEVLDRSRKVLKELRETNKRLLEELKRALDKIRKDKGDDEDLRRELTKIREKSERLRKKSKDLEDDYRRLDEELRKRIKELHDKIKRLLEELKEKADDLRRRNVSEEDIKRLLEEVERIIRKLAEENKKLNKEIEDLSRRARERNERLLREVEKIIRDIRERAR

SEQ ID NO: 20564 - protein, 188 aa, Artificial Sequence; identical to SEQ ID NO: 20563
  Synthetic sequence.

SEQ ID NO: 20565 - protein, 181 aa, Artificial Sequence
  Synthetic sequence.
SEVEELTKKAKKIIEDHRRYVEKSARDVERLIREHERYVEESAKKVEKLLREIKELDKRDLREEDRKRVDETIKRILDKLREENERAKEENKKMLDKLRRDNEKVERENRKLLDDLRREVKDIRDKDKIRELERENEEVIKESRERSERLARKNKKVLEDSERRSRELSERVERLLDESRR

SEQ ID NO: 20566 - protein, 181 aa, Artificial Sequence; identical to SEQ ID NO: 20565
  Synthetic sequence.

SEQ ID NO: 20567 - protein, 171 aa, Artificial Sequence
  Synthetic sequence.
REEDVLRKLEKEIRDLLERIKRKSEELIERNKRTNDDIRRRSKETIDELRELTKRVDIDDSVRRRVEKVEEELERENEKLSRDDKRSIEENKKKDDELARRVEKVIEDLRRANVPDEDIRREAERLLREMEKRAKENEEDVRRNLKRLRDALKEHKEKVEKLLEEIKKDAK

SEQ ID NO: 20568 - protein, 171 aa, Artificial Sequence; identical to SEQ ID NO: 20567
  Synthetic sequence.

SEQ ID NO: 20569 - protein, 175 aa, Artificial Sequence
  Synthetic sequence.
SETDDIIRRIRRLIEELLRNSKRTSDDNRRTLEELERNSERAIKKIKDVLEKLSRDRVPEDELKKRLDELREEIKEVEERHEELLERDRRKLEEVEKEHERRLEEIKRRIEKVLRDTSSDEKAEKIRKELEDMARESRKLMRENKREVDRVEKKSRKLLKDILDEIDKVDEDEKR

SEQ ID NO: 20570 - protein, 175 aa, Artificial Sequence; identical to SEQ ID NO: 20569
  Synthetic sequence.

SEQ ID NO: 20571 - protein, 176 aa, Artificial Sequence
  Synthetic sequence.
SEAERIAREVERVLREIEEEVKRLSEENRELVERIERESRKSIEDIERRLEEVKRKVKREELLKEVEKELRDLDRRHKEKHDEVERESRELLKRIEEVLDRARKELEELEKRAREENRLDRRLLEALRREVEEVLKRIRETLEENRRRNEEVLRRDKELLERIRDKIRRVLEELKR

SEQ ID NO: 20572 - protein, 176 aa, Artificial Sequence; identical to SEQ ID NO: 20571
  Synthetic sequence.

SEQ ID NO: 20573 - protein, 177 aa, Artificial Sequence
  Synthetic sequence.
DEERELRKLERELEDVVRKDRKILEDLRRTLDTVRREDERILRELEETLKEVVKRVREKGTTEDVDRKVDENRKELEKAKRKSEEETERNKERLDDILRRSERRLEDIKRRLDELERRGEDIRRISEEAKELLKRWEDESRKVEEEHRRSLEEWRERSERIAREHKKSLEKLEKDVE

SEQ ID NO: 20574 - protein, 177 aa, Artificial Sequence; identical to SEQ ID NO: 20573
  Synthetic sequence.

SEQ ID NO: 20575 - protein, 181 aa, Artificial Sequence
  Synthetic sequence.
SIEELLKKLEEDIERVLRKSEELLKRNEEENKKVLDESKRLLDELKKRAEKVLRELKDEKRRLEDAERKIREMEKEARKVLEDSKRTSEKLKKKAEDVLKRSKEEVEELKRRVKKVREDGTTEEVLKEIVKRVRDDIERHDRESKKLSDENKRVVDEHRKRSEELARKLEELLREIRERVT

SEQ ID NO: 20576 - protein, 181 aa, Artificial Sequence; identical to SEQ ID NO: 20575
  Synthetic sequence.

SEQ ID NO: 20577 - protein, 183 aa, Artificial Sequence
  Synthetic sequence.
SDIEKLAEEVDRLNKELTDRLERLREEHKRTLDEIRKTLEKLKREVDKELEEVKKIVKDGDNRERLEEDLRRRLEELEKRMKELKDRNRRKAEESERKLRELLKDNKDKLEKIKDDARKADSRDERVKKILDDLKRKNEENDERVERIMRELRERNRKLNEEIDKIVEDIRREVEKVSREARR

SEQ ID NO: 20578 - protein, 183 aa, Artificial Sequence; identical to SEQ ID NO: 20577
  Synthetic sequence.

SEQ ID NO: 20579 - protein, 180 aa, Artificial Sequence
  Synthetic sequence.
DAVDRVREENKKDSERNKKRVEDVKRRAEERSRRNKKKVKELRDRNREEIKRIKELKDRGEVTEEERKKIRDRYKKDEDRVRKEDEETKRRLEEETKEDDRRNEREEREYEKKAEELERRNIVDRKVEEESRRSFKRNKEENKKVRDEIKKTIEENEAENRKAHEDSKRSFEELEDELRK

SEQ ID NO: 20580 - protein, 180 aa, Artificial Sequence; identical to SEQ ID NO: 20579
  Synthetic sequence.

SEQ ID NO: 20581 - protein, 182 aa, Artificial Sequence
  Synthetic sequence.
DKEREATRRLRELEKENTKLVKEIRDADREIEKRLREIHKKLEDENRKLEEEIKDMVRRKGDTSEEEKKKLDDLRRRLREAHRELDEERKKSEKKLEDDHRREETRLRRNREETKKTEDDLRREGVDDRIVEEVKKHHERNERRLREYLDESRKYLEDHIRRLEKYLEDSRRLATRIKEETK

SEQ ID NO: 20582 - protein, 182 aa, Artificial Sequence; identical to SEQ ID NO: 20581
  Synthetic sequence.

SEQ ID NO: 20583 - protein, 178 aa, Artificial Sequence
  Synthetic sequence.
SSVEEVKRKNEKSLREIERASEEHLERLKRELEKSEDEARKHNKKLDDDLERLERKGGGDEDAERELRKLREDSERERKEHKEKLDRARRRSEKMKEDLKRRLEKLDREHREDRRREPDDERVKDLERTHEESKRRVEELMKENDDLLKRIEEESKRLNEENERKVEDIEKKVEDLKR

SEQ ID NO: 20584 - protein, 178 aa, Artificial Sequence; identical to SEQ ID NO: 20583
  Synthetic sequence.

SEQ ID NO: 20585 - protein, 182 aa, Artificial Sequence
  Synthetic sequence.
SEIERVAKELKDEADRLRKEVEKHRRRSKEELDRLREESKKVNEDLKRMLERIREIAAQGNLEEDILRTMKEEIERRREEYEERLKAVEERLRREHERTKKKLDDDRRRIEKKRKDLTDKLEPNEEFKKLRDLIEDIKRRLEELVKALEETNKKIEDDVRDSVRKNRETLERIKKEIEDTAT

SEQ ID NO: 20586 - protein, 182 aa, Artificial Sequence; identical to SEQ ID NO: 20585
  Synthetic sequence.

SEQ ID NO: 20587 - protein, 183 aa, Artificial Sequence
  Synthetic sequence.
KDVERILREIRETLRRVEEEAKRSNDEIRKLNEEAERIVREILKEIEKELREVRKRLTEKGPRERLEEELKRRLEKIRERIERAREEYERKVREEEKKHREKEERDRERKERTEDRIRRRQSENDELLRRLKEELDRVERTIRELIRRNEEVLERSDESVEKLLRELEELLRRVEEEIKKAAT

SEQ ID NO: 20588 - protein, 183 aa, Artificial Sequence; identical to SEQ ID NO: 20587
  Synthetic sequence.

SEQ ID NO: 20589 - protein, 176 aa, Artificial Sequence
  Synthetic sequence.
SEREERAKRLRKILEDLKRESEEHLRRLKTRLDKLREDSKKHLEDVRRKLEDLKRIVEENKVSREELEKRREDIERRVRESEKRTDEREKRDEERHREFRKDLERKVRTMRDETRRGGETDDELRKLVRKVEEDLKRLDEENKKLLEKVKRDLDRLKKENKDLLKRVEEELRREAT

SEQ ID NO: 20590 - protein, 176 aa, Artificial Sequence; identical to SEQ ID NO: 20589
  Synthetic sequence.

SEQ ID NO: 20591 - protein, 176 aa, Artificial Sequence
  Synthetic sequence.
SEEEERKRRLEEKLERLEEKSRRHLKEVKRTLEELEERSRRHLDENRRLLKRLKEIVDRNEDSEEVIERREEEIDKRNEEEERETRKRAEETDRRVEKSEEKLKRDEDRMDKETKDGGDTSEEIKKLVKDIKEELKRLLEENKRLLEEAKKTLKKLLEDNRRLIEKIKKELDEARK

SEQ ID NO: 20592 - protein, 176 aa, Artificial Sequence; identical to SEQ ID NO: 20591
  Synthetic sequence.

SEQ ID NO: 20593 - protein, 174 aa, Artificial Sequence
  Synthetic sequence.
REEERLKRELEKDLERIKKLSDEHKKRLEEENRDLRRKSREHKEKLERDLRRVEEIRRREKIREEIEERIRRRDEELERDNERVKEEYDRRREDRRRENEEIKERLKERKEETRKKDTSDEVERLLKEIEDRVRKLEKENEEIARRSTETLEKLLKENRETLKEIRDRVREAKR

SEQ ID NO: 20594 - protein, 174 aa, Artificial Sequence; identical to SEQ ID NO: 20593
  Synthetic sequence.

SEQ ID NO: 20595 - protein, 174 aa, Artificial Sequence
  Synthetic sequence.
SEEEELKRRLKEILRELKELSERHKKRLRELNEKLKRLSEEHKRKLEEITEDLRRIATREPIREEIDKRYREKVERAKEENKEIEEDYKRAEKELREDNRRIEEEVRKKEEDTRRTPNSEEVKRLLDEIRRELERLKEENRKIVEDSTRTLKELLEENKRILEESSRDLERLKR

SEQ ID NO: 20596 - protein, 174 aa, Artificial Sequence; identical to SEQ ID NO: 20595
  Synthetic sequence.

SEQ ID NO: 20597 - protein, 174 aa, Artificial Sequence
  Synthetic sequence.
SEEEKIKEEIKRDLEDLRRLSKEHKDRLRKLLEDIKKLSEEHKDKLRRITKELRDVVRREEIREELDEEYKEKAERARRENEEIRKKLEEDVERLRKENERIKREAERRDKETEDTDTSEEVKRLLEKVKEDLKRLLDENKRIIERIEREVERLKRENEEILKESSRDLERAKK

SEQ ID NO: 20598 - protein, 174 aa, Artificial Sequence; identical to SEQ ID NO: 20597
  Synthetic sequence.

SEQ ID NO: 20599 - protein, 174 aa, Artificial Sequence
  Synthetic sequence.
SKEEKLKEDLKRTLDDARRLAEETKRRLEEILEKLKRLSEKSKEDVKRTTDELRDIVRKRKIDEEIDERYKDKKRKHERRMTEIDKEVRELDEDTRRKIEKIDKELEDRDDRTRKEDTSEEIKDLLRRIREELKRLKDELRRIIEEIRKELERLKRENEELNRRSSEELKKAKK

SEQ ID NO: 20600 - protein, 174 aa, Artificial Sequence; identical to SEQ ID NO: 20599
  Synthetic sequence.

SEQ ID NO: 20601 - protein, 179 aa, Artificial Sequence
  Synthetic sequence.
SEVEELLERHKRALDKAKKVSEDHKRDLKEKLDDVKRKVEELERRLKRALDELTKEGGGSTDVERKLREVDEKTERDRRRLDEEVKRVEDESREKTERLREEVKRLHDESRDRKEKLRLEEDLVRTLDELHKDIERRLRKLEEENRDILRRIREEIERLKRKLDEIARRIKEEVKKLKK

SEQ ID NO: 20602 - protein, 179 aa, Artificial Sequence; identical to SEQ ID NO: 20601
  Synthetic sequence.

SEQ ID NO: 20603 - protein, 179 aa, Artificial Sequence
  Synthetic sequence.
SEVEELKKEHKKVLDEVRRASKKHKEELEEMLRDLKRKADELARRLEDALRRLEEEGGGGDRVEKDLRRIEERLKEDEKRDRDKVDELRRRSEEKLKRIKRRMEEVSKKSEDDERKLRLDKKAVDELRELHKEIKRRIEKLLKENEEILRKIEEDIERLLEDLRRKAEEIKRRVDETRR

SEQ ID NO: 20604 - protein, 179 aa, Artificial Sequence; identical to SEQ ID NO: 20603
  Synthetic sequence.

SEQ ID NO: 20605 - protein, 179 aa, Artificial Sequence
  Synthetic sequence.
SEVEEIEKENKDAVRRMREKSRRHKEELKDALREAEEISRRHKEELKRKLEELTKRGGGDEKLDEDLKRIRDKSKKTTEDLKRKVEELRKRSEETLKELEDDLKRLHEKHKDTEDKMDLEEELVRKLRRLDKRTHEDVRRLLDENRRTLEKIEEDIRRLIKENEDTLREIEKRVEDKKR

SEQ ID NO: 20606 - protein, 179 aa, Artificial Sequence; identical to SEQ ID NO: 20605
  Synthetic sequence.

SEQ ID NO: 20607 - protein, 177 aa, Artificial Sequence
  Synthetic sequence.
SEDEELKKEIEKLLRELRKRSTESKKEIEDLLDELRRKSERSRKEIEDTLRELEERAKGERSEEEDKRTREDTEEKEKEHRKKLRKEDEELREREKEHERKLREVEKRLREREEETKSRETSEEIKELLERLRRDAERLKKENEDLNRRLREEVEKNKEDNKRLNEELRKKVEEDRR

SEQ ID NO: 20608 - protein, 177 aa, Artificial Sequence; identical to SEQ ID NO: 20607
  Synthetic sequence.

SEQ ID NO: 20609 - protein, 185 aa, Artificial Sequence
  Synthetic sequence.
SLEETLDKILEDIRRRIRENEERNRRLKEEIDKAIKRNEEENRKTNEDIKRKIDDLERKRGDRSKEVEDTKREVEEEEDRSRKKEDEDRERVKRAKEESERRREEDKKRVEDMERRAEEKKDKEQDKKEVEELIRELEDELRKLEERSKEHLDRLREELKELDERSKKHLDELRKLEEKLRRDAD

SEQ ID NO: 20610 - protein, 185 aa, Artificial Sequence; identical to SEQ ID NO: 20609
  Synthetic sequence.

SEQ ID NO: 20611 - protein, 175 aa, Artificial Sequence
  Synthetic sequence.
SETEKLLERIRRNVEENEKYAREHLKKLDKNLKDNKEYIDRHVKKLKERLDTLREIAREKDPSRELDKALEETRRDSRRSEENRRRHEKRTRDEAKKSEERLRKHRKDSEKETKDGGDREERIEKLLRELERTHRELKEELDKLHKRLEEEHRRLEKKLRDIHRKVEKDLRDLKR

SEQ ID NO: 20612 - protein, 175 aa, Artificial Sequence; identical to SEQ ID NO: 20611
  Synthetic sequence.

SEQ ID NO: 20613 - protein, 175 aa, Artificial Sequence
  Synthetic sequence.
EEKERLKKRIRDNVEENKKYAEEHLKRLKEKLEEVRKYIEDHKDRLRRKIEELKKDAERKPDDRELEEKEKKDREEAERSKRRRDEKRRKIEEDSRESRKRRDRHRRESEKEIRDGGDNDEEIRRILEELRRTHKKLEEELEELHKRVEDELRRLEDELREIHERLEETLRRLRK

SEQ ID NO: 20614 - protein, 175 aa, Artificial Sequence; identical to SEQ ID NO: 20613
  Synthetic sequence.

SEQ ID NO: 20615 - protein, 175 aa, Artificial Sequence
  Synthetic sequence.
SEKEKLKEEIKRNVEENRRYVEEHKRDLERNAEENEKYIREHLKRLKEEAEEVRDRVAKEPPDRKMEKTEKETDKRAKESRDRAERHKEETRKKAEESKRREDRHREESEDRAKKGGDRDKEIERLLRELERTHRELRKDLKRIHDELKKKHDDLRRTLEEVHKRVKEELDRARR

SEQ ID NO: 20616 - protein, 175 aa, Artificial Sequence; identical to SEQ ID NO: 20615
  Synthetic sequence.

SEQ ID NO: 20617 - protein, 175 aa, Artificial Sequence
  Synthetic sequence.
SEKEELIERIRRNLEENRRYIERHLEELEKKLDDVRRKAKRHLEKLREELEKLKDDARKKPPDREVEKRKEEKDRESERSKRELDRTREEIERETRESEDRERRHAEESEKRIKDGGDNDEEIRKLLEELRKTHEKLKRDLERLHKKVRDTLKKLEDELKELHKRVDDELRKLRK

SEQ ID NO: 20618 - protein, 175 aa, Artificial Sequence; identical to SEQ ID NO: 20617
  Synthetic sequence.

SEQ ID NO: 20619 - protein, 179 aa, Artificial Sequence
  Synthetic sequence.
DEERKLEELEKENDKLLEDAKRTLEKLLKDNRDLVKRVEDELRRLEEENKKLADDVRRDGKSDEKIERDIDKSRRDTRDEARRARERIKRSEDELRREMEELDKRHKEFKEDERRKRKEKRRSSKELEDRSREHLERLKARLKELEDKSRKHLEEVKKELRELEEKSKKHLKRLEDARR

SEQ ID NO: 20620 - protein, 179 aa, Artificial Sequence; identical to SEQ ID NO: 20619
  Synthetic sequence.

SEQ ID NO: 20621 - protein, 179 aa, Artificial Sequence
  Synthetic sequence.
DEEETLKRLDEENDKLLEEVKKTLEDSLRRLEELHKRTEEELRKSRRELRELVKDVERKGSLREEIKKELDDYDRRTKEELDKTRDEHEKYKRKVREELKRTDEKVRRSKEDDERVRREKRRSKEELRDKSRRHLEDVKRRLEELKKSNEEALRRDEKKLEDLRRSNEKVLRELKEKAR

SEQ ID NO: 20622 - protein, 179 aa, Artificial Sequence; identical to SEQ ID NO: 20621
  Synthetic sequence.

SEQ ID NO: 20623 - protein, 179 aa, Artificial Sequence
  Synthetic sequence.
SEEEEVRRLEEELKKLHDDIKRRLEELLRENEKILRDIDREIKKLLEELRKTIDKADKDGVLSEELKKELEKLLKDIEDTLKRLKDESKEDRERLEKELRELSKRSREEDEKRRKATKDGDRDKDELRKIVEELKRDHEKDLRKVEKLSEEHKEKLRRALEELKRLAEEVKKRLDDERR

SEQ ID NO: 20624 - protein, 179 aa, Artificial Sequence; identical to SEQ ID NO: 20623
  Synthetic sequence.

SEQ ID NO: 20625 - protein, 189 aa, Artificial Sequence
  Synthetic sequence.
SVEERLEEMERRNKDLIRRVEEDLERLLKENRDLIRRIKEELKRLKEELKELVERISREGDRPEEEKERVKERLKKEEKETDEKAERDDRRHRKTEKETRDRVREDRKRHEDEERRRREKARRLKDSGSKEEVLKELEEENRKHEKRLRDALERLRRRSKKHKDEARKILEELKERAKTIKRRLEEDRR

SEQ ID NO: 20626 - protein, 189 aa, Artificial Sequence; identical to SEQ ID NO: 20625
  Synthetic sequence.

SEQ ID NO: 20627 - protein, 189 aa, Artificial Sequence
  Synthetic sequence.
SVKEDLRKAKEENKRLIEKAEDDLRKLLRENKELLKRIDEELKRLKKELDDIVRRIEDKGDRPKEDRDRVKKEADEIREETDREVEEERRDVKRTEEETKKRAEDSKRRHKKFEDDLDEKARELERSGSKEEVLEKLKRDNEDHKRRLKEDLRRLREESKKHKKKLEDRLKKLEERARRIKEKLKEEER

SEQ ID NO: 20628 - protein, 189 aa, Artificial Sequence; identical to SEQ ID NO: 20627
  Synthetic sequence.

SEQ ID NO: 20629 - protein, 184 aa, Artificial Sequence
  Synthetic sequence.
DDEERIRKIAEDIKRKLKETLERLRDESRKNKRKLEDLLRKSEEKAKRLKDKLRKMEEEKERKRDEELKREIERLRREKEELHKEFRKRVEDTRRENERRREEVKKRLDTMRKETEDTEEKIRRDGVDNEDVKRLLRELKEITDRIDEEVKRLREENERITRRIEEEHKRLNKELERILREIER

SEQ ID NO: 20630 - protein, 184 aa, Artificial Sequence; identical to SEQ ID NO: 20629
  Synthetic sequence.

SEQ ID NO: 20631 - protein, 175 aa, Artificial Sequence
  Synthetic sequence.
SSEEKAKELRKRLRETHKRVKDEIKRLKEELEESHKRLEERSRETLRKLEELIKELNVSEEVLDELRRKLERLEEEHKKYKEKSKRELEKIDEDVERYERDSRREEEETEKKLRKDGVVDTELEKDVRRVEEKNRRALEDVRRKVEEVKESNKRALEKNERIVREVERRLREEKK

SEQ ID NO: 20632 - protein, 175 aa, Artificial Sequence; identical to SEQ ID NO: 20631
  Synthetic sequence.

SEQ ID NO: 20633 - protein, 175 aa, Artificial Sequence
  Synthetic sequence.
SSEERFEKLDRELKRTHEELERAIRELKKDYERSLKRVEEELKRLLDELEELARRVGVDEKVLKEEEDERRRLREEVEKYKKDAKEELKRTDDKVRKYKEKSDRDRERAEDEVRKTGVVDTKVTETVRRVREENKRMLEDVKRDVDRLRTSNEKVLRDIRRTVKRAKERLKELKE

SEQ ID NO: 20634 - protein, 175 aa, Artificial Sequence; identical to SEQ ID NO: 20633
  Synthetic sequence.

SEQ ID NO: 20635 - protein, 179 aa, Artificial Sequence
  Synthetic sequence.
SAEDELRRLRRELEKSHEELKRRIDELLKRLRELVKRVKDRSKELLDELRKLLEDVKRKGRVSERLEEDIRKHMKRHRERLEREERELKKKLKEMEDRVREYEDRSRREAKKDEEDIRREGVKDTRVRERVKETRRRNEEVLREVERIAKEVEDDLKRILEELEDNVRRVKKKIKDVER

SEQ ID NO: 20636 - protein, 179 aa, Artificial Sequence; identical to SEQ ID NO: 20635
  Synthetic sequence.

SEQ ID NO: 20637 - protein, 179 aa, Artificial Sequence
  Synthetic sequence.
SSEEELKKLEKELEETHRKLKEDVERLLRDLDRKVKKVEDDSKKLLDELRKLLEEAKRRGVVSEEVEKRVRDHMKRHEEELKRIREELEREKEERREELRRYEEEVKKKREEDRDDIRRRGVKERDVRKRVKEMKEDNRRALEDIRRKTEEVAKKLREILKKLRENVRRVAEEIKRVAD

SEQ ID NO: 20638 - protein, 179 aa, Artificial Sequence; identical to SEQ ID NO: 20637
  Synthetic sequence.

SEQ ID NO: 20639 - protein, 179 aa, Artificial Sequence
  Synthetic sequence.
STEEELERLRRELERTHERLREESEKLVRELRKLVEEVREALERLRRDLKRLLKEVREKGRASEDVERELKKEDERIEDKARKDKEEADKHERRHREDLKRYEKKSEEDDRRREKKIRDKGVKETEVREEVKRTKEENKRVEEKLRRNVDEMRKKLEEILRRIKEEIDKMRRKIEEIER

SEQ ID NO: 20640 - protein, 179 aa, Artificial Sequence; identical to SEQ ID NO: 20639
  Synthetic sequence.

SEQ ID NO: 20641 - protein, 178 aa, Artificial Sequence
  Synthetic sequence.
DVEEDLKRLEKKNRDLNKRMEDSNRKLEEDDERVNRKIRKDHKKAEDDLRRVIKEVEEENRSDERDKKRLKKRTDDNRREDKRRDDENKKTNKDYKRRFEKKRRENEDTDRKTKDEVRRRGVTEKTIEDIERHLDRLRKENDKLRKELEDHIRRLEEEVRKNLDRIREEIERARERVR

SEQ ID NO: 20642 - protein, 178 aa, Artificial Sequence; identical to SEQ ID NO: 20641
  Synthetic sequence.

SEQ ID NO: 20643 - protein, 179 aa, Artificial Sequence
  Synthetic sequence.
RAEDEVRKIKKEIDELIRRLEKLNEDIKREIDELVRRLEELNKRVKEEIKRLIEELKKENRVDERKVRKLEEDLERHDREVREDKERIERTAKRHREDVERNKEETTRRREKTKREIDRDGVGDRELKERLDRMRDHARKHEEKLKESLKRVREHVKRHAERVEESLRRLKRDVDELRK

SEQ ID NO: 20644 - protein, 179 aa, Artificial Sequence; identical to SEQ ID NO: 20643
  Synthetic sequence.

SEQ ID NO: 20645 - protein, 174 aa, Artificial Sequence
  Synthetic sequence.
SSDEKLEEIERHHRKVEEESRRLDEDIKRHHKEVEDESRELLERIKKKLEDVTRALGREDREMKELKRELDKRREEVKRRDDREREKSKKREDEIEKKDRERRKESEEKRRRLREEGLRDEILEKLERDNRRYKEESEEEVERAKEENRRYLEESRREVEEFDRKLKEIADRAR

SEQ ID NO: 20646 - protein, 174 aa, Artificial Sequence; identical to SEQ ID NO: 20645
  Synthetic sequence.

SEQ ID NO: 20647 - protein, 182 aa, Artificial Sequence
  Synthetic sequence.
SELEERVKKVEKVNEDLKRRVEEHERRVKRTLERLEEEVRRHAEKVKKRLEELRRLAKDVERETLEREIREDEKRSRDDAERLAREIERVRKESEEDAKRKKEDNERKNRERKDSARRQGRSEERIEDLLRRLDDRNRETEREIEERHKRLKEELDKVEERIRREHEKLKRELEEVERRTRK

SEQ ID NO: 20648 - protein, 182 aa, Artificial Sequence; identical to SEQ ID NO: 20647
  Synthetic sequence.

SEQ ID NO: 20649 - protein, 185 aa, Artificial Sequence
  Synthetic sequence.
DVVDELRRIAKEVRDRLREIVERLDRIAKEVVKENEEVVRHNDELAKRVVTTAKRIVDEVKDKETVKRRIDRIAEKVEEDTKEHEDRSKRSEEDVERVVKKIREEVKEIVDRVEKFVKEVRDSGTDSEEVKRVVETVRKLLRDAEKEIEEVVKKVRDLLRRVNKELKESVERVRRLLEEVRERAR

SEQ ID NO: 20650 - protein, 185 aa, Artificial Sequence; identical to SEQ ID NO: 20649
  Synthetic sequence.

SEQ ID NO: 20651 - protein, 186 aa, Artificial Sequence
  Synthetic sequence.
SDLDRVLRKIEELVREIEKESERTNRKSERDTEEVARRSEDSDRDIERLVREIRDRLRKAGVDSREVERVDRELEELLRRLRKENEDSLRESERLNRENKRRSEDSVKKLRDILARVEEKVRKREDLKDVVRELEEIVKELEERAKENVKRSEKSVKEDLDVLADNVRRSKEIVEEIKKRADEVVT

SEQ ID NO: 20652 - protein, 186 aa, Artificial Sequence; identical to SEQ ID NO: 20651
  Synthetic sequence.

SEQ ID NO: 20653 - protein, 171 aa, Artificial Sequence
  Synthetic sequence.
SEKEKVIKEARELLERLRKRLKDVNDDVTRLLDELRKENEKSREDVEREVKRLEEEVPVEDVIRELKRRLEEVDKKNRDILETLKRELDEVSRRTREELEKLRKELEEVEKAGLPAEELKRVADRLRRRLERLVEENERVVKKILDEIRRSVEENKRIVDKVRKDLDERRK

SEQ ID NO: 20654 - protein, 171 aa, Artificial Sequence; identical to SEQ ID NO: 20653
  Synthetic sequence.

SEQ ID NO: 20655 - protein, 171 aa, Artificial Sequence
  Synthetic sequence.
DEDEKVLRKIEELVRRLHEKNRKVLEESKRTLEKVEERLRRVLKEIEDLVRDAARRVDKREVIEELKKDLDRVRRKLEKVRKENADLNDRVRRELEEIDKRLKKKLDDVRRSDRDVSELDKIIKELKREADESVKKLKEIVKRSLDHLEEVVKELKKRLDDLKREIDTKAK

SEQ ID NO: 20656 - protein, 171 aa, Artificial Sequence; identical to SEQ ID NO: 20655
  Synthetic sequence.

SEQ ID NO: 20657 - protein, 175 aa, Artificial Sequence
  Synthetic sequence.
SLEEEVKKVVEEIKRRIEDDVRRIRELVERIKKLIEKDVTDLKRVVDENRDLAEKAKRIPKEDVDRVVREVERSNDELRRHSEEVLRRVERLIRELERHSREVIKRIEDTIRELRRRKVSEELLRELRRVLEEAREDSRRLLEEIRKVLEEAEEKSRRVLEESKRVNDELRERLR

SEQ ID NO: 20658 - protein, 175 aa, Artificial Sequence; identical to SEQ ID NO: 20657
  Synthetic sequence.

SEQ ID NO: 20659 - protein, 176 aa, Artificial Sequence
  Synthetic sequence.
SLDESAKRVLEEIKRLAKEDLDELKRVLDEIKEILREVLEANRDSVRRIEEEVEKLARVDDERTVKRLEDEAKRILDDNRRKSERVARELERLLEELKRHSEDVLKKLKDLLRELKEEGVDDRVLEEIERVIRKIEEDSRRLLKEIADVIKKVREESKRLLDDLKRVIDELRERAR

SEQ ID NO: 20660 - protein, 176 aa, Artificial Sequence; identical to SEQ ID NO: 20659
  Synthetic sequence.

SEQ ID NO: 20661 - protein, 185 aa, Artificial Sequence
  Synthetic sequence.
SLEEVLDRVRRESDKVRKTLERVKEEVERVSREVVEDLKRVEEEVRRLIERVKDILRRSNIPEEDLRRLERRLEELERKIKKVVKDNEDRNRDLNRRIDEVIKENERRNRELLKKAEEDIRRKKDKEELIRDVLREAERLVKESLDDIRRLLDEVRRLVEESRRNIERLLEEVRRLVEEIERAAE

SEQ ID NO: 20662 - protein, 185 aa, Artificial Sequence; identical to SEQ ID NO: 20661
  Synthetic sequence.

SEQ ID NO: 20663 - protein, 178 aa, Artificial Sequence
  Synthetic sequence.
DKVDEVLKRVKRVVEEIEDRVRKLNKEVRDVVKRIEELAREVLDHSRKVVEEIKKTAEDRKDERVLEEIKRKSDEDEKRLEDVLRRIKELLDRLDDKHKRILEEIEKKIRELRERIKKTGIEEEVVRTVKEELDKALEKAERVLEHSRRMLERVLKEAKRVLDEVKELNKRVIDEVRR

SEQ ID NO: 20664 - protein, 178 aa, Artificial Sequence; identical to SEQ ID NO: 20663
  Synthetic sequence.

SEQ ID NO: 20665 - protein, 175 aa, Artificial Sequence
  Synthetic sequence.
SVEDVAREVDKLLKRANEESKRVLEEVERLLRTVSRELEKVIRDVKKLIDDVEKRVPLKESLEEVKRRIEKLVEDVKRVNDESRRRIEELIKELKDMDRRSKEEIEKLRREVRTSGSETAEKVLRDVERIVRRNEELVREVLRRVKKIVDENRKIAEDALRKVEELVKELEERAR

SEQ ID NO: 20666 - protein, 175 aa, Artificial Sequence; identical to SEQ ID NO: 20665
  Synthetic sequence.

SEQ ID NO: 20667 - protein, 178 aa, Artificial Sequence
  Synthetic sequence.
SEAEEALERVKELVKRSEELAEESLRRARKSVEEVARRAEEALERVKKSVEEVKEVRKEGQPKEELDKILEKNKRDTERLRRDLERILRENKRKTEKLAEDNKRAIDEIRKRIDDLERKVDGKEVLDKVRDLVRRVDEENRRVIEEAKKLSEDVARRVDKVIKDVERLSKRVEDEVRR

SEQ ID NO: 20668 - protein, 178 aa, Artificial Sequence; identical to SEQ ID NO: 20667
  Synthetic sequence.

SEQ ID NO: 20669 - protein, 178 aa, Artificial Sequence
  Synthetic sequence.
DEDRRAVEELRRVVEEVNKLNEDTLRELERIVRENIRRVRELLKEAEDVVREVEKEVRRITDKEKVERILRKLEKILDRIRRESERLDRETEEVLRKLHEENKEILKELEKKLRDVKEKVKEAEEVLREAKDLIDHVRKTIEEVNDTVRDLVRKVHEVNKEVLDRIRKLVEEVRKTVE

SEQ ID NO: 20670 - protein, 178 aa, Artificial Sequence; identical to SEQ ID NO: 20669
  Synthetic sequence.

SEQ ID NO: 20671 - protein, 184 aa, Artificial Sequence
  Synthetic sequence.
SSLDRVRRAIEELVKKVNTDSKRVKDRVRKLLKEVNDTSDRVRRDVKRKLDKVKDDARKAGTPDDVKRKLRRVEEEIKKLIEEDKEKNRRSEREVEELIERLEEANKRSKEELEKLIEDLKRSTDDRVVERVVREVERIVRENEELVKEVVRRAEEIVERNERHSRELLRRLAELVDDLRRKIE

SEQ ID NO: 20672 - protein, 184 aa, Artificial Sequence; identical to SEQ ID NO: 20671
  Synthetic sequence.

SEQ ID NO: 20673 - protein, 184 aa, Artificial Sequence
  Synthetic sequence.
SSLDEVRKRVTELLKKVDDTSKKVEDDVKRLLDKSTRTSDEVRKAAERLLEEVEESARRKGTPEEVKRRLEDVKRKVRKLIDDNRRTNERVRKRVEDLIRENRKKLEEVKRRVKKLIDELRRSTDDEMVKRVLEELKKIVDDLERHSRKLLKDARRIVEESIEHSDRVLKEATRIVEKLERDIR

SEQ ID NO: 20674 - protein, 184 aa, Artificial Sequence; identical to SEQ ID NO: 20673
  Synthetic sequence.

SEQ ID NO: 20675 - protein, 181 aa, Artificial Sequence
  Synthetic sequence.
DEIEEVLREMRELVERNVREIEKVVRENEKLVEDNIRLVREVAKELRDLVRKLIERVARTTDKEELKRVLKTIEDEVRKITERLKESSERSERESRKSVDKLRKSTEDIKRRIEELERRVERTEELEEVVKEARRLLKKSEEDLRRVEKRVEELNEKSKEEMERVRDDVRRLLEEVKERAR

SEQ ID NO: 20676 - protein, 181 aa, Artificial Sequence; identical to SEQ ID NO: 20675
  Synthetic sequence.

SEQ ID NO: 20677 - protein, 181 aa, Artificial Sequence
  Synthetic sequence.
SEVDELLRLADEIVRELRELVRRHDEIVDKLVEENRRIVEEHLRRVEDVVRRLKELVKKIKDKKKLEDKLRDLLKKLRELSREVEKLNRESLETIRRTTEDLERKLETLARKVRELEERVRRDEEAERVVKEARRLLREIEELVKRSVERVERLHREVHERIKESTKRVEELVDEVRKAVK

SEQ ID NO: 20678 - protein, 181 aa, Artificial Sequence; identical to SEQ ID NO: 20677
  Synthetic sequence.

SEQ ID NO: 20679 - protein, 184 aa, Artificial Sequence
  Synthetic sequence.
SAVDEVRKVIKEIFDRLAELLKHNSDMVRRLLEEIRELVKNNTEIVREVLKKLEDILRELTDKDEVRKALKELVDRLRKVSEEHKRRIEEIERRIRRVSREHEKTLKKIVDDLERLIRDVRERVEEEKLEKVAEDARRAIKDIEDKLRDSNRRLDKLIKEVRRRLEESHKRIEREIKEIEERVR

SEQ ID NO: 20680 - protein, 184 aa, Artificial Sequence; identical to SEQ ID NO: 20679
  Synthetic sequence.

SEQ ID NO: 20681 - protein, 187 aa, Artificial Sequence
  Synthetic sequence.
DKLDEVKEAARRVVEEAHKKNRRVLEKLDEVSRRAHELDKRVKEKLKEVVKRADDLLKEKGISEEKVKRVRDEARKIERELDRLNEENKRKNDESKKTLRELNERDREVVRKVEKEIEDLRREGGDDVDTLVERLRRLVEELRKHSDDTVRRMEDIVRRNKKHSEESVRKMDDIVKKLEELAREVVR

SEQ ID NO: 20682 - protein, 187 aa, Artificial Sequence; identical to SEQ ID NO: 20681
  Synthetic sequence.

SEQ ID NO: 20683 - protein, 187 aa, Artificial Sequence
  Synthetic sequence.
DRLDKVKEDLKRSSEDAHRKNKEAIELLDEVSTEAHKLDEDVRRKLEKVVREVRKLLEDKGISEELVKRLDDTAREVRERLERLNERNKEVNKKSKEKLKELNRRDEEHSRRLDKRLDDLARKGGDDIDTIVRDAEKIVEDNRRHSDETVRRIERLVTENLRHSEESVRTLDRLVEELLRTAEEVVR

SEQ ID NO: 20684 - protein, 187 aa, Artificial Sequence; identical to SEQ ID NO: 20683
  Synthetic sequence.

SEQ ID NO: 20685 - protein, 187 aa, Artificial Sequence
  Synthetic sequence.
DKLERVLRELERSSKEAHEKDKKVLEDLDEVSKRAHKANEEVIARLEDVVRKAEDELRKKGISKELVKRVEDTVRKIRKELEKLNEDDRKKNKESEDRLRKLNEDNKRHSEDVKRKLEDLARKGGDDLDTLVKRIEDIVKENEDHSRRSVEEIRRIVEENERHSRESVKTIKDLVEELERRAEEVVR

SEQ ID NO: 20686 - protein, 187 aa, Artificial Sequence; identical to SEQ ID NO: 20685
  Synthetic sequence.

SEQ ID NO: 20687 - protein, 187 aa, Artificial Sequence
  Synthetic sequence.
SELEKVLKDLEESSKEAHKADEEVLRRLERVSREAEKELKRVLDDLRRVVEEVERLLREKGISEEKVKRVKDTADEIKDRLKKLLDEVRERNRESEERLRELNERNKKHSEEVLRRLRELRRKGGDDLETLVRDARRIVKENEEHSRDSVRRIDKIVKENADEVRRVVKEIKDIVKRLEELARETVR

SEQ ID NO: 20688 - protein, 187 aa, Artificial Sequence; identical to SEQ ID NO: 20687
  Synthetic sequence.

SEQ ID NO: 20689 - protein, 171 aa, Artificial Sequence
  Synthetic sequence.
SLDEDVDELVKRVEEEMRRNVKELDKLVKEDKRLAEENVRRLEEIVDRSRKLADRKEGDKEKIKREADKSLEDLEESTRRLKERSDRLLRRLEESTKRVKDRLDEIEEDLKRKGVSEEVLKRLREVIERARRDSERVLRKLEKTTDKVRRDSERVLRENEKSIEDVARKMT

SEQ ID NO: 20690 - protein, 171 aa, Artificial Sequence; identical to SEQ ID NO: 20689
  Synthetic sequence.

SEQ ID NO: 20691 - protein, 186 aa, Artificial Sequence
  Synthetic sequence.
DELERLLEELKRTTRKIEEELKEVNRRLDDTTREAEKELRRLKEKLEEVVKRAEELLRRRGVSEEKVKRLRDTLDRVRKTVDELLKELKRVSDELRKRTEKSNRESRKRSEEIEREIEELARRGEPEKDVVKRLEDLVRDDDRIAKEDVKRLEDLVREDRTLVKEIVDRLEELVRTVEKLVKEVVN

SEQ ID NO: 20692 - protein, 186 aa, Artificial Sequence; identical to SEQ ID NO: 20691
  Synthetic sequence.

SEQ ID NO: 20693 - protein, 177 aa, Artificial Sequence
  Synthetic sequence.
SAIEKVKEVVERVLETVRDSVRRSHEESKRLIDKVRKRLEEVREEVKELIERVRRKGIPERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 20694 - protein, 177 aa, Artificial Sequence; identical to SEQ ID NO: 20693
  Synthetic sequence.

SEQ ID NO: 20695 - protein, 177 aa, Artificial Sequence
  Synthetic sequence.
SVLEEVRRRVEELLKTVKESVDRSHERSERLIEEVRESLKEVKRRVKELVERVREKGIPEDRVKRIEDKLREELERLERENRKIEEDLKRSNDELRRENERIAERLEELLRELSRDTNDKVARDVLEEIERLIREANERNKRNLEDVERVIRELNKENERVLREVEKKIEKLIRETE

SEQ ID NO: 20696 - protein, 177 aa, Artificial Sequence; identical to SEQ ID NO: 20695
  Synthetic sequence.

SEQ ID NO: 20697 - protein, 178 aa, Artificial Sequence
  Synthetic sequence.
SSIERVEKEVRRLLRESDESLKRVMEEAKELIKSVRESTKRVEEDARDLLRKVVERTGDEREDLRRVLEELRKLIEDNRREDKRSEDELRKLIRDNKEENDRARREAEKLLEDLSRGRSEEEVERVLEEVRRIIEKLKEDDKRSLERIERIVRRNNELNKESVDRIRKIIKEMEERAD

SEQ ID NO: 20698 - protein, 178 aa, Artificial Sequence; identical to SEQ ID NO: 20697
  Synthetic sequence.

SEQ ID NO: 20699 - protein, 174 aa, Artificial Sequence
  Synthetic sequence.
DESEDVEEKMRRLLEKSKDETRRVKEEVERLNEESKRVTEEVEKRVRDLLREVREKVRDKDVLEEIERRARKLVKELRELNREITERSKRSREELDKLNKKIEDDLRKIKKKLDDGKDVETVLREAKRLIEESIERIERVLKENRELAERSIKVLRDVLREVEDLIRKLEERAK

SEQ ID NO: 20700 - protein, 174 aa, Artificial Sequence; identical to SEQ ID NO: 20699
  Synthetic sequence.

SEQ ID NO: 20701 - protein, 177 aa, Artificial Sequence
  Synthetic sequence.
RKVEEVKKEAERLLRRSEEVSKKVADDADRLLKRSREVSDRVRRESERLLKEVAEAGVDEKILREIKKRSEESVKRLEDINKRLEDEIRRLKEELKRINDELRKRIERLREDLERDRTDKRVEDVLREARDLVRRSIKKIDEVLKEAKRLVEESIKLSEDNVRRNEEIIRDLERRTR

SEQ ID NO: 20702 - protein, 177 aa, Artificial Sequence; identical to SEQ ID NO: 20701
  Synthetic sequence.

SEQ ID NO: 20703 - protein, 177 aa, Artificial Sequence
  Synthetic sequence.
SAVERVKEEVDRLLERSKKESERVRKESEDLIRESDEVSRKVEEDSRRLIEEVERSGVDESILEELRRRSKKSKEDLDRINEELKRRSEESVKRLEEINKELKERVERLKEELDKIDDERVVTRLLEEAKRLVERSIEEIKRNVKENRKLVEESIKLSEENVKRNKRLVDEAIRAAE

SEQ ID NO: 20704 - protein, 177 aa, Artificial Sequence; identical to SEQ ID NO: 20703
  Synthetic sequence.

SEQ ID NO: 20705 - protein, 187 aa, Artificial Sequence
  Synthetic sequence.
SVVEEVVERVKRIAEELKRSSEENVDTVRKVVAEAKKLVEDDVREVEKLARRLKEVVTRDISDKKTLRDDIDKIEEEMRRLNKELEERIRKIERELERSSEENKRRVEKLAREIRKLVEDLERSGRVDERVLKDVKDKADKLIREVEETSKRSEEDVRKVIEEVREVLRESHERVKELIKEVREAER

SEQ ID NO: 20706 - protein, 187 aa, Artificial Sequence; identical to SEQ ID NO: 20705
  Synthetic sequence.

SEQ ID NO: 20707 - protein, 182 aa, Artificial Sequence
  Synthetic sequence.
SEAEKVAEDARKLAEEVIRLIEEVVERSKELVDRNEKEIRRVIEESDKLVEEVIRLLRRGDIRDEDIKRIEERLKELNTRSRETSKDVERELKELNKRLEEEIRKIEKEMKKLLDDLVRKRGETESVREVEKIVRDVVREIREMLKRSKDETRRVIKRVREVNDRSEKRSRDVVREARETSR

SEQ ID NO: 20708 - protein, 182 aa, Artificial Sequence; identical to SEQ ID NO: 20707
  Synthetic sequence.

SEQ ID NO: 20709 - protein, 182 aa, Artificial Sequence
  Synthetic sequence.
SEAEEVARRARKLVRELEELIRKSVEDSRELVKRNIEKIKRNVRKSEEDVDRVIKLLRRGDIREEDIKRIKEDLKRSNEESRRDSKRLEDRLRRLNEKLTRDIRRIEEEAEELLRDLVRRRGEAEAVREVDRIVKEVVRRVREALERSREETRRVIEEAKKANKESDDVSRKVAKEIDEEAT

SEQ ID NO: 20710 - protein, 182 aa, Artificial Sequence; identical to SEQ ID NO: 20709
  Synthetic sequence.

SEQ ID NO: 20711 - protein, 177 aa, Artificial Sequence
  Synthetic sequence.
RVIEEVDKEIKRVIKESEDVTKEVKDTSRKVLEDSKRESERVRRRSEEVLKKVEEEGVDKRILDELRRRVEESSKTLEEINRRLEEKIRDSERKSEEINKRLREELDKLREELKRIDDEDEVRRVAEKVKRLVDESIKRLKDNVKRNKELVDESIREVERNVEENERLATKVIEEAK

SEQ ID NO: 20712 - protein, 177 aa, Artificial Sequence; identical to SEQ ID NO: 20711
  Synthetic sequence.

SEQ ID NO: 20713 - protein, 177 aa, Artificial Sequence
  Synthetic sequence.
SVIERVEEEMEKVIRDSERVTKEVEDRAREVHERSEKRIREVEETSRRVLEELRRAGVDKRILDELRKRIKDSREDLERINEELRRALRKLLEDSKRINEELRKTLEELRKRLERVDDEEEVKKLAEEVRRLVEDSIRKLEELARRVDELVRESIERVDRNVEENKRLVREAIERRR

SEQ ID NO: 20714 - protein, 177 aa, Artificial Sequence; identical to SEQ ID NO: 20713
  Synthetic sequence.

SEQ ID NO: 20715 - protein, 177 aa, Artificial Sequence
  Synthetic sequence.
SVDREVEEIMRRVHKESEDVIRKVKDTVRRVLERSREVSERVKRDAERVLEEVKRAGVEKEILDRLREEVKKLEEELRKIDTDLERKIRELEKELEEINKKLREDLKRLKDELDKIKDKDFLKRVAEEVKRLVEESIKRVEDVAREVERLVEESIRLLEAVAKKVRDLVREVKRRRT

SEQ ID NO: 20716 - protein, 177 aa, Artificial Sequence; identical to SEQ ID NO: 20715
  Synthetic sequence.

SEQ ID NO: 20717 - protein, 184 aa, Artificial Sequence
  Synthetic sequence.
KEIEDLVKKIREIVDRIKKTVEDSVREVRRIVDESAKSVEELVKELKKLAEELRKLVEDGPEEKLRREAKRIIERADKLLKDDHRENKRLIEELRKINRDVREEVKRLTKELKESLDDLVRKRGETELIRTVERELREVEKEVKKMLDESTEVLKEVEERVRRMNDDVRRVLEKVARDVERDLR

SEQ ID NO: 20718 - protein, 184 aa, Artificial Sequence; identical to SEQ ID NO: 20717
  Synthetic sequence.

SEQ ID NO: 20719 - protein, 183 aa, Artificial Sequence
  Synthetic sequence.
KEVEEVVTKVDDLVRELEERSRRHVERVKEIADRNEKLVREVVKRSRDNVRELEELVRRGLERIDEELKRSAKTNKELVDRLRDKNRRSIEELKRLLDHNKELLDRVRRELERLLEEAERNRLPREVLEEVKKRIRDVLKRVEDASKRVKETIDEVLKRIKELTEDVERKSREVLRRVKEARK

SEQ ID NO: 20720 - protein, 183 aa, Artificial Sequence; identical to SEQ ID NO: 20719
  Synthetic sequence.

SEQ ID NO: 20721 - protein, 181 aa, Artificial Sequence
  Synthetic sequence.
KEVEDIIRKLRRHVKEIERTIREMVESVKRLADEVVKVLKDALDSARDHVRKILETLRDKGTSEVARRLERSNEEHMRRTEEEIRKLEERLDRHVKETRDVLRELRRSNDKLRDEVDRANLPEDVLRELRKVIEDTERTIKRLVDELEKVHREVKERIRKIAKDLRDKHKKSKRDIRETER

SEQ ID NO: 20722 - protein, 181 aa, Artificial Sequence; identical to SEQ ID NO: 20721
  Synthetic sequence.

SEQ ID NO: 20723 - protein, 181 aa, Artificial Sequence
  Synthetic sequence.
SAKDEVKDVNDKVRKEVRRVIEESRAVNEEIKRRVDTVLKESEDVNREVKREVEDKVRGEDLKRRVDKLLKELDRHSDELRRRLKEVLREVDEHSKELAERVKRILDKTTEEIKDLTRRGVDEKVAKEIVRKSEDVVRRIVEELKEDAKRSRDLVRELVKEIKEDVKRSRELVKRVVEEAK

SEQ ID NO: 20724 - protein, 181 aa, Artificial Sequence; identical to SEQ ID NO: 20723
  Synthetic sequence.

SEQ ID NO: 20725 - protein, 182 aa, Artificial Sequence
  Synthetic sequence.
REAEELVKRNEKIVTDIRRLVEKTVRDSRRVVEELKREAEETVERSRRVVTKLKELVERGDGRREEIERVTRELERENEELERRVKKVIDELKELNDRLEETLRRLVEESRRLLKDLIDKRGPDRMVEEVERTSREVEEEVKRVLKKSRDVTREVEEEVRRLLERSRKETDDVRKRLEEAER

SEQ ID NO: 20726 - protein, 182 aa, Artificial Sequence; identical to SEQ ID NO: 20725
  Synthetic sequence.

SEQ ID NO: 20727 - protein, 182 aa, Artificial Sequence
  Synthetic sequence.
DEAERLVEEIKRVVKEAEDLVRRTVEISRRVVETLRKEAEDLVRDSERVVKELTELARRGDGRREEIEKLIRELRKLNKDLEERVRRVERELEKENKRLEDTLRKLLEELRKLLEDLIRRRGRTELVEKVRRVIEEVEKRLRDMLRKSRDVTREVKERVARMLEKSKKVTDDVEKRVTDEDR

SEQ ID NO: 20728 - protein, 182 aa, Artificial Sequence; identical to SEQ ID NO: 20727
  Synthetic sequence.

SEQ ID NO: 20729 - protein, 182 aa, Artificial Sequence
  Synthetic sequence.
KEAEDLVRRVEEVVEELERRVEKLVRESEEVVKKLSKEVKESVDTNRDIVRRITELARRGDGREEDIRRLVTESRRLDEELRKRIEEVIRRLRKLNEDLTREARRVEEELERELRELIRKRGETEKVEEVERVIRRVKKRVEEVLRKSKTTTTDVERRVREMLERSEESTRRVKERADRERT

SEQ ID NO: 20730 - protein, 182 aa, Artificial Sequence; identical to SEQ ID NO: 20729
  Synthetic sequence.

SEQ ID NO: 20731 - protein, 184 aa, Artificial Sequence
  Synthetic sequence.
SEADDVVREIEDLVRRDKELVDEVVKRIKDLVRRDKKLVDEVVKEIKDLVTELEDLARKLDEEELRRVVKRVRDEIRRLADELREHSRRVEKEIEDLRRELEKHSEDVEREIRRLLKELRDRGIPEEMLRKLERVVEEVKRRSTEALKRLREVVKEVKETSKRANEELERVVREVKKRLDDATK

SEQ ID NO: 20732 - protein, 184 aa, Artificial Sequence; identical to SEQ ID NO: 20731
  Synthetic sequence.

SEQ ID NO: 20733 - protein, 184 aa, Artificial Sequence
  Synthetic sequence.
DEVREVVKEIRKLVEDDKRRVDKVVEDDRRLAKRDLDLVEDVVRRIEDLVRRVLEEARKLDRETLRKVVKDVIDTVDELLKRLERHSREVRKESEDLLRELRDHSRRVKERIKKLLDDLRRAGVDKSVLDELRKVVEEVKERSDRALEEVERSIRESEKESRRANEKLRKVVEEVRKKLEEAER

SEQ ID NO: 20734 - protein, 184 aa, Artificial Sequence; identical to SEQ ID NO: 20733
  Synthetic sequence.

SEQ ID NO: 20735 - protein, 184 aa, Artificial Sequence
  Synthetic sequence.
SEVDKVVKDIRDLVRRDLKRVEDVVRTDRRLAEEDLRRVKEVVEKIEKDVKELDELARKLDREELDTMLEKVKREIEERRKRLEEHSKRVEDESRRLLEDLRRHSKEVVDRIRELLKDLERRGVDESVLKKLKDVVDEVERESREALRKVEESIKESKRRSEKALEELREVVKRVDRLLEEARR

SEQ ID NO: 20736 - protein, 184 aa, Artificial Sequence; identical to SEQ ID NO: 20735
  Synthetic sequence.

SEQ ID NO: 20737 - protein, 184 aa, Artificial Sequence
  Synthetic sequence.
SEVDEVVKEVEDLVRRNEELVEEVVRRVEKVVTDDRRLVEEVVREIRKIVKDVEDLARKLDKEELKRVLDEMRERIERLLEKLRRHSKKLDDELKRLLEELREHSRRVEKRLEDLLKELRERGVDEKVLRKLEKVIREVRERSTRALRKVEEVIRRVREESERALRDLERVVKEVEKRMREAAR

SEQ ID NO: 20738 - protein, 184 aa, Artificial Sequence; identical to SEQ ID NO: 20737
  Synthetic sequence.

SEQ ID NO: 20739 - protein, 185 aa, Artificial Sequence
  Synthetic sequence.
DEVDEIVRRIEKLVTDDLKRVEDLVREVKKLVDEDKRKVDEIVKEIRRLVEEIRKEAERDRDERVLDKIRRDLERMLRKLEEDLRRSVEETKKTLRDLEKRIKESSEETRRELEKLEEELERRRMDEKVKRKLRKVVEEVERRSKKANEELEKKVREVEELSKRVLEKLKKVADEVRKEVKDAKD

SEQ ID NO: 20740 - protein, 185 aa, Artificial Sequence; identical to SEQ ID NO: 20739
  Synthetic sequence.

SEQ ID NO: 20741 - protein, 186 aa, Artificial Sequence
  Synthetic sequence.
DSVERLVETIREIARESLRRAKELVKSNKKLAEDSKRRVDKLVKELKDLVTRVKETLKRKRDDEETIERLKRELDRAVEEVKKALKESKEKSEEHVERMRRDIERTHRELEDLVRKVREDLKKDDLKGEVLELIEEVVREVKEVNTTVSKEVEDVVEETRKVNEDVAKLIEKVVREVKRVVDEVRT

SEQ ID NO: 20742 - protein, 186 aa, Artificial Sequence; identical to SEQ ID NO: 20741
  Synthetic sequence.

SEQ ID NO: 20743 - protein, 182 aa, Artificial Sequence
  Synthetic sequence.
SELERLVEEIRRLVREIEERSKKTTEDIKRLAEDIRRRSKEAVDENEDLARKIRKRAEERNDKDLVTELERRIEEIERRNKKLLDELKKRVERIVREVEKINEDLKRRLEELERRVKDVVRKRNEDSREIDKVIEEVRKRLKEVTDSDREVIKEIEEVLREVEERNRRSIEKIRKVLEDVTK

SEQ ID NO: 20744 - protein, 182 aa, Artificial Sequence; identical to SEQ ID NO: 20743
  Synthetic sequence.

SEQ ID NO: 20745 - protein, 185 aa, Artificial Sequence
  Synthetic sequence.
SEVDELVEKIRTTVKRVLEKHKRNTDETRRLVEEILERHTRTSRRIERVVREATDKLRRRKTEEVKKDLDRLLKELREEVEELKRRTTEILKRSRESSDRVRRESEEILDRLRKDVEDLRRKRKDVTEMLEKLREVLERAAEVLKRAEESDRTVDEEVERRVREVARSDDEVLKEVKREVERVKT

SEQ ID NO: 20746 - protein, 185 aa, Artificial Sequence; identical to SEQ ID NO: 20745
  Synthetic sequence.

SEQ ID NO: 20747 - protein, 182 aa, Artificial Sequence
  Synthetic sequence.
SEAEEVAKRVKEIAKENADLAREVAKDIKRLADENKKHADDVARDIERLAKELLEAARRGDAREEVAERARRRAEELARRHREENKRSEERARRLAEKAKRDNEKSREDIRRLLEDLKRKGAPERAEKLARDAAEEAKKAAEESNKLIREAAERLKEAARRADKLVEEAARRLEKAAEEARR

SEQ ID NO: 20748 - protein, 182 aa, Artificial Sequence; identical to SEQ ID NO: 20747
  Synthetic sequence.

SEQ ID NO: 20749 - protein, 182 aa, Artificial Sequence
  Synthetic sequence.
DEVDEVVRRDERLAEENLKRNTESSKRDRDLARENLKDAKRVVERIRKLMEDLKKLFDRGDIRDERARDVEREVEELLRELKRRNEESERRSRELLERLREDNERSKRRSKRLLERLRERNVDEKLTRRVEESLKRSEEVLRRVNESDKRSLEETRKVLEESNKEIEKVVRDLEELLKEVRR

SEQ ID NO: 20750 - protein, 182 aa, Artificial Sequence; identical to SEQ ID NO: 20749
  Synthetic sequence.

SEQ ID NO: 20751 - protein, 182 aa, Artificial Sequence
  Synthetic sequence.
SEADKVVKEVDDIVARNTEENDKSSKRVEDIIRENDKHAEEVVRDIRRLAEELRELRERGEIREKRLEEVRRRVEELLREHKEENDRSAEEIKKILRDLAERNKDSLRRIRKLLKDLKDKNLPEELEKRLRDVVRRAEERLRDVNRSDEEVVRRAEELLKRVDDRVKTVVEELKKTLDDERR

SEQ ID NO: 20752 - protein, 182 aa, Artificial Sequence; identical to SEQ ID NO: 20751
  Synthetic sequence.

SEQ ID NO: 20753 - protein, 182 aa, Artificial Sequence
  Synthetic sequence.
EEVDRVVKRDDDLARKNLEENERSSREDDRLVKENEDHAKKVVDDIRKLMEELRELARRGDIREKDADRVRREVDELLKKHRRFNEESRKESKRLLDELRRRNDESTKDSERLMRDLKRKNVPEELEKRLRESLRRSREVLKRVNESDRDSLERTKKRLEDVDREVRKVVEELRKVIRDEEK

SEQ ID NO: 20754 - protein, 182 aa, Artificial Sequence; identical to SEQ ID NO: 20753
  Synthetic sequence.

SEQ ID NO: 20755 - protein, 182 aa, Artificial Sequence
  Synthetic sequence.
SEAEEVARRVEKIAEDNARHAEKVAKDIEDLARENLELNERTSRRVERLARELLKAARRGDAREEVARRVEREIEKILEDANEANRRSEKEAEELAERHKEENERSKREIDELLKRLEDAGAPEEARKLARKAAEDARRAAERANELVKRAADELRRAAEEANKSDEDAAREARRAAEEAER

SEQ ID NO: 20756 - protein, 182 aa, Artificial Sequence; identical to SEQ ID NO: 20755
  Synthetic sequence.

SEQ ID NO: 20757 - protein, 182 aa, Artificial Sequence
  Synthetic sequence.
KDVEDVVREDEELAKTNKKHADDVVRRIKELIDRNRRLNEETSKRIEDLVRRLLELARRGDIREDELRRVREEVEKILKDVNEENRRSLRELERLVKEHEERNRDSKKRSEDLAEELKKRNVPERVRKEVERSLRKSDEVLRRVNDKVRRVLEELRKVLEDVNRSDEKVLRELEELLERVRT

SEQ ID NO: 20758 - protein, 182 aa, Artificial Sequence; identical to SEQ ID NO: 20757
  Synthetic sequence.

SEQ ID NO: 20759 - protein, 174 aa, Artificial Sequence
  Synthetic sequence.
SEDEKVRKVVEEAKEVNRRAEEAIKDVSERLERVNREVTKRSRDVSEEVRKMLERDASDKDEVERVKEKSKKSNEDLKRISERSRDESRKSNETLRRISEETRRRIREIEKLVKAGKDVDEVVKRIKELVDRSLELAERIVERNERLVEKSERDVRKIVEDNKRLADEVAKRAT

SEQ ID NO: 20760 - protein, 174 aa, Artificial Sequence; identical to SEQ ID NO: 20759
  Synthetic sequence.

SEQ ID NO: 20761 - protein, 174 aa, Artificial Sequence
  Synthetic sequence.
REDELVDKVLRELEELLRRVKKRLEDVSRDLERVNREVRDELRRVSKKVEDMARRDVGDKELVDEVRRESEKSNKELEDISRESKERSDDSNRKLDKLLKDVRDELRRIRKKVEDGKDAETVVRDIRRLAEELLRTVDKIVKDNERLARESRERVRRIVERNEELARDLARKAR

SEQ ID NO: 20762 - protein, 174 aa, Artificial Sequence; identical to SEQ ID NO: 20761
  Synthetic sequence.

SEQ ID NO: 20763 - protein, 174 aa, Artificial Sequence
  Synthetic sequence.
DDEKKVEDVVRKVKKVAEDVRRRLEKVSREVKKVLDEVRRRVEEVSREVEEILRRAASDKKDVEEVKRRSEDSKRRLEEIIKEIEERSRRSNETLKKLIKELEDRVRKIKEKVDRGSDADEVVKRIEDLVRDLERRVDEIVKRNKELVKRVEEEADKIVEDNKRLAEEVLRKAT

SEQ ID NO: 20764 - protein, 174 aa, Artificial Sequence; identical to SEQ ID NO: 20763
  Synthetic sequence.

SEQ ID NO: 20765 - protein, 174 aa, Artificial Sequence
  Synthetic sequence.
DSRRKVKEVIKELEEVLRRVKEEVEKVSRDLERLLKEVKEKLERVSRKVEEEIREKASDKELADEVRKRSKDSNDELKRLLDELRKRSEDSDRRLDEVVTRIRKRLKDIEKKVEDGSDADTVVKRIKELMKDVERIVEEIVRENRKLVTDLLREVDRIVEENERLAEELAERAR

SEQ ID NO: 20766 - protein, 174 aa, Artificial Sequence; identical to SEQ ID NO: 20765
  Synthetic sequence.

SEQ ID NO: 20767 - protein, 174 aa, Artificial Sequence
  Synthetic sequence.
SSKEKVERVVERLRRVNEEVIRLIEKVSRELEEVNKEVRERIERSVKETEDILRTAASDKEEVDDVRRRTEELVRRLEKLSEDSKKRSKESLEEVRRISKDTEDKVREIRKKVEAGKDVDTVVREIEKLMDDSKKKADRIVDENRELVKRSEEAVEELVRRDKKLAEDVFRKAE

SEQ ID NO: 20768 - protein, 174 aa, Artificial Sequence; identical to SEQ ID NO: 20767
  Synthetic sequence.

SEQ ID NO: 20769 - protein, 174 aa, Artificial Sequence
  Synthetic sequence.
DDERKVKKVVKEVRKVDEEVARRLDKVSKELRDVNREVKKKMEDSVKKTEDLAKKDASDKELVDRVRRETERLLEELEKLSRDSEEESKKSKEELERISRETEDRIRKIERLVEGGKDADTVVKRIKELAEESEKRVDKIVKRNKELVDKSKKDVDELVKRDEELMKDLVEKAR

SEQ ID NO: 20770 - protein, 174 aa, Artificial Sequence; identical to SEQ ID NO: 20769
  Synthetic sequence.

SEQ ID NO: 20771 - protein, 174 aa, Artificial Sequence
  Synthetic sequence.
SAEEKVRKVLKELREVNERVERELKRVSDESERVDDEVNTRAKKVVRDVERVLEERAGDKEEVEEVRKRIEELLEELKRLSEENKRRSEESEKELKEISKKTDEDLKRIERLVEAGKDVDEVVERIERLARESKKRVERIVRENEKSARESEKRADEIVKTIEELAERVARRAT

SEQ ID NO: 20772 - protein, 174 aa, Artificial Sequence; identical to SEQ ID NO: 20771
  Synthetic sequence.

SEQ ID NO: 20773 - protein, 174 aa, Artificial Sequence
  Synthetic sequence.
KDEERVKEVVKKLRKVNEDVRRLIERVSRESKRLDEEVNRELDESAKDTERALRERLGDKEAVDRVRDETRRLAEELKELSERNEKRSRDSAREVEKISRDTEERVKEIEDKVKAGADADEVVKEIEKLAKTSEELARRIVRENEESARESLERARKLVEDDRRLVKEVVERAE

SEQ ID NO: 20774 - protein, 174 aa, Artificial Sequence; identical to SEQ ID NO: 20773
  Synthetic sequence.

SEQ ID NO: 20775 - protein, 181 aa, Artificial Sequence
  Synthetic sequence.
DLEERLATVVRKVEEDLKKLRRDNEKVIREVEKLNEDLNRRNKKLIDEVRKLLEKAKREGSLRDEEVERLEEELDKSNKRLEEISRKNKKELEESHKRLAEIVKRLKDELEKIKEEVKRVDDEKRVRELLEKIKRLLEEVDRRVKESIKEIEDSLRRSKEKADRSIEEIKKLLDDLRERAR

SEQ ID NO: 20776 - protein, 181 aa, Artificial Sequence; identical to SEQ ID NO: 20775
  Synthetic sequence.

SEQ ID NO: 20777 - protein, 181 aa, Artificial Sequence
  Synthetic sequence.
SVEDLLRRVVEEVRKELERLKRKNEKVVKEVRKKNKEVNDRNEEVIRRVEKRLKKLKEDGRLSDELVEKLKEELRRSNEELRKISDENEKELEKSNRRLKKIADRVEEELKRIKEELDRVDDEEEVRRLVRRIEKIVDEVRKRVDKSVEEIKRSLKRSKELADESLERIRRLLEEIDERVR

SEQ ID NO: 20778 - protein, 181 aa, Artificial Sequence; identical to SEQ ID NO: 20777
  Synthetic sequence.

SEQ ID NO: 20779 - protein, 179 aa, Artificial Sequence
  Synthetic sequence.
SSDEELKKVLEDMKRVLEKVREDMKRVNDELKEAVERVKKESDDVDRELRRVIEEVVREDTDDEDLKRELDDIHRRNREHTERLLDEARRLLEDSKRHTEETEKTLRRLLEDLKRKIERKEVDVKDLVRTVERLVEEIKDLVRKDVERVKKIVRRIEDLAKKDVEVSEKLVKEIKDRAK

SEQ ID NO: 20780 - protein, 179 aa, Artificial Sequence; identical to SEQ ID NO: 20779
  Synthetic sequence.

SEQ ID NO: 20781 - protein, 179 aa, Artificial Sequence
  Synthetic sequence.
SAKELLDDVAKKLEEVVERVARKLDEVDERLREMIERVRKELEDVNRRLRDLVRRVVDKDRTDEDLKKRIEDLEERLRRHTEETVKRAEDIHRENREKLREMKETLKELRDRLKEILDRNELRVEEVVRDVERIVDEIEKRAEKVVRDSEKLVRDIEELVRRDVREVERIAEEIEKEAT

SEQ ID NO: 20782 - protein, 179 aa, Artificial Sequence; identical to SEQ ID NO: 20781
  Synthetic sequence.

SEQ ID NO: 20783 - protein, 179 aa, Artificial Sequence
  Synthetic sequence.
SADEELERVLRELDKVIKDVVEESRDVDRKLERVVREVERLLDDVDRRLKEVIERVVREVTDKEDLRREAEKIHKENTDRLRELKKELKKLLDDSRRHSKEVEDELEKLLRDLKRILDRKELDVKDVVTEVKKLVETVKRLVEENVKRVEKIAEEIRRLVEKVVRESDELVERIERRVR

SEQ ID NO: 20784 - protein, 179 aa, Artificial Sequence; identical to SEQ ID NO: 20783
  Synthetic sequence.

SEQ ID NO: 20785 - protein, 188 aa, Artificial Sequence
  Synthetic sequence.
SAEELIRKAAEDARRANKEAEDLIREAAKEARRANEEAERLIREAAKRAEDALRDADRKAREKEAKDRARKLAKEIRDLIKKAEEDAKKSHEETEELIRRAEEEIKKSHEEIKKLIERAEEEAEKKKDAEEEAKKLADDIREAAKRSLDRARELAKRIREAARRSLEEAKKLAEEIKKAAEKALRDAT

SEQ ID NO: 20786 - protein, 188 aa, Artificial Sequence; identical to SEQ ID NO: 20785
  Synthetic sequence.

SEQ ID NO: 20787 - protein, 184 aa, Artificial Sequence
  Synthetic sequence.
SAVERVVREVKKTVDESRKRAEKEKREVEDVVRRIREKVKRVVDDNRRVVETIKELSKERRDEELLRRAEEEVRRVHERNRDILREIAETIRRVEERLRESLEDSRRESKRVKEELEEVLKEDKSEEAREKLDRVRKELDDANRRVEEELRRVARELEKVLREVEELLRKVDEDIRRVLDEERR

SEQ ID NO: 20788 - protein, 184 aa, Artificial Sequence; identical to SEQ ID NO: 20787
  Synthetic sequence.

SEQ ID NO: 20789 - protein, 184 aa, Artificial Sequence
  Synthetic sequence.
KDVEEVARKVKRVAERSEELVAELVKKNKKVVDESREKVDDVVRRNKELVDTIRDLARRRKDEDLLREAEERVRRVHEENKKAHTDSKEAIDRLEEDNRRVNEESRRLSKRVKEELKEVLKRDRSEEIRKLAEDVKRELERVNKKVKELSDRAAEELKRVNEEVRKKLEEVDREIRKVLEEVRK

SEQ ID NO: 20790 - protein, 184 aa, Artificial Sequence; identical to SEQ ID NO: 20789
  Synthetic sequence.

SEQ ID NO: 20791 - protein, 184 aa, Artificial Sequence
  Synthetic sequence.
SLMEEVKKEVDKVVREIKELVRKVEEDVKKVVKESRDKVDKVVKENKKVVEKIRDLARRRTDEDLLREAEDEVRKVHEENKRIHKESEDTIREVEKKLKKVLDDIERLVKEVSDRAKRVLDDDRSDEIRKLIKEALDKLKEVLDEARDRLKKVKEELETVNREVEKLLRDVDREIEKVLKEVEK

SEQ ID NO: 20792 - protein, 184 aa, Artificial Sequence; identical to SEQ ID NO: 20791
  Synthetic sequence.

SEQ ID NO: 20793 - protein, 190 aa, Artificial Sequence
  Synthetic sequence.
SEAEKIVREVERVVEESRRVAKENEKEVDKVVDTIRKLIEDLARRVEDILKKIEEERRKGGDDKEKLLEKIKRLLDELRKLIEELERRVEKIVEDVKRHSEELKERSKDLNRRIKEKIEDVLRKLKDDRDVKRIEDLLREVEERLRRVSEEVKKRLKELHERVEEVLRELRKRLRDLERKARKVLEEAKK

SEQ ID NO: 20794 - protein, 190 aa, Artificial Sequence; identical to SEQ ID NO: 20793
  Synthetic sequence.

SEQ ID NO: 20795 - protein, 173 aa, Artificial Sequence
  Synthetic sequence.
DVKEVLDEARKVVEDSIRRSKELIDEVRKRVEESVEESKRLAETVAEEVREVIERARGRDSAEELKRELDRLIEEIKRSNEKLRRDIKKLEDDVRRSDERLRREIEKIEELIRRGSDIETVLREVKRLVRENVKRIAELVKTIEDLVRENSERVRRVVREIRELVKELEKKAR

SEQ ID NO: 20796 - protein, 173 aa, Artificial Sequence; identical to SEQ ID NO: 20795
  Synthetic sequence.

SEQ ID NO: 20797 - protein, 173 aa, Artificial Sequence
  Synthetic sequence.
DVDELLKRVEDEVRRSKEESEKLRKEVRKEVEDSAKTSKDLIDDARRTVEEVIKKVKGRDVIEELKERIERLEKTVRDSDKELRERIRELEREIEESNRRLEEDIKRIKKVIKDGADVDTVVERIRKLVKENSDRVREVVDTIKKLVEENVREVRRLVEEIKRLVEEVKRREE

SEQ ID NO: 20798 - protein, 173 aa, Artificial Sequence; identical to SEQ ID NO: 20797
  Synthetic sequence.

SEQ ID NO: 20799 - protein, 173 aa, Artificial Sequence
  Synthetic sequence.
DVKEVLKRAEEEVRRSIKRTREVLERVEKMVRDSSRTTTDLIRKVRREVKRVIDEVNGRDLARELKRMLDELDERLKDSDRKLKEKIDRLIKEIEESDDELRRTIEEIKKLIDDGTDIDTVLEDVKRLVKENSEKIDEVVREIRELVETNRKLVEDLVREIKELVEKALRDAK

SEQ ID NO: 20800 - protein, 173 aa, Artificial Sequence; identical to SEQ ID NO: 20799
  Synthetic sequence.

SEQ ID NO: 20801 - protein, 173 aa, Artificial Sequence
  Synthetic sequence.
DVKEVLKRAKDEVRRSSDRTRRLIEKVRDESERVVEEVKKLNEDVNREVERVIREVKGRDVVEEVRRRVEKLNRDNEKIIKEDRDALEEIRRRLEESDKRLEDVIREIEKVIDDGKDIDTVLREVEKLVRDNERLVEKLVKEVEDSVRETKKRVEESVDTVRRIVEELKRRAT

SEQ ID NO: 20802 - protein, 173 aa, Artificial Sequence; identical to SEQ ID NO: 20801
  Synthetic sequence.

SEQ ID NO: 20803 - protein, 178 aa, Artificial Sequence
  Synthetic sequence.
SEAEEVLREVKEVVDRSRELAERVLRAVRELVKRDEDLARKILEDVARVVKTIDDLARERSDEEVLRRVKRLVDELRKKLKKVLEDSARLAEDLRRKAEEVKRESKRLSDELREKAKKAGVDKEVVDRADRALREVNKRLDEVVREVEKLLRESLDRSRRVIEEVAKRLEEVLKKLED

SEQ ID NO: 20804 - protein, 178 aa, Artificial Sequence; identical to SEQ ID NO: 20803
  Synthetic sequence.

SEQ ID NO: 20805 - protein, 178 aa, Artificial Sequence
  Synthetic sequence.
DEMDEVRREVERVVREDEKLARDLKRRVEKVVEDIKRSADEVLKEVKKLVEEIRELMKKRTDREVLERVRRKVEELTRELERNHREIEELVRRVKRELEKALKESEDRVREVKERLERAGVDREVVRRVEEELERSLRKSREVVKRVEKELEDVLREHRKVLEEVTDLLRRVLEELRR

SEQ ID NO: 20806 - protein, 178 aa, Artificial Sequence; identical to SEQ ID NO: 20805
  Synthetic sequence.

SEQ ID NO: 20807 - protein, 186 aa, Artificial Sequence
  Synthetic sequence.
REAEEILKKVAEVVKEDKKLADDLRKKNKETVDDIRRKAEELLKRVKKVVEELKRRMEEGGDDRKKLTDRVEELLRRVEEELKDLKRKIDEIIERLKRDNERVLRRSEDLVRKVEEELKDVIDKSDTDELRKIAEEVRKRLEDSVRTTRDIIRRVKRENEEVIKELERVMRKVREDLKRVKEEIER

SEQ ID NO: 20808 - protein, 186 aa, Artificial Sequence; identical to SEQ ID NO: 20807
  Synthetic sequence.

SEQ ID NO: 20809 - protein, 178 aa, Artificial Sequence
  Synthetic sequence.
SREEVAKEVRELIARSEKETRDIIREVEDRMRRSKEETEEVIKEVKRLLEEVKKRLEEKGISEELRESVDRVEETVRRLLTKLREDSERLRRRLRKLLEEIRRESERLKEEVERLIRRNEGDAEEILRTVKKVVDRDRELAKRLLDEARELVRTNRELVKRVLETVTRLVKKIDDEAR

SEQ ID NO: 20810 - protein, 178 aa, Artificial Sequence; identical to SEQ ID NO: 20809
  Synthetic sequence.

SEQ ID NO: 20811 - protein, 178 aa, Artificial Sequence
  Synthetic sequence.
DEEEVEKRVKDLLRESTERTKEVNERVRRLAEESRKRTEEIIREVRRLAEEVEERLRRRGIDEELKRRVEEVKKRLEELLTDLKRRSDELRKRLEDSSRETEKKSREVVKTVDELRKRREGDVRELLETVKKLVKDDVDIVRRNLEEVKKLVETNVRLAEEVLKEVDRLVKKVEEDAR

SEQ ID NO: 20812 - protein, 178 aa, Artificial Sequence; identical to SEQ ID NO: 20811
  Synthetic sequence.

SEQ ID NO: 20813 - protein, 184 aa, Artificial Sequence
  Synthetic sequence.
DELDEIRKRVEELIKRSEEDSREVRRRLEEIIERNRKISRDVEREIEKLIKDVRDSNTTSEEAKELLKDIRRKLKELVDRLHKIDEDSLREVERLVKRLKDKNRDILRELEELARDLRRRLRGEELRRVEEVVKRVRELVERSKEETDKIAEDVRRLLKESNDDTERIKRKVEEMLKELEERIK

SEQ ID NO: 20814 - protein, 184 aa, Artificial Sequence; identical to SEQ ID NO: 20813
  Synthetic sequence.

SEQ ID NO: 20815 - protein, 178 aa, Artificial Sequence
  Synthetic sequence.
RELDEVVKTVRKLVDESKKESDDVAREARELLEKLERESEEVVRRVRELVKELKKKRDDERLDRVVKDILKKVEDLIRELREVNKETRKKVERLVKELERVNREIRERVERIMDVLRRGDVDVDEVLRKAKELIDDSRRLIEDVKRRLKELIDRDRRLIERVLEEAERLIRELDEEAR

SEQ ID NO: 20816 - protein, 178 aa, Artificial Sequence; identical to SEQ ID NO: 20815
  Synthetic sequence.

SEQ ID NO: 20817 - protein, 190 aa, Artificial Sequence
  Synthetic sequence.
KEIEELDKMVEDIVRELDELVRAHTETVDRLIRDLERSNEELRKLIKKIVDELEDLVRRGGDDKERLLREIKRLVDDLKRLVEKNTRDIKRMADELRETAKEVEERIKELIKRLEDLARDILRKRKDDEEVVRRLKDVERKVKKLAEDVKEKLRRSVERVTKLLKEVEDNSREVEKEAEERVDRVLKKVK

SEQ ID NO: 20818 - protein, 190 aa, Artificial Sequence; identical to SEQ ID NO: 20817
  Synthetic sequence.

SEQ ID NO: 20819 - protein, 175 aa, Artificial Sequence
  Synthetic sequence.
REVEELVERIERSSRRALERLEDLDRTIKKSSEDARRRLKEMDDRLEELVKRARDNGVDEEVVKEVKKLVEESRRDNEESVKRSEDLLRETERRNRDAIRRSEEEVRKILEVLKKGELREEEIKKVLEEDRKLVEKLERDNKRVLDEDKELVRRNEERNREVLERIRELIERART

SEQ ID NO: 20820 - protein, 175 aa, Artificial Sequence; identical to SEQ ID NO: 20819
  Synthetic sequence.

SEQ ID NO: 20821 - protein, 179 aa, Artificial Sequence
  Synthetic sequence.
DEVEKLIKDIRDIIRRVEEAVARLVEENNKLVKEVDDRLRELSKENRDIVRKVREGGVGDEVLEKAEDSSRRNDEDVKKLLTELRKSSEDLKRLVDDVRKKLEDKVRRLEEVVRKELSDKRTLLEEAKRVLEDIEKEARDLLRRLEEIIRRTRKLVKDILDRSRDILRRTRELVDRVRR

SEQ ID NO: 20822 - protein, 179 aa, Artificial Sequence; identical to SEQ ID NO: 20821
  Synthetic sequence.

SEQ ID NO: 20823 - protein, 179 aa, Artificial Sequence
  Synthetic sequence.
KEAEDLLRRIEDLIRKVKKEVEDLVRENNRLVEKVVRELEKLSDELRKLIKRIKDAGVSDEVLRRLEEIVKRNDEEVRKILEEAKKSSRRLEETMRKVLEDLRRLVERLKRVVDEELQDKETLLRDIERIRREIEKLIEELLRRAEEIIRDTERLVEKILRESKELLKEIRELAEREKQ

SEQ ID NO: 20824 - protein, 179 aa, Artificial Sequence; identical to SEQ ID NO: 20823
  Synthetic sequence.

SEQ ID NO: 20825 - protein, 184 aa, Artificial Sequence
  Synthetic sequence.
DLERVVEESSRLVERVVRRNKKVVEDIRRRVREVERKNEEVTKEIKKILDEVRRRLERDGADSTLLRELEEVIKEAEKRHKDSIDELREILKELEKRHRKSIRELREINKDLRRRVKDLRDKGGIREELKKLLERSREMLEKSERTVDTSREEAKRVLEESEELVERTLREVEEIIRRVIERVR

SEQ ID NO: 20826 - protein, 184 aa, Artificial Sequence; identical to SEQ ID NO: 20825
  Synthetic sequence.

SEQ ID NO: 20827 - protein, 184 aa, Artificial Sequence
  Synthetic sequence.
SLEEVLRAVRKLAEDVKRKNKEVLDRIRDSSRRSEEKLEDSLRKIEELVRKLEEELKRDGADERLAEELREILDRVRKEHKRLVEENRRVVKKVEDEHRKSEEELDRIVDELRRRVEELRKRGGVDEDLKRLLEEIKRVLEESEEKVERSLREMEEVDKETEKRSRKLNREVREVVKDVADKVR

SEQ ID NO: 20828 - protein, 184 aa, Artificial Sequence; identical to SEQ ID NO: 20827
  Synthetic sequence.

SEQ ID NO: 20829 - protein, 181 aa, Artificial Sequence
  Synthetic sequence.
SRLEDLLRKVKKVLDEIRRTIEKSLEDVRELIKRIERTIEKLLERSRDVVRRVLEDAERRRRKELVEELEKELRRIDEEVEEEVRRLIEELERIVRESEKLSDKLIRDLERIVKRLAEEVDSEKAKEVLKEVKDRVDEVAKELTDVNRDIRRIVDELRRRAEKVVRESRELSRELREELEK

SEQ ID NO: 20830 - protein, 181 aa, Artificial Sequence; identical to SEQ ID NO: 20829
  Synthetic sequence.

SEQ ID NO: 20831 - protein, 181 aa, Artificial Sequence
  Synthetic sequence.
SELERLLEEVEKELRKIERTITELLRRSRELLEEIERAIKESLRDSERLLREIEDTVRKRRREEIVDKLVKDLERLDEESKKLSEKLARDLDKANKRVEDTVRELIERLKEIVEELARRLDESKVREVLREVRERVKEVVERLKRVVEESRKRSEEVKKKLEEVNRRSEEESKRVKEELKK

SEQ ID NO: 20832 - protein, 181 aa, Artificial Sequence; identical to SEQ ID NO: 20831
  Synthetic sequence.

SEQ ID NO: 20833 - protein, 182 aa, Artificial Sequence
  Synthetic sequence.
KLEEVLRTVRKLVEDLREELERVVRTSRELTRRLEEELKEVVKRSEDLSRRLEEILKRDAREDKDLVTEIKRRLEELNRRNRELVKELLRLLDEVDKDLKRLVEELLRELEKVIKKIKDLVDNNVDLTEALKEVKRLVDEIRKTIEEALRDSKRLVDEIRETIKRSLEEVEKEVRKAEERIR

SEQ ID NO: 20834 - protein, 182 aa, Artificial Sequence; identical to SEQ ID NO: 20833
  Synthetic sequence.

SEQ ID NO: 20835 - protein, 182 aa, Artificial Sequence
  Synthetic sequence.
SIEDVLRAVEKLLRDLKRRSEEVVKHSETELRRLLEEVRRVLEHSREALERLEERIKDVREEVIKRVKELVEKLKKENEDLLTDVRRLLEELKRRNKELTERTKELLDRLKEEAEKAKRDNVSDEVIKEILERVKKLIEEIDERNKELNERTKELIKRIKDRLKELNDKTEKAIDKIRKEVE

SEQ ID NO: 20836 - protein, 182 aa, Artificial Sequence; identical to SEQ ID NO: 20835
  Synthetic sequence.

SEQ ID NO: 20837 - protein, 182 aa, Artificial Sequence
  Synthetic sequence.
SIEEVLREVEELLKELEKRARDVLRHSEELLRDVIRRSEEVVKHSEDLLRKLKEAAKDVREEVIRDVDRLVRELKERNRKLSDDSRRRVERLKEENEKLLKEVKDLVEELKRRAEKLSRDNVSDEELKKILDEVRKVIKELEDKLRKLNKKTEDVIRELIERNDRLNKDTKRVIDELKEKVR

SEQ ID NO: 20838 - protein, 182 aa, Artificial Sequence; identical to SEQ ID NO: 20837
  Synthetic sequence.

SEQ ID NO: 20839 - protein, 182 aa, Artificial Sequence
  Synthetic sequence.
SIEEVVEEVKELLERLIRRSEDVLRHSKKLLEELERKSERVVEHSEDLLRKLEEKIKDVKDDVIRKVRELAKKLRTENEDLSRRSREVVKRLKELNEKNLEEVRRLVKKLKEDAERLARNNVDDETLKRILEEVREVIKKLIKSSEDVNRETEELIRRLEDRNRKLNEKTEKVIREIEEEVK

SEQ ID NO: 20840 - protein, 182 aa, Artificial Sequence; identical to SEQ ID NO: 20839
  Synthetic sequence.

SEQ ID NO: 20841 - protein, 182 aa, Artificial Sequence
  Synthetic sequence.
TVEDVLRELRERLKESEKRDRDSVRKAEELLRRSEKRTDDVVKHSERLLEELEEAVRRIRGDELKTEVEEVRKKIRRSLEELKKHSKEVVDEIRRLLEESERHSKEVVEDIERKLESLRRIEDEDVVRRLLEEVEELLRRNVKKSEELLKEIRERLEDNIRKVEKVNRDNKREIEEILRRVK

SEQ ID NO: 20842 - protein, 182 aa, Artificial Sequence; identical to SEQ ID NO: 20841
  Synthetic sequence.

SEQ ID NO: 20843 - protein, 182 aa, Artificial Sequence
  Synthetic sequence.
TVEEVLKEAEDLLKESKERSEDSARRAEEILRRSEERTRKVVEHSREMARRLMEKVKEKRGDELKEEVERVLRRIEKSLEELRRHSERVKEEIRRLLEEDKKHSDDVVKTIRELLERLKRIDDEKVVEDVLREVEKLVRDNIEHSKRLLDEIRRRVEENIRRVDEVNKRNEELIREVEERVR

SEQ ID NO: 20844 - protein, 182 aa, Artificial Sequence; identical to SEQ ID NO: 20843
  Synthetic sequence.

SEQ ID NO: 20845 - protein, 185 aa, Artificial Sequence
  Synthetic sequence.
SKVEEILERVKRLIEENIKRSEEILEEVRRLIRENTEVSKKLLEEVKREITELEKEVREDRDKDRLRKKVEEVKDKIRKELKRNEDHSRRVAEEIRRLLRENERHSKRVADEVDRVLKELDKTTKDERVKDVLRRLKKIVDESKRRSDKVNKEIEDRVRESEKKSRKVNEDIKRLVKRVADEVER

SEQ ID NO: 20846 - protein, 185 aa, Artificial Sequence; identical to SEQ ID NO: 20845
  Synthetic sequence.

SEQ ID NO: 20847 - protein, 185 aa, Artificial Sequence
  Synthetic sequence.
SDIEDLLKKVEDLIRRNIETSRRLLEEVRKLIEENIRLAERILEEVRRLIEELARLTREDRDKDELRKKVEEVEKTVKDVIDDLRRHSDKVEEDIKKLLDDNRRHSEKVMREIEKVLKELRDRDNDEKVKDALRRLRDLIRRSKEDSERVNEEIKDIVRKSRETSEDVVRRARELLDKVRREVEK

SEQ ID NO: 20848 - protein, 185 aa, Artificial Sequence; identical to SEQ ID NO: 20847
  Synthetic sequence.

SEQ ID NO: 20849 - protein, 185 aa, Artificial Sequence
  Synthetic sequence.
SELEELLKEVAKLIKRNKDRVRKILDEVRKLIKRNEDVSRRLLEDVERLIKELEREVREDRDKDKLKRKVEEVRKRIEEVLRTNERHSREVAKEIKKVLDELREHSEKVARDIKRMLDDLRRKTRDKKVEDILRTLEELIRESERTSEEVLRELREEAEESKRKSKRVNDRIRELVEKVDREVDK

SEQ ID NO: 20850 - protein, 185 aa, Artificial Sequence; identical to SEQ ID NO: 20849
  Synthetic sequence.

SEQ ID NO: 20851 - protein, 185 aa, Artificial Sequence
  Synthetic sequence.
SKLERLLEEVEKLIRRNKRIVREILREVRELIERNIRVSEEINRRNRRLIEEIRRLVEEDKDKEKLRKKVEDLAEKVRESLERNEKHSREVEERIKELIRRLREHSEDVRRRIREVLKELAKTTDDERVKRILKEIERLVEESKRESERVLEEIKELVKDSKRRSKEVNDHSKKLVDEVREAVKK

SEQ ID NO: 20852 - protein, 185 aa, Artificial Sequence; identical to SEQ ID NO: 20851
  Synthetic sequence.

SEQ ID NO: 20853 - protein, 178 aa, Artificial Sequence
  Synthetic sequence.
SRIDELLKEIRKVTEKTRRDVERLLEEIRKVTDKSRKDSERSLDEARKVLDTIRKLLEDGKPKEKLLKELRDLLRRIEERNERILRENKRIVDEIKKEAEKLLKRNKEIVDEVAERAARDGVGEALERIKRSSEELAEEVKRVLDEVRRSSEELEKRARDSLRELRELVKRVEEEARK

SEQ ID NO: 20854 - protein, 178 aa, Artificial Sequence; identical to SEQ ID NO: 20853
  Synthetic sequence.

SEQ ID NO: 20855 - protein, 178 aa, Artificial Sequence
  Synthetic sequence.
SRIEKLLDEIRKVSKKSIDEVRKILEEVEKVTRDSIRKLRKLLREIEKVLEEIERLLKNGRDKDELVRRLEEIAKKIEEDIKKILEENRRIVREVKERLKAIVRRNEEIVDDVLKKMAKDGVGEALKRIKELSDEVREEVKKVLRKIEESSERLEEEAKKVLDTVRELVERVARRAKE

SEQ ID NO: 20856 - protein, 178 aa, Artificial Sequence; identical to SEQ ID NO: 20855
  Synthetic sequence.

SEQ ID NO: 20857 - protein, 179 aa, Artificial Sequence
  Synthetic sequence.
REAEEALRRVEEVVRRSKTELKKLLEDVRRLIEESERELRDLLRRVEEVIRRIREELRERKTEEVIKKIEKLVTDVREEVKRLLDRDRKIVTDIKRKVERLLEENERLVERVREEAERDLREVKEMLRTVDELLKDSERDSERVLREIEELLERSKRKSEEVLREIERLLEKIEREVRK

SEQ ID NO: 20858 - protein, 179 aa, Artificial Sequence; identical to SEQ ID NO: 20857
  Synthetic sequence.

SEQ ID NO: 20859 - protein, 177 aa, Artificial Sequence
  Synthetic sequence.
SEVEEVAREVDELVKESRDESRRIVEEAKRLLKESNKSVKDIERDARRLVKEVEDAVREEELKRLVDELRKRAEELVDESRKLDEDLRRRLDELVKRMEEINEELERRVRRIKELLKRGMDVKKVLDEVRELAERSKDLNRRLLERIRELVRRSKERNKELLKRLRDLVERVKREIK

SEQ ID NO: 20860 - protein, 177 aa, Artificial Sequence; identical to SEQ ID NO: 20859
  Synthetic sequence.

SEQ ID NO: 20861 - protein, 177 aa, Artificial Sequence
  Synthetic sequence.
DEVEEVKKDAERLNKELHESLRRSNEEAKRLLKESKDASREVVKDARRLTKELRETMNDDRVRDLVRRNEEVVREVEKTLERINEELERMVRRLVREDEKLNEDNKRKLDEAKERLRGGSDVEKVLRDLRRLTEETKRRNRETLEEIRRLIERSKEEIKRLLEELRELTKRTKDRIR

SEQ ID NO: 20862 - protein, 177 aa, Artificial Sequence; identical to SEQ ID NO: 20861
  Synthetic sequence.

SEQ ID NO: 20863 - protein, 177 aa, Artificial Sequence
  Synthetic sequence.
DEVKEVKDRARKLVEEVKRAVDEVRKRADELNKEVHESLRRSNREAERLVKEVEDTVREERAERELRRLEDRVREVVERDKKINEDNKRVIDELTKRLEDLVRELERVVREIEDRLRRGADVETVLREITELAKKILRDIEELLREITKITEESKRENEKSLRELEDLARRVKEKTR

SEQ ID NO: 20864 - protein, 177 aa, Artificial Sequence; identical to SEQ ID NO: 20863
  Synthetic sequence.

SEQ ID NO: 20865 - protein, 177 aa, Artificial Sequence
  Synthetic sequence.
DEVERLVEELERLLREVRDSVRRSNTEAKELNKEVHEAIRRVVEEARRLLEEVRRTADDEDVRRILKRLEEVIREIVERLKEINDRNRRVVEEVAKEDEKIVRELEKLVEEVRKVLKDGVDVETVLRRVEEVARRVKKLNEDTLRTLRRITEDSLRKIEKLLRDIEKLVREVVERLR

SEQ ID NO: 20866 - protein, 177 aa, Artificial Sequence; identical to SEQ ID NO: 20865
  Synthetic sequence.

SEQ ID NO: 20867 - protein, 180 aa, Artificial Sequence
  Synthetic sequence.
SEIEDLERRIKEVVDDLRRLVEENSKKIDDLLRRLKDLIRKVEEMNRKLIREAEELVREERSEELVREAEELVKTVHRENKRVEDEIRRLVEEVERHSEKVIRDIERLVRTIEEEIKSLPDSEELRKVEESVRRLAEEIKKELEDSRRRVEELVREIEKELEDVNRDARRLVDKVREELR

SEQ ID NO: 20868 - protein, 180 aa, Artificial Sequence; identical to SEQ ID NO: 20867
  Synthetic sequence.

SEQ ID NO: 20869 - protein, 184 aa, Artificial Sequence
  Synthetic sequence.
REVEELKKTLDRLVEESKRESDKVREDAERTVRESEDKSRRVKDEARRSLEEVEEDVKDESAEDILRRVRKVSEDHVKELKRLNDDLRRVSEDHVRTLDKLNEELREMVDRIRKRLDELEKRGGDKDEIKKILEEAEEVVRDSKKKIEDLLRHNKKRVDDSLRKIEEILKHNRDEIERVREEIR

SEQ ID NO: 20870 - protein, 184 aa, Artificial Sequence; identical to SEQ ID NO: 20869
  Synthetic sequence.

SEQ ID NO: 20871 - protein, 184 aa, Artificial Sequence
  Synthetic sequence.
DEVETVREEAKRLVEESRKESRRVEEELKKLLRRVEEEARKVKEELEKSVDEVRKAVTDKDAKDILKTLEDASRDHMRKLDEIIKRLKEIVEEVKRRLKKLNDELEKVVRDVERTLDDLKKKGGIREEIKKILERVREVVKRSKDEIREILKEVRKMIDKVRKEIKEILDHNKEVVRKIKEETK

SEQ ID NO: 20872 - protein, 184 aa, Artificial Sequence; identical to SEQ ID NO: 20871
  Synthetic sequence.

SEQ ID NO: 20873 - protein, 184 aa, Artificial Sequence
  Synthetic sequence.
SEVEEVKERAERLVRESEELSDRVRREAEKTIEAVRELVERIRKRLKESVEEVERRVTDKKAEDILRRVRELSKRHVDRLEKILRDVKKLSEDHVRTLEKLNKDLRDMVRKVEKELKELKDRGGVREEIKKLLEEVKRVVDKSKRDIDELLKHNRRKIDEVLRELEEILRHNETRIKEVLDRAR

SEQ ID NO: 20874 - protein, 184 aa, Artificial Sequence; identical to SEQ ID NO: 20873
  Synthetic sequence.

SEQ ID NO: 20875 - protein, 177 aa, Artificial Sequence
  Synthetic sequence.
SEVEKLLREAEEDVERILKRLEDSMDSNRELVERILETLKRSLDEVEKEIRKIIEELKRRRREEEARKLIEKIKRIIDTNHKLAEDLLRRLERHLRENHREAEELLRRLEELIEDLRRRNVDDKVIKRLEDLLRKVEKVVRDTNRTIKDSIRRVKEVVDTTNREAEKLLRRVEDTVR

SEQ ID NO: 20876 - protein, 177 aa, Artificial Sequence; identical to SEQ ID NO: 20875
  Synthetic sequence.

SEQ ID NO: 20877 - protein, 177 aa, Artificial Sequence
  Synthetic sequence.
SRVEKLLDEVRRLAEDILRDLERSMRSNEELVRKILEKLKESLESNRRLVKRILERLREERKEELARDLLRKLRKHLEDNHKLAEELLKRLEDHVKRNHERAKELLDELKKMLKELKDRDVDEKVIREVERLIEEVKRVVDDTNRRAEESIKEVRDLVRRTNEEIEKTIEEVDREVK

SEQ ID NO: 20878 - protein, 177 aa, Artificial Sequence; identical to SEQ ID NO: 20877
  Synthetic sequence.

SEQ ID NO: 20879 - protein, 180 aa, Artificial Sequence
  Synthetic sequence.
REAEEIKKALDKLAEELRELLERSRDTVRKLIKELRDLVRESRRRVKELIDDIRRRVDSKEMEKVLKTATDVLRRNEDLIRRIEKVLREILRKNKELADDIERVLRELEKKIEKLRRDGASREELKRLLEEVERLIERLKERIKRLTEESEKLVRELLKLIEKSTKESEEDVKRLVDEAK

SEQ ID NO: 20880 - protein, 180 aa, Artificial Sequence; identical to SEQ ID NO: 20879
  Synthetic sequence.

SEQ ID NO: 20881 - protein, 175 aa, Artificial Sequence
  Synthetic sequence.
SEIEDLLRRVRRLIEESEEVIKRVADEVKEIIDRSREKIKRVTEESREIIKRLKKDGKEDRDKLEKLVKELEDKNRESLRDTERLVRELRKLLEESLRLTEEIVTRLEKELRDIDRDRRVEDVERDIRRLVRKLREDNKRIAKTIEDLVRELRELNKRSEDETRKLVKELRDAAK

SEQ ID NO: 20882 - protein, 175 aa, Artificial Sequence; identical to SEQ ID NO: 20881
  Synthetic sequence.

SEQ ID NO: 20883 - protein, 183 aa, Artificial Sequence
  Synthetic sequence.
SEVERIKKAVEDLVRKLRKVSKETLDESRELVKELKERDKESEKDSRRLAERLRKLLEEKNQTDLRKEVEDVVRDMERSNKESKDKTDEVARELEESNRDNRRKVEEVVERLRRLLEKLKRSTDRKVVKDILDEVKKLIDDIEEHSKRVADRNRRLIEKIKKDTEDVIKRNRDLVTEIEKRIR

SEQ ID NO: 20884 - protein, 183 aa, Artificial Sequence; identical to SEQ ID NO: 20883
  Synthetic sequence.

SEQ ID NO: 20885 - protein, 183 aa, Artificial Sequence
  Synthetic sequence.
SEVEKIEERVKRLVEELKKSLKESEEETERLARELRDVDRRSKEESRRLAEELEDLLRRRNVDELKREVEKIVRDLDKSNRDSKRLTEKIVEDIKKSNEDSDKKVEDLRKRLEDLLRDLSRSTDDKVVEELLKEIEEEIRKILETNDKVVKENRRLAREILEDTKRVVDRNRELIKRIAERIK

SEQ ID NO: 20886 - protein, 183 aa, Artificial Sequence; identical to SEQ ID NO: 20885
  Synthetic sequence.

SEQ ID NO: 20887 - protein, 183 aa, Artificial Sequence
  Synthetic sequence.
DEVETIAKEVKELADKLRREVEESRKDSEDLVRKLRESLKESRKRSKDLVDELRKLLERKNTTKLREEVERVAEELKRTNDDSRRKVEDAMRKSKKLNDDLRRRVEKVVEEAKELLKDLKRSTDKKVVDDLRKRVEKLIKEIEEDIERVIRRSRKLIEDILRDNERVVKENEDLIREIEERIR

SEQ ID NO: 20888 - protein, 183 aa, Artificial Sequence; identical to SEQ ID NO: 20887
  Synthetic sequence.

SEQ ID NO: 20889 - protein, 183 aa, Artificial Sequence
  Synthetic sequence.
SDVERVEEELRKLLKEIEDSVRESERRLEKLLEDLKRSTEKTKKELKELIDRLEERVRERGDEEVKRVVEEVAKRAEDLLRESEELVREVAKRLRELLEESRRLVREAAEDLKRLLEELKRLTDSERVKEILERVRKLVEDVLRRNKRLVEEVERLIEEILRVDERIVREVRELIKRIEERIE

SEQ ID NO: 20890 - protein, 183 aa, Artificial Sequence; identical to SEQ ID NO: 20889
  Synthetic sequence.

SEQ ID NO: 20891 - protein, 183 aa, Artificial Sequence
  Synthetic sequence.
SSVEEVKKTLEDLLRESDKSVRESERRLRELLRESDESVERSRKTLEDLIRELEDLVRKRGDEEVKKEVDRVAEEAKKLLEDSKRLSDDLRRRLKELLEESEKLSRTLKDLLRRVLEELRRLTDDREVEKILREVTKLIEESLRRDREITEEVRDLIKKSKEKDKEIVDTVRRLIREIKERIR

SEQ ID NO: 20892 - protein, 183 aa, Artificial Sequence; identical to SEQ ID NO: 20891
  Synthetic sequence.

SEQ ID NO: 20893 - protein, 183 aa, Artificial Sequence
  Synthetic sequence.
RSVEEVVKTLEDLLEKLERSVRESEERLKKLLAESDDSVRKSAEELRRLIEELKDLVRREADEEVERTVREVAKEAEDVLEESKRLSDKLAERLKELLDRSRRLVEEVAETLRRLLEELKRLTDEREVKRLLDEVERLIDEIRERDKDIVREVDKLIKDSKREDKRIVDDVRRLIEEIKRRIK

SEQ ID NO: 20894 - protein, 183 aa, Artificial Sequence; identical to SEQ ID NO: 20893
  Synthetic sequence.

SEQ ID NO: 20895 - protein, 183 aa, Artificial Sequence
  Synthetic sequence.
SSVEEVKRELEKLLEDSDRSVEESKKTLRRLLEESNKELRRVAERLKDLIRELKKRVKERGTEEVARTVDTVAREAEKVLDKLREDSERLAETLKRLLEESERLSRELAKTLRELLERLRRLTDDREVEEILRRVRKLIEESKTMDKKIVDDVRKLIEESLRDIERIVEDVERLIKEIKERIT

SEQ ID NO: 20896 - protein, 183 aa, Artificial Sequence; identical to SEQ ID NO: 20895
  Synthetic sequence.

SEQ ID NO: 20897 - protein, 183 aa, Artificial Sequence
  Synthetic sequence.
SSVETVEKELRRLIKELRDSVKKSEDDLRRLLEESNRLVREVERRLRELLEKLRKLVEERADERVEDEVRKVAERLKKLLKELKELSEKLARDLKRLLERSKRLVEEVEKELRRLLEELKRLTDDREVKRILDEVKDRIRRILREDEEIVKEVRRRIKRSEEAIREIAREVDREIEDIERRIR

SEQ ID NO: 20898 - protein, 183 aa, Artificial Sequence; identical to SEQ ID NO: 20897
  Synthetic sequence.

SEQ ID NO: 20899 - protein, 174 aa, Artificial Sequence
  Synthetic sequence.
SEVEELEERARKLLEDVERLTREVEERAKELVKRVKDSSKRSEDEIRRLLRKLLETSGDNEEVRDVEERAKRVVEESRESNKKLEEDLRRLVEELRKSNEELKRRIEEVRKVLADGKDVEKVIRTLEEEVRRDEEKIREVLERVEDLIREDLRRDEELVKELEKLIREVDEKER

SEQ ID NO: 20900 - protein, 174 aa, Artificial Sequence; identical to SEQ ID NO: 20899
  Synthetic sequence.

SEQ ID NO: 20901 - protein, 174 aa, Artificial Sequence
  Synthetic sequence.
KEVEDLEEELKKLLKEVKTRTEKVVRDAEKSVRDLEKSSRDSDRTLKDLLRRLMETTGDNEIVEELTRRLKKLKEESDKSNEDHDRKSKKLVKRLEDSNKRLEEEARRLRKVLDDGKDVKKVLDEVRRLVEEDKKRIEEVLKENRESVKRDKELDDRLLERVRELIERALERAR

SEQ ID NO: 20902 - protein, 174 aa, Artificial Sequence; identical to SEQ ID NO: 20901
  Synthetic sequence.

SEQ ID NO: 20903 - protein, 174 aa, Artificial Sequence
  Synthetic sequence.
SEVERLEEEAKRLLEELKRLVERVVREAERSVEKVRDSVRRSEEEARRLLEEITKDDGRNELVETLERLAEELVRRSKKLVEEHEKRSRDLVRELEELVKRVEEKIRDVVRKLRNGKDVDKVVEDLKDDIRKVKKRIEEVLDENRKSVRKLDEDDRRLVDELRRLVKEVKDKVR

SEQ ID NO: 20904 - protein, 174 aa, Artificial Sequence; identical to SEQ ID NO: 20903
  Synthetic sequence.

SEQ ID NO: 20905 - protein, 177 aa, Artificial Sequence
  Synthetic sequence.
KEVEDLKEELKKLVEELERLVEKNVREARELVKRSEEESRRVAETARRLVDEIRRAGLDEEVVRRLKEVVDDVIRKLKELDDRLRDVVRKVEEENERLVRELRKVVKRVVEELEKTTDRRTITELLKEVEELVKRVLDAIRKSNREVEKLVRESLRRIEKLLREVEKLVKELLERRK

SEQ ID NO: 20906 - protein, 177 aa, Artificial Sequence; identical to SEQ ID NO: 20905
  Synthetic sequence.

SEQ ID NO: 20907 - protein, 177 aa, Artificial Sequence
  Synthetic sequence.
DEVERLEEELKRLVKEIEDSVRESKKEAEETLRESRKLSREVEERARRLVEELKRKGVPDELVKRLEEVVREVKKDLERLDEEHERKSEEIVRRSEKLVEDLRRLAEEVVRRLRRTTDEREIRELLEEVRKVVEEIKRRDDELVKENRRSIEESKRRIEELLKEVKELVERVTDTER

SEQ ID NO: 20908 - protein, 177 aa, Artificial Sequence; identical to SEQ ID NO: 20907
  Synthetic sequence.

SEQ ID NO: 20909 - protein, 177 aa, Artificial Sequence
  Synthetic sequence.
RDVEEVKKEAEELVKKSEESVRRSKEELERTLKRSREESERVKETAKKLVEKIERDGIPDRLVKELEDAVRRIAEELDKLDKDHEDKSKKIVDDSKKNLDELREFVRRVADELDKTTDKETIKRLLDEVRKLVEDSLRHDEELVERNKKSIKDSLDEIERLLREIEELVRKVEEDER

SEQ ID NO: 20910 - protein, 177 aa, Artificial Sequence; identical to SEQ ID NO: 20909
  Synthetic sequence.

SEQ ID NO: 20911 - protein, 177 aa, Artificial Sequence
  Synthetic sequence.
SDVDRVKEDAKRLVEESKRSVDESAKDMRRTLKRSRDESRRVKEELKRLVDRVKESGLDDKVVRELERAVRRVEEDLKKLNKDHEDKSRELIKRSEKNVRELKKVVEDVAEELDRTTDKDEIRELLERVKKLVDESRRHDKRLVEENRRSARDSLREIERLLREVRKLVEKVLRDRK

SEQ ID NO: 20912 - protein, 177 aa, Artificial Sequence; identical to SEQ ID NO: 20911
  Synthetic sequence.

SEQ ID NO: 20913 - protein, 177 aa, Artificial Sequence
  Synthetic sequence.
DEVETALEEVKELLERVLRKIEDDLRRVRDLLEKLKRTNEELLRKVREEVRRLADLIRKRRTEDVERELERLLDELRREVERVERENRKIVDELEKHTRRVVEEIKETLRELDRKVKEMNLDETVKREIEKARETLERLLKRSEEEVDRVKKEVEEISRRVKKEVKKLVDEIRERLR

SEQ ID NO: 20914 - protein, 177 aa, Artificial Sequence; identical to SEQ ID NO: 20913
  Synthetic sequence.

SEQ ID NO: 20915 - protein, 177 aa, Artificial Sequence
  Synthetic sequence.
RRVEEVAKELKRIAEKLKRDIEELLRDDKRLADELRETNKELLRKDKEILDRLAEEIKRRRTDEVREELERRIDESKKEVDEVVKENDRIVKESEERVKDLEKELEERLRRLKEKLKANRVDETVDRKIDELAERIRRLLEKVKRHVEETKRDVRRVSEEVRKHVEETKRDVRRRLK

SEQ ID NO: 20916 - protein, 177 aa, Artificial Sequence; identical to SEQ ID NO: 20915
  Synthetic sequence.

SEQ ID NO: 20917 - protein, 182 aa, Artificial Sequence
  Synthetic sequence.
SRVEDLVRRIRELVRRDLKRIKDLEEEIKRLAEEIERHSKKVVDELKELADRLRKMLEEGNLREEDIDRVRKEMERLLEENKRESDKLVRRLEELVKDSERHSARVVEELEKLVETIRSEGVEKEKVDDIRREVKRVVRESEEANKRVRKLVEDIVKRAEDSNRRVEELVRELVEDLKRAAK

SEQ ID NO: 20918 - protein, 182 aa, Artificial Sequence; identical to SEQ ID NO: 20917
  Synthetic sequence.

SEQ ID NO: 20919 - protein, 182 aa, Artificial Sequence
  Synthetic sequence.
SEVDELLKTIEKLARDDVKKIREVVEENKREVRRLEEHSKEVVKEIKDRIKEVLELLRRGELRRKDVKKVEEELEKLVRENKERSKEVVRRMRESNRRSEKHSRDLVRELRDRLREIAERGVEERVLERVERLVRRLAEESRRANEKSKEDTKRLEDRLKKSNDDLEKLVRDVVTRVREEAD

SEQ ID NO: 20920 - protein, 182 aa, Artificial Sequence; identical to SEQ ID NO: 20919
  Synthetic sequence.

SEQ ID NO: 20921 - protein, 182 aa, Artificial Sequence
  Synthetic sequence.
DEVKELEKRIRKLVREIEEHSKEVVKENRRLVEEDLETIKEVLREIKRRIKKLLELLERGELRREDVKRVEDELKKLLEDSKRHSEDVEKKLKESNDKNEKKSEEVVRELEDLVREIAERGVEKDVLKTIKDTVEELVERLKRSNERSREETKKLVKRSREANKRVEDLVRKVVKELREAEK

SEQ ID NO: 20922 - protein, 182 aa, Artificial Sequence; identical to SEQ ID NO: 20921
  Synthetic sequence.

SEQ ID NO: 20923 - protein, 182 aa, Artificial Sequence
  Synthetic sequence.
EEVERIVKEIRDLAEKDKEHSKRVEEEIRRLVEEVERHSRRVEEEIRRLAEELKRLLDRGELRDEEVRRVVKEIEDLVRRNKEETRKVVEDLKRLVEENKRHSDEVVRRLEKLVEDIKRKGLPEEKLEDLERKVRKLADESREVNDRLRELVERVVRRLEEVNERLERLVEELRRRLEEAKR

SEQ ID NO: 20924 - protein, 182 aa, Artificial Sequence; identical to SEQ ID NO: 20923
  Synthetic sequence.

SEQ ID NO: 20925 - protein, 182 aa, Artificial Sequence
  Synthetic sequence.
DEVEELVERIKRLVERDEREIKRVEDEIERLVRRVDEHSKRVEEEIRRLVTELMELLDRGELRDEKVKEVVKTAKELVDRNKRETDEVKKELDKLVEDIRKHSKDVVDELKDLLRRIKSRGVEERVVEKVRRLVDKLAERSRDLLRKLRDLVRRVVKRLEDVNRRLEELVRKLAEELKEKSR

SEQ ID NO: 20926 - protein, 182 aa, Artificial Sequence; identical to SEQ ID NO: 20925
  Synthetic sequence.

SEQ ID NO: 20927 - protein, 188 aa, Artificial Sequence
  Synthetic sequence.
SEIEKILDDIRREAEKDLRLSEKIVEDIKRLAERDIKRLREIVEEIEKLLREVSDELRKRKEKEELKKRVEEAEERLRRLVRELEEHSKKVVRDLEELVKKNHDHSRRLKEKMEELVKELRKEMDSEDAERLIREVEKLVRDLVRESEKSNEEVRKLVEDLVRESDKVLKDVKRLVDEVVRRAREEVK

SEQ ID NO: 20928 - protein, 188 aa, Artificial Sequence; identical to SEQ ID NO: 20927
  Synthetic sequence.

SEQ ID NO: 20929 - protein, 188 aa, Artificial Sequence
  Synthetic sequence.
SRIDEIVKRIEELARRDEEVSREIVKEIRDLAKRDEDTSKRIVEEIKELVKKIKEELERSKDKEKLARKVDELVRRLRELVKRNHDHSRRVVREMEKLVEENHKHSKDVVDTMRDLVRRLEEELDSEDAKRLLDKVRKTVEDLVRRSRKSNEDVRREVEKLVDRSRKSNTTVERLVRKVVRELRETVR

SEQ ID NO: 20930 - protein, 188 aa, Artificial Sequence; identical to SEQ ID NO: 20929
  Synthetic sequence.

SEQ ID NO: 20931 - protein, 188 aa, Artificial Sequence
  Synthetic sequence.
SRAEEIVERIKKLAEDDKRESDRIVEEIKKLARDIEEAIRRIVKEIRDLVKEVRDVLEREKDKEKLDRKVDDAVRKLEKLVRELKELVDRVVKTAEDLVRENHRHSKEVVETLERLVEELRKEATDERAKELVEEVERLVRELVKDSDRSNKEVRRTVKEIVERAEKLVRDVEEDVERLVRDLKRKVK

SEQ ID NO: 20932 - protein, 188 aa, Artificial Sequence; identical to SEQ ID NO: 20931
  Synthetic sequence.

SEQ ID NO: 20933 - protein, 188 aa, Artificial Sequence
  Synthetic sequence.
SEIEKILKEIEDLARRDEEVSKKIVEDIRRLAKEVEDTSRDIVRKIEELAKRVLDRLRKDRRKEELEKEVREVVKTLEELVKDNHRLIRRAVEEMKRLVEENHRHSREVVKELEDLVRKLRADSTSEDAERLVREVEDLVRRLVRRSEKSNEEVKRTVEELVRRMEESNDRVRDLVRRLVEELKRAVD

SEQ ID NO: 20934 - protein, 188 aa, Artificial Sequence; identical to SEQ ID NO: 20933
  Synthetic sequence.

SEQ ID NO: 20935 - protein, 180 aa, Artificial Sequence
  Synthetic sequence.
SEIEKLRKTVERIKEEVKRLSDEHKKRTRELERTSERLVEEHRERTEELRRRIEEIVRKKRDRSLEEIVKKLKELLDKLDKELEDSSRDTKRRLKRLDEDSDRSNKELAERLRRIAELIKAGKDIDTLVEEIKELMKEDSERIKKSVKEVDDLAKEDSDRIRDSVRTVKELADEAIRRAK

SEQ ID NO: 20936 - protein, 180 aa, Artificial Sequence; identical to SEQ ID NO: 20935
  Synthetic sequence.

SEQ ID NO: 20937 - protein, 180 aa, Artificial Sequence
  Synthetic sequence.
SEIERLEDRIRRLIRDSRELVKTLKKELKEIIERLEELSERLRREIERVVREVEDVVRKRRSDKIEDLVRRLKERLDRIIEESRDLNEKTKRELERVIREIERSSKESEDRAKKIEDLIRAGSDIDELLKKLDEIATRDREKIERLREEIRKIARKDEEDIRKLVKEIRDEVRKLKEDAR

SEQ ID NO: 20938 - protein, 180 aa, Artificial Sequence; identical to SEQ ID NO: 20937
  Synthetic sequence.

SEQ ID NO: 20939 - protein, 174 aa, Artificial Sequence
  Synthetic sequence.
SEVEELRELVKRLIERIKRVVETNERDLEELIKRVKDAVKKNKEDLERLIEEIDRKRVDERLIRELRKKLERLKEENERLVRDLKRAVDEVVKENRRLVDDLRRKLETVERVLDKGEPIKELLDELKRLIDEVEKKLRESNERVRRLAEEVLRRSKESNDRVRDEARKVKETAR

SEQ ID NO: 20940 - protein, 174 aa, Artificial Sequence; identical to SEQ ID NO: 20939
  Synthetic sequence.

SEQ ID NO: 20941 - protein, 174 aa, Artificial Sequence
  Synthetic sequence.
DEVEALKRTVEELIKRIRKAVEDNERDLERLLKESRDVVKKNEEDLKRLIEEIERIRVDEKLIRELREVVKKVKKENEDSVKESEEVVREVRKRNRELVRELETIVRRVERVVENGEPIEKLLRELERVIEEIVRRLEDSNRRVRDIARRDKERSKRSNDRVRRLAEEVKERAK

SEQ ID NO: 20942 - protein, 174 aa, Artificial Sequence; identical to SEQ ID NO: 20941
  Synthetic sequence.

SEQ ID NO: 20943 - protein, 174 aa, Artificial Sequence
  Synthetic sequence.
SEVEELKKLVEELRREIRRLVRENEEDLKKLLEESKRMVERLKELVKKLIEDIRRTRVPDELIRRLEEMAKEVERRLKKSVKESEDELRRVVEENRKLVRDLEKILEDVERVVENGEPIKELVDELKRVADEIVRRIRESNRKVRKIAEEDKTRIKRLLEELERLIADVERRAT

SEQ ID NO: 20944 - protein, 174 aa, Artificial Sequence; identical to SEQ ID NO: 20943
  Synthetic sequence.

SEQ ID NO: 20945 - protein, 178 aa, Artificial Sequence
  Synthetic sequence.
SEVERLLRELERSVTEVKERVRRLVEELERIVREVKKRVDEHKERNKRALEDVKRKVRDRKDVKEVVRELVERLRRIVEESDKNLRELLREVERLVEDVVRKVEELLKRNERLVEEIKKRGVREEVEKRARKTTEDIKRMADKVTKVAEEVLRRVEKVVEEVREVSRRVVEDIERDTR

SEQ ID NO: 20946 - protein, 178 aa, Artificial Sequence; identical to SEQ ID NO: 20945
  Synthetic sequence.

SEQ ID NO: 20947 - protein, 182 aa, Artificial Sequence
  Synthetic sequence.
KDVEKVIEDIERILTEVRRHSKEILDRIKRILETIREIVKEVKKRNEDLLREARESNVRSEEVRRIVEEIVRRARRSNEELRRIAEEIVRELDRLVKENHELIREVARRLEKLVEDLVRRRGRDKSVEDARRAVERVVREARRSNEEVKRAVEEVAKELERLVKESEDESRRIVEELKKTVD

SEQ ID NO: 20948 - protein, 182 aa, Artificial Sequence; identical to SEQ ID NO: 20947
  Synthetic sequence.

SEQ ID NO: 20949 - protein, 182 aa, Artificial Sequence
  Synthetic sequence.
DEVEEVIKRIRDILRRVEEHSEKILREIEKLLRDATRHSEEVKRRNEKILRDAENSRVRSKEAEDIVRRIVEEAKKSNEENHRLIRDLERRLRELVKENHDLIRRVEKELEELVEDLVRKKGNDEDVKRVRDEVKKVVERVRRSNKKVEDMVREVERRLRESNKESREDSKRIVEEMDRRVK

SEQ ID NO: 20950 - protein, 182 aa, Artificial Sequence; identical to SEQ ID NO: 20949
  Synthetic sequence.

SEQ ID NO: 20951 - protein, 178 aa, Artificial Sequence
  Synthetic sequence.
SEVEKIIDELRKVAEEHKRRVKELVDTNRKVLKEVKDRVRDLVRRVREILKDVSDKARRVTDRKTLEELLRRLKEMVDRVRETAERLLRELERISREHKKEAKRLLETNKRRVEEVKRRVREVDEIKEVLKESEEEVRRMLEELEKELRRSRKTVEELLRRLDKTLREVEEAVKRERD

SEQ ID NO: 20952 - protein, 178 aa, Artificial Sequence; identical to SEQ ID NO: 20951
  Synthetic sequence.

SEQ ID NO: 20953 - protein, 178 aa, Artificial Sequence
  Synthetic sequence.
DRVEELLKRVREILERVEREARRLVEEVEDVMRRHKEKLEELVRHNREVLREVSREARRTRDKETLKRLLDELRKLSKEHKDEAKRLLESNRRIVERVRERVERLLDELRKEVDKVRKAVREVEEVKKVLKEVEDTVRELVRRLEKKLKESIDTVERLLEELERVLRESNKTVEDETR

SEQ ID NO: 20954 - protein, 178 aa, Artificial Sequence; identical to SEQ ID NO: 20953
  Synthetic sequence.

SEQ ID NO: 20955 - protein, 178 aa, Artificial Sequence
  Synthetic sequence.
DEVRKILRELREALKRHVEEVKRLLEHNERVLKKVKEDVERLMEEVKRALEDVKRDVDRTRDKETLERLLRRLKTIVDRVRETAKELLDRVRKVSKEHEDALRRLKDTNREIVRRVAERLKDVKEVRKVLRESEKLIDDLLRELKRVLEETNRRVEDLLRRLEEVLRRVEKTVRDRAK

SEQ ID NO: 20956 - protein, 178 aa, Artificial Sequence; identical to SEQ ID NO: 20955
  Synthetic sequence.

SEQ ID NO: 20957 - protein, 176 aa, Artificial Sequence
  Synthetic sequence.
SLKERLEKVVEESLRRVEEVIKKLERRVEESERRVEELVKTLRDVLRKILRELEKEGGRELIEELRKALRRLDETVKKNLDENRELIEEVRRRLKKHLDDNKKVAEKLKEALKRNSSRETVERLLEEIRELLERSRKNVEDLERRIDKLLEDSERNARELLERIRKELRDISEKRK

SEQ ID NO: 20958 - protein, 176 aa, Artificial Sequence; identical to SEQ ID NO: 20957
  Synthetic sequence.

SEQ ID NO: 20959 - protein, 176 aa, Artificial Sequence
  Synthetic sequence.
SMKEEIDRVVREVAENVRDMIRRLKRVLEESLRRVDELVKEIKKVLDDVRRRIEEDGGDELIAELDKIAEEVKRNAEKHLERNKRLADEVRKELEKHRKENERLIRELKDRADKNSSEETVKRLVEKIRELNERSLDNVKKLLDRIRELLEESERNVKDIVRRIRDLLRRIKEKAT

SEQ ID NO: 20960 - protein, 176 aa, Artificial Sequence; identical to SEQ ID NO: 20959
  Synthetic sequence.

SEQ ID NO: 20961 - protein, 182 aa, Artificial Sequence
  Synthetic sequence.
DEVERVLEEIERMLREVEEHTRRVVEEVRRVLEEVKRHSERVVREIRRLLEELRKLVERGEITDEKLREVVKRLDDLVKENKRRSEEVVKRLRELVRRNKEKSRKLEEEAKKLVDDVRRSGAPKDLVRKVEEEVRRVKRELERLNKELEDEVRRIEEAAKRSNEELKKVVDEVKRELEKASK

SEQ ID NO: 20962 - protein, 182 aa, Artificial Sequence; identical to SEQ ID NO: 20961
  Synthetic sequence.

SEQ ID NO: 20963 - protein, 182 aa, Artificial Sequence
  Synthetic sequence.
DEVDEVLKEIRKVLEDVRKHSEEVLREIERVVREVKKHSRKVVEEIKEVVKRLEDLARRGEIRRKDVEDVVRKLRKKVRDNVETSRRVVEELKKLVKRNVEVVKRVVEEARRLVEEVDKGGVDKRLVDKVRKVVEEVERELKKSVDDVRRVVEEVERRLREVNKEVEDVVREVEERVRRAAT

SEQ ID NO: 20964 - protein, 182 aa, Artificial Sequence; identical to SEQ ID NO: 20963
  Synthetic sequence.

SEQ ID NO: 20965 - protein, 175 aa, Artificial Sequence
  Synthetic sequence.
DEEKEVEKVVRDVEDKLRRLLEENRDVSRKIKRELEELLKELKRSVDDSKEKLERKLREEDEVVKRVLKTSEDLVRELERLIREVEKDLEDSNRKVEDVVRDLKRRLKEIEKLVRDGADIKTVLEEIKKLAKEAEEEIKRTLERVKKLLEEVRRVVEELLRRNRTLLREIVRKAK

SEQ ID NO: 20966 - protein, 175 aa, Artificial Sequence; identical to SEQ ID NO: 20965
  Synthetic sequence.

SEQ ID NO: 20967 - protein, 175 aa, Artificial Sequence
  Synthetic sequence.
DEERELEEVVKDIERRSKKVVEDNRRVSEEIKRRLEKLLEENRKSAEDSKEMLRRELREKDEVVRRLLKESDDSNKEVKELIDDLTRRLDKSNEDLKRSVDETKEKLDRLLDLLRRGVDVKTIVTEVRDVVRRDKKKAEDTVRTVKELLDRARKKVEKTIRDNRKVLEEVVRKAR

SEQ ID NO: 20968 - protein, 175 aa, Artificial Sequence; identical to SEQ ID NO: 20967
  Synthetic sequence.

SEQ ID NO: 20969 - protein, 175 aa, Artificial Sequence
  Synthetic sequence.
SELERVEKVVREVKKALEDLLRRNKESVDRSRTEARRLLEELRESVRRSEEMVRRKLREKDEVVRDLLKKSRKLVEDLRELAERLKRKSEKSNEEVRRLVEKLTEELKDLLRLVEAGKDVEKVLKEIRDLLREAAERVERSIRRNKKVLDDLKEVVERLLKENERLLREIVEDAR

SEQ ID NO: 20970 - protein, 175 aa, Artificial Sequence; identical to SEQ ID NO: 20969
  Synthetic sequence.

SEQ ID NO: 20971 - protein, 175 aa, Artificial Sequence
  Synthetic sequence.
SAREKLRKVVEEIRRELKRLLEENKKVSDDIRRKLDELLKELEKSVKESIDTLRRDLREKTEVVERVERDSRRLIEELRKLVEDLDRRLKKSNDEVRKVVEELKRTLEELLKLLDDGVDVDTIVKELRELLKRAEEEVKKTSDRVADLVRRAEEVVKKLLRENEELLRRIVETAR

SEQ ID NO: 20972 - protein, 175 aa, Artificial Sequence; identical to SEQ ID NO: 20971
  Synthetic sequence.

SEQ ID NO: 20973 - protein, 175 aa, Artificial Sequence
  Synthetic sequence.
SEKEKVEKVVDEVRRRLEDLLRRNRESVRRSDEELKRLLKRNKEVSDEIRKRLRRELDKKDEVVRELEKRLEESNREVEKLIRDVVRKSEDSNRRVEKLVRDLLRRLEDILRLVEAGADVKTVLREIRELLKEAEERVKKSIKENEDLLDDVRRKVEESTERVERELERVSREAT

SEQ ID NO: 20974 - protein, 175 aa, Artificial Sequence; identical to SEQ ID NO: 20973
  Synthetic sequence.

SEQ ID NO: 20975 - protein, 175 aa, Artificial Sequence
  Synthetic sequence.
DEDREVEEVVKEVEERLRRLLKKNEDVSREIEKRLKELLEKNKRSVEKSEEMLRRKLREKSEEVKDLKDKSARSNEEVAEIVKDLKRRLEESNREVEELIRRVRKRLDELLKMVKAGKDVDRVLEEIRELLKRVKEEVERTSRDVKEVLRRAEEEAKRTDDENRKLLEEVVEKAR

SEQ ID NO: 20976 - protein, 175 aa, Artificial Sequence; identical to SEQ ID NO: 20975
  Synthetic sequence.

SEQ ID NO: 20977 - protein, 178 aa, Artificial Sequence
  Synthetic sequence.
DRSKEVVDRLEEELRKVKEDSKESVDRLRRLLEEVERRAEKSLRDSKEVLRRVKEEAERDRDEKTLRDLLRELKKDLERSDRELADLVRRLKEVVDRIRETNEKLIRDLKRRLEEVLDRNREVRELEKVVRDIIDRVRKMLETSEEVIREVLERVRKVLEENRRVNKDIIDKVEERVR

SEQ ID NO: 20978 - protein, 178 aa, Artificial Sequence; identical to SEQ ID NO: 20977
  Synthetic sequence.

SEQ ID NO: 20979 - protein, 184 aa, Artificial Sequence
  Synthetic sequence.
DEIERLIEEIKTVLDEIRKEAKRMIDENKRLLDEIRELSERVVEENRRLLEEIRDRAEKRRTEELAERVRRLLRRVEEENKRVARELRELLRKSEEDTRRLVTEVRDRLEKLRERVEELVRRKRVKELADELRKVLKDVRREIEKLVRDAEKSNEDSRREVERLVKRNRESLEEIRKRVEDLVK

SEQ ID NO: 20980 - protein, 184 aa, Artificial Sequence; identical to SEQ ID NO: 20979
  Synthetic sequence.

SEQ ID NO: 20981 - protein, 175 aa, Artificial Sequence
  Synthetic sequence.
SSKETLRKEVERLEKELKKLVDESRRVLEEVEREVRRAVRELEESVKKSAKRLRDRVRGEEILRRVEKKLKESEELVRRATETLKEVLKRLRESSKEVADRLKEVVERLRREVDKGGDDVEKLIRRVEELLERVRELVKKNIREIEELLERLRRLVEKVIEDDKRMLKEVEEEAN

SEQ ID NO: 20982 - protein, 175 aa, Artificial Sequence; identical to SEQ ID NO: 20981
  Synthetic sequence.

SEQ ID NO: 20983 - protein, 185 aa, Artificial Sequence
  Synthetic sequence.
REVEELIKRIERLLDEAREHSKEVIRRDEELLRRVRKIIEEIIREIERLLREAEDIARKRGGSDEEVLRRLEEIVRRLRELVERVKRELEKIVEESRRLVEKNEDLSRKLVETLKDLVRRLSRDVSEELLKRIEDVVRRVVEDLKRLNEEIRRSSEETEKELRRLLEEIRKVVEDVERRVRELVK

SEQ ID NO: 20984 - protein, 185 aa, Artificial Sequence; identical to SEQ ID NO: 20983
  Synthetic sequence.

SEQ ID NO: 20985 - protein, 185 aa, Artificial Sequence
  Synthetic sequence.
DEVREVIKAIRKMLEEAEKHSRDVIRADKELLDKIARHSEEVIKEIRRLLRELEKIAKDKGGESRELEELAKEVVERLKKLVEENVRLSRRIVETSRRLVRENKELSREIVERLEKLLRDLAKTVSEDLLRRIEEEVRRVVEALEKLNRDIEESSRRTEDTARKLNERIREVVEEVMRRVRKLVE

SEQ ID NO: 20986 - protein, 185 aa, Artificial Sequence; identical to SEQ ID NO: 20985
  Synthetic sequence.

SEQ ID NO: 20987 - protein, 185 aa, Artificial Sequence
  Synthetic sequence.
SEVERVIEEIRKLLEDAKRHSDEVIKTDEDILRKVKKHSEEVIREIEKLLEEIEELARRRGGRDKEVVERLREVVRRAEELVKDNKRRSERVVEESRELVERNRRRSEKLVRRLEELVRRLSRDVDEELLRRLEKLVEDVMRTLKKLNDEIRKSVDETEKTLEELNRRIRKTVEEVRKTAEDLVR

SEQ ID NO: 20988 - protein, 185 aa, Artificial Sequence; identical to SEQ ID NO: 20987
  Synthetic sequence.

SEQ ID NO: 20989 - protein, 185 aa, Artificial Sequence
  Synthetic sequence.
DEVREVIRRIEKLLEDVKRHSERVIREDRKLLRDAERRAKEVIDEIRRVLEEAKEIVRREGGESKKVKDELEKVVRDLRKLVEDLKREVTEIVKKSDELVKENTRESDRVVKELRELVRRLSRDVSEELLKTITDVVRKVEETLKKLNDEIRKSVEDTMRALKKLVDDLRRVVKEVEDRVREEAR

SEQ ID NO: 20990 - protein, 185 aa, Artificial Sequence; identical to SEQ ID NO: 20989
  Synthetic sequence.

SEQ ID NO: 20991 - protein, 185 aa, Artificial Sequence
  Synthetic sequence.
DVVREVIKTIKKILDEVRDHTRRSIERNEKLLRDIRKIVEDSIRRNRKLLDDAKKVAERDLSDKESLKRKVDEVIKELKDTLDELRKIAEDVIRELEKTLKENHELIREVIERLKELVARLRSQVDEEMVKTLKKVVEDVERELRRLNKEDEDTVREIAEAAERLVRDDERTVREIEEALKELVR

SEQ ID NO: 20992 - protein, 185 aa, Artificial Sequence; identical to SEQ ID NO: 20991
  Synthetic sequence.

SEQ ID NO: 20993 - protein, 185 aa, Artificial Sequence
  Synthetic sequence.
DVIRDVEKKIRDILERVREHTKKSIKENRDILDDVRRHTEKSIKENEDILDEVRRVAERDLKDKKTLTDVVRRIERELEKTLERDHRRIREVEKRLEETLRENHELIRDVIRRLKDLVDKLRSQVPEEMVKRAKDVVDDVARRLEELNREDKKTVEEIVETAKELNERDKETVERIRKKLEDLVK

SEQ ID NO: 20994 - protein, 185 aa, Artificial Sequence; identical to SEQ ID NO: 20993
  Synthetic sequence.

SEQ ID NO: 20995 - protein, 185 aa, Artificial Sequence
  Synthetic sequence.
DAVRKVIEDIKRALEEVRRHTKESIKRNEDILREVEKIARDIIREIRRILERVREVVERDLKDKDTLRKAVEDVIKRLEEILKELEDIVRDVIRRLEKTLKENHDLIREVIKRLEDLVRDLRRKVPEEAVETLKRVVDDVAKKAKELNREDEETVRKIVEELKRLLDELRREVERVADEARRAVK

SEQ ID NO: 20996 - protein, 185 aa, Artificial Sequence; identical to SEQ ID NO: 20995
  Synthetic sequence.

SEQ ID NO: 20997 - protein, 185 aa, Artificial Sequence
  Synthetic sequence.
SVAEEVIRRIEEILKRVEEHTRESIERNKKLLEEVRKHTEDVIRRIRELLERLERVVRRDLKDKETLRDTARRVVEELEKILEEDHRLVRRVEEELRKTLEDNHRLIREIEERLRRLVEDLKRKVPEEMVKRVKDVVDDVVRRLKDLNETDRRTVDEIVKEARRLNDELRKVVEEVEEKARRDVK

SEQ ID NO: 20998 - protein, 185 aa, Artificial Sequence; identical to SEQ ID NO: 20997
  Synthetic sequence.

SEQ ID NO: 20999 - protein, 183 aa, Artificial Sequence
  Synthetic sequence.
DEVREIIERIKKLLDDIRKVAEESIRRNEKLLEEVRKRVRESIEELKRIKEEVEKLAREGQPKEELKRIVDEIAKRADESNETLKRIVDKLRKDSKKSNEDVKKIIEELKKRLDDLLRDVRRVPEDVVRTIEEVVRRVEKELRRLLEENERVIREIERELKKLVDDNKRVSDEIKDRAERLVD

SEQ ID NO: 21000 - protein, 183 aa, Artificial Sequence; identical to SEQ ID NO: 20999
  Synthetic sequence.

SEQ ID NO: 21001 - protein, 183 aa, Artificial Sequence
  Synthetic sequence.
SEVEDIIRKIEESARRSEKVVRDSIRENRRLLEEVKREVDRSIERLEDIIRKVEEVARRGEPEEELRRIVEEVKRELEKSNKELREIVKELRERSRRSNEEVERIVRENAKRLDELLRDIRRVEERAVDTIRRVVEKSKTVSKKVLDENREVVREVDERVRELVRKNEDVSRKIEERARRLLK

SEQ ID NO: 21002 - protein, 183 aa, Artificial Sequence; identical to SEQ ID NO: 21001
  Synthetic sequence.

SEQ ID NO: 21003 - protein, 177 aa, Artificial Sequence
  Synthetic sequence.
DEEEEVERVVKEAEETIRELLERDKRVVKRLREEADRVLDEVREEVKRSEETAEDLRRKGLDERLVDRLRKLSEDHKRKVEELKRRLDEVLRRVEEESKRLLEELREILERVRRLVRRGDPGEKLIKELEDVLRELEERSRKTLEELKDVLRKVKETIDELIRTNRRELEKLERDTR

SEQ ID NO: 21004 - protein, 177 aa, Artificial Sequence; identical to SEQ ID NO: 21003
  Synthetic sequence.

SEQ ID NO: 21005 - protein, 177 aa, Artificial Sequence
  Synthetic sequence.
SEEEEVAKVVEDVRRRLEELKRAVEEVIRRTDEEAKRLLEADRRVVERVREEVKRLVEAGLDERLARTIEEILKEVLRRSEKLLEDLRRVNEKSDRDVDRLREEVEDILRRLRELVRKGEPGKELIKRLRDELKRLEDDARRILERNKKILEDVERESRRTLKELKDVLKELEERAR

SEQ ID NO: 21006 - protein, 177 aa, Artificial Sequence; identical to SEQ ID NO: 21005
  Synthetic sequence.

SEQ ID NO: 21007 - protein, 184 aa, Artificial Sequence
  Synthetic sequence.
SLVEELERVVKDVEREARKLNEHNRENSKRVEDRLRELNEHLRKNTEEVKRRLEELIRKKKDSEELLRLAEKLLTESEKLVRDMERENKKSIEDSRRLVKRVVEENKRVLDEARKLVEELKRLTDEDAIREVLRRIERLLEEVKKKNEETSKRSKELLEENAKRNKEVSDRSKRLLEEIKRRAD

SEQ ID NO: 21008 - protein, 184 aa, Artificial Sequence; identical to SEQ ID NO: 21007
  Synthetic sequence.

SEQ ID NO: 21009 - protein, 184 aa, Artificial Sequence
  Synthetic sequence.
SLTERLREVVRRVEEELKELIRHLRENSERVRKTLEELNRHLKENVEDVKRKLEDLIRKKKDARELERLLRRIIETSEELVRRVVERNKKSIEESERLVRDAMRKLEKLIDEIRKLVEEVSRLTDKDAVERVIEEIERLLDEVKKTVEELSKTSKKLLDENKKENEDVSRKSEELLKKIADEVK

SEQ ID NO: 21010 - protein, 184 aa, Artificial Sequence; identical to SEQ ID NO: 21009
  Synthetic sequence.

SEQ ID NO: 21011 - protein, 184 aa, Artificial Sequence
  Synthetic sequence.
SLKERLEEVVRRVRKELKKLIEHLERNVEEVRKTLEELNRHLDENVKRVKDTLTRLIEEKRDKKDLVEKLERALEDSKRKVDKLREENRESIRRSKKLVDDAKKKLDDVIRRIKELLERASRLRKKDEFERVLKRIKEVLDEVKREVEELSKESEDLLRKNEERNKRASDRSEDLLKKIAEEVK

SEQ ID NO: 21012 - protein, 184 aa, Artificial Sequence; identical to SEQ ID NO: 21011
  Synthetic sequence.

SEQ ID NO: 21013 - protein, 184 aa, Artificial Sequence
  Synthetic sequence.
SLLEELEKVVEEVKRSLDEVNKRNKKNTDDVAKTLTDLNEHLERNVRKVEEDAKDLVRKKKDSDELRERLEDIIRRSKELVDELRKLNTDSIERSERLVREAVKRNERAIERIKKLVDDASRLDKEKLAKDVLREIRRVLEEVKRDNDRTSKESKDLLDENKKRNEEVSEESERLLRDIARKVD

SEQ ID NO: 21014 - protein, 184 aa, Artificial Sequence; identical to SEQ ID NO: 21013
  Synthetic sequence.

SEQ ID NO: 21015 - protein, 184 aa, Artificial Sequence
  Synthetic sequence.
DLLEELKDVVDKVRRTLERLNEENRKNVEDVKRRLDDLNRKLEDNVRRVEERARELIKRKKDAEELREELERVIKTSKDLVDKLRRENEKSIEDSDRLVKKVERDNERVITRIEELLRRLARLTDEKAVRDVLKEIEELLRKVTKENKDTSDESRRLVKTNEDLNREASKRSEDLLARVEEKVR

SEQ ID NO: 21016 - protein, 184 aa, Artificial Sequence; identical to SEQ ID NO: 21015
  Synthetic sequence.

SEQ ID NO: 21017 - protein, 184 aa, Artificial Sequence
  Synthetic sequence.
SLTERLAEVVKRAEDLLRKLNEENKKNVEDVERTLRKLNKDLKDSVDRSRREAEKLIRRKKDSKDLARKLKKVVEDSKELVDRLMEENKRSIERSRDLVRRVKETNEEVLREIRRLLEELSRLTDKDAIEKVLEDIERVLREVEKRNRETSRDSERLLRRNEEENRKALERDEKVLKEVADEVE

SEQ ID NO: 21018 - protein, 184 aa, Artificial Sequence; identical to SEQ ID NO: 21017
  Synthetic sequence.

SEQ ID NO: 21019 - protein, 184 aa, Artificial Sequence
  Synthetic sequence.
SLEEALEKIVREVKETLERLNKENRDSVRETADTLRKLNEELRRNVKRVEEALRDLIREKKEKEELKDKVRELLRRSRELVEEVVKENKKSIEESKRLVDEAEKINRDLIRRIKELLDRASRLRKEEEAKRVLRKIEEDLKRVADINRKTIERDKKLLEDNERKNRKVSEESRELLEKIAKDVK

SEQ ID NO: 21020 - protein, 184 aa, Artificial Sequence; identical to SEQ ID NO: 21019
  Synthetic sequence.

SEQ ID NO: 21021 - protein, 185 aa, Artificial Sequence
  Synthetic sequence.
KEVEEIIEEIKDRLRRLEETVERLLRENREMLRRTREEVKEIIKRIRDLLRELKKIAEKDRRKEELERLARELEERLKRLVDELRRSLEKHDRESEESVKRLEELARRLLEDLDRLVKDLRRKGIDKKLVEDVDKVVKEVEDRVRRLIEALKKVSEDLHRENKKLIEELEEVVKEVKERARELTR

SEQ ID NO: 21022 - protein, 185 aa, Artificial Sequence; identical to SEQ ID NO: 21021
  Synthetic sequence.

SEQ ID NO: 21023 - protein, 185 aa, Artificial Sequence
  Synthetic sequence.
DEVKEIIKRIEDLLEDLKRKVERILREDERSLEESRKKVEEILKEIEDVLRKLKKDVEEDRDKDRLREEAKRLLEKLEKLVRDLKREVDENVKRSEKLVREAEELAERLVKELEELVRDLERKGVDESAIKELRDVVREVKKRAKELIERLRESVERSRETNERLIRELEDVVRRVEETVRRLIK

SEQ ID NO: 21024 - protein, 185 aa, Artificial Sequence; identical to SEQ ID NO: 21023
  Synthetic sequence.

SEQ ID NO: 21025 - protein, 178 aa, Artificial Sequence
  Synthetic sequence.
KKEEKIKRSVERSKEENERLIEELERSIRDTARRAEKLIERLEKVVREVDKRLRELREEGRLRDEEVDRLKKELDRLLRTVKELVKELKRRSTELLRRLEEIVRENEKISRDILKLLRDGKDVETVLREDEDTLRRSEEKVDKLIKDDRRLLEELEDKVRELLRTVKELLKRTEERVT

SEQ ID NO: 21026 - protein, 178 aa, Artificial Sequence; identical to SEQ ID NO: 21025
  Synthetic sequence.

SEQ ID NO: 21027 - protein, 178 aa, Artificial Sequence
  Synthetic sequence.
SSEERLKESIDRSKKRNKEAIEELEKSIRETEKTLEELIKTTRKSIEDVRKRLEDLERKGELDRKMVETLRKRLEDILRRNKTLVDRVKERSEKLLRDLRKIVKENEDRSREILKLVRDGSDIDTLIEEDKETLRRSDEEVRRLIDEDRRLLEEVEKRARESNKEIRDLLRRVEEEAR

SEQ ID NO: 21028 - protein, 178 aa, Artificial Sequence; identical to SEQ ID NO: 21027
  Synthetic sequence.

SEQ ID NO: 21029 - protein, 178 aa, Artificial Sequence
  Synthetic sequence.
SEEDELRESVKDSERRLRRLIEEDKRVVEEVEEENKRLIDKVREVIKRIEDRLDELRRRGELSEDSVRRLKELLKDILRKVEEIVERNVRRLREMLKESKRLVDRLKEESEEILKLVRAGKDVKEAIRRDRELLKRAEEESRRTLEEMRTSLEESKRRVEELIKTLKRLLDEAEKEAK

SEQ ID NO: 21030 - protein, 178 aa, Artificial Sequence; identical to SEQ ID NO: 21029
  Synthetic sequence.

SEQ ID NO: 21031 - protein, 178 aa, Artificial Sequence
  Synthetic sequence.
SSEEKVEESIRRSKKRLEELIRDVERVVRKVEEDNRRLEEKLRKSIEDTRRKLEELKRRGELDDELVRRVKEESDRLLDELRDIVRRNVERARRLLEELERLVEDLKRKSEKILELVRRGKDFETLIRDDKRLLRKVEEDAKRLIKEIRDSLRESEKRVEELIDRDRRLAKEVEDRAR

SEQ ID NO: 21032 - protein, 178 aa, Artificial Sequence; identical to SEQ ID NO: 21031
  Synthetic sequence.

SEQ ID NO: 21033 - protein, 178 aa, Artificial Sequence
  Synthetic sequence.
SSEERLRESIKRSKKRLEELIREVRKRIEEIRRKNEELIREVEEVIRRIREELKRLRDEGKLDDKTVKDLKEKLDRILEEVKRIVDENEKTARELLKRVEEIVRELEKRSKEILKMVRDGKDIDELIKEDERLLREVEKKVKEIIKRLDDSLRDSERRAKELIRELEELLREAEERAK

SEQ ID NO: 21034 - protein, 178 aa, Artificial Sequence; identical to SEQ ID NO: 21033
  Synthetic sequence.

SEQ ID NO: 21035 - protein, 178 aa, Artificial Sequence
  Synthetic sequence.
SSEDRLRKSIEDSRKRNEELTRALETVIREIRKRNARLIEEVKKVVEEVKRELERLREEGLLSDELVETVLREAERLLEELRKIVEDNVRTADKVLEDLKRIVRRNEEESKKIEELVKAGKDIDTLIKRDRETLKESEDRVRKLLEDLRRSLRESEKEARRLIEEIRTLLEKVAREAT

SEQ ID NO: 21036 - protein, 178 aa, Artificial Sequence; identical to SEQ ID NO: 21035
  Synthetic sequence.

SEQ ID NO: 21037 - protein, 175 aa, Artificial Sequence
  Synthetic sequence.
SEVEDVLRRIRELLEEVRELVERNLKEIKRLADEIERLAKENLERSRRLAEELRDGNLDEKAAKDVVDDSKRHSREVVETVKKIAEESKRHSDEVVKTLKDIVREIKREVEEKVRGEDAVERVERILRDADEKIKELARESERLNRELDELIKRLVDESRELNRELEEIVRERAR

SEQ ID NO: 21038 - protein, 175 aa, Artificial Sequence; identical to SEQ ID NO: 21037
  Synthetic sequence.

SEQ ID NO: 21039 - protein, 175 aa, Artificial Sequence
  Synthetic sequence.
REVEEVLKKIEDLARELTKKVRKNLEDIKKLAEEIRELAERVLRTSRELIKELRDGNLRDEELKRIVDRSRELSKEVVERVERIVEESEKHSKDVVDEMKEIVDRVRKEVEDRVRGRELLEEVRKILEEMRRRVDELVRRSEELNRKLRELVERLVKELEDLNDEAKKIVDDRAR

SEQ ID NO: 21040 - protein, 175 aa, Artificial Sequence; identical to SEQ ID NO: 21039
  Synthetic sequence.

SEQ ID NO: 21041 - protein, 175 aa, Artificial Sequence
  Synthetic sequence.
REVEEILKKIRTLLEEVKRRVEKNLEDIRKLLKELEDRVRRDLDEIRRLAEELRDGNLPEEDVRRVVEESKKHSRDVVETMKKIVTESEDHSRKVAEELKKIVKEIKEEADDKVRGEKLLAEVRKVLKEAEDKIRELVERSKTINTEVKKEVDRLVEESKKLNKELEDEVDRRAK

SEQ ID NO: 21042 - protein, 175 aa, Artificial Sequence; identical to SEQ ID NO: 21041
  Synthetic sequence.

SEQ ID NO: 21043 - protein, 175 aa, Artificial Sequence
  Synthetic sequence.
REVEEVLKKIRELIETLEELVRDDLRRIEELLRRIEDKVRENLRRIREVIKELRDGNLPEEELRRVVEDTKRHSREVVEEAKKILEDIRRHSERVAREMKKIVDDIRKKVEKDVRGEDLLKRVKELLDDIRRKVDELIDRSRRLLEDLRRRVKELAEESKKLNEEAEKIVEDRAR

SEQ ID NO: 21044 - protein, 175 aa, Artificial Sequence; identical to SEQ ID NO: 21043
  Synthetic sequence.

SEQ ID NO: 21045 - protein, 175 aa, Artificial Sequence
  Synthetic sequence.
KEVEEVLKEIKDIAEEIRELAERDLKRDKELVDEAEDLVRRNLEDIRRVIEELRDGNLSEEELRRVVEETKKHSDEVRKELEDIVRRSKEHSRRVAERVKRLVEEVKKRVEDRVRGEELLRRVEKLLEDLKRTVDEMVKRSEDSLRRSEETVRELEERSRRLNDEIRRIVDERAR

SEQ ID NO: 21046 - protein, 175 aa, Artificial Sequence; identical to SEQ ID NO: 21045
  Synthetic sequence.

SEQ ID NO: 21047 - protein, 179 aa, Artificial Sequence
  Synthetic sequence.
SEVDKVVKEIKEKLDEIRKEVEKVVREDERLLEEIERLARKVVRENKELLKDIRREGREDTEKAREMLERSERKVRELIKEAKKILEESRELVKRLTEKAREVLKEIRDEVKKLEDRTDDETVARKLEEVVREVEEEVRRLEEKLKRSVEETEREIRRVVKELEDSVRETEREVRRLSK

SEQ ID NO: 21048 - protein, 179 aa, Artificial Sequence; identical to SEQ ID NO: 21047
  Synthetic sequence.

SEQ ID NO: 21049 - protein, 185 aa, Artificial Sequence
  Synthetic sequence.
DDVEKLVRDIERLVEKVTRDNKKTVDDDKTLVDEARKENEETVERIKRELEELEKRVRKDRRREALKKELEELEKRIREILKTLHDRNREIIKRSEDLLKELHERNRRAIEEVRRLLDELRRNGVSEEATRKLEKVLRDLEEELKRVDRENEKSLRESRKIVEDLDRTNKRVVDELRRIVEELRK

SEQ ID NO: 21050 - protein, 185 aa, Artificial Sequence; identical to SEQ ID NO: 21049
  Synthetic sequence.

SEQ ID NO: 21051 - protein, 182 aa, Artificial Sequence
  Synthetic sequence.
DEIDDVLRKIEDLVRKLRELVKKVLEDSKRLLEEIKRLAKEALERSEELVRRVEELARRGDIDEKELREVLETSKRLSEEVRKRAEELLKESRDLSEELRKRLEDVVREIRKLVKDVADKTTIEEVIRKLEEAVKRAEELVKRIEEELRKVDEEVERLVREIEKELREVNDRLRRLIEEIAR

SEQ ID NO: 21052 - protein, 182 aa, Artificial Sequence; identical to SEQ ID NO: 21051
  Synthetic sequence.

SEQ ID NO: 21053 - protein, 185 aa, Artificial Sequence
  Synthetic sequence.
REIEEALKEIEKIIEDLRKIVEEVLKRLEEIDRELRKRNEDSNREIEKIIEDLKDMVRKKGPDEELKKLVEDIKKKVTDILRRNEKVVEESERLSKELLDDLERVVKKIEEDIKRILDRVREAGLSEEAERRAETVLRKLERVVDKVIKDIRKVLKDNERVVREVRKSAEELLDKLRKVVEEVRR

SEQ ID NO: 21054 - protein, 185 aa, Artificial Sequence; identical to SEQ ID NO: 21053
  Synthetic sequence.

SEQ ID NO: 21055 - protein, 185 aa, Artificial Sequence
  Synthetic sequence.
REIEDVLRRIEEIIRELEERNKKSNKEIAEIDKELRDRNRKSNEEIEKIIEDLKEAVERKGTNEELEKLIDEARKRLEEILRRNDTVVDESRKRSKDILDRNRELVREIEERLDRILKRVREAGLSEEAEKRIRDVLDKLREVVERVIRSIEDMLRRNEKVVREVKESIERALKRLEETVKRVRD

SEQ ID NO: 21056 - protein, 185 aa, Artificial Sequence; identical to SEQ ID NO: 21055
  Synthetic sequence.

SEQ ID NO: 21057 - protein, 185 aa, Artificial Sequence
  Synthetic sequence.
DEIEKMLRDIEEIIKRLRKIVEEVRDTLRRIDEDLRRRNEESNRRLEKIIEDLERVARRDGPDERLRKLIKEARETVERLLEENRRRVAKSRETSKKLLDELRRVVEEIEKRLEEILKKVKDDGLDKKAEDEIRKALRKLKEVVKKVLKEIAEMVERNDRELRRLEKSIRESLDKLRETVKRLED

SEQ ID NO: 21058 - protein, 185 aa, Artificial Sequence; identical to SEQ ID NO: 21057
  Synthetic sequence.

SEQ ID NO: 21059 - protein, 174 aa, Artificial Sequence
  Synthetic sequence.
DLVEEIRKTIEKIVREIRKVLDEVRKHTEDVIRDIRRVLKEVERHSREVVKRIRDERGTEKARDLVRRNKEKSERVVRRARELVKRNEERSREVVKDLRRLVKEIKDLAKKLVDDGIDKDELRKLVETLEKVVREVEEELRRLNEELEKVVREVEKRARESNDRLEKVVREVER

SEQ ID NO: 21060 - protein, 174 aa, Artificial Sequence; identical to SEQ ID NO: 21059
  Synthetic sequence.

SEQ ID NO: 21061 - protein, 186 aa, Artificial Sequence
  Synthetic sequence.
SEVDEVVKEIRKLVEDDEREVEKAIRDIRRSNEELRERVERLLEELERLIKEVEETVRRMEGKEEIDKLLRELEKRARDVLRELEELLKEDEKRVKEVLDRIKKVNEDTKKRVEELLREIVRRRGEDVEAVEKARKILEEVEKVVTDTEKKLDDIRKHVKEVVDRLRKEIEDVLKRVRDVAERERR

SEQ ID NO: 21062 - protein, 186 aa, Artificial Sequence; identical to SEQ ID NO: 21061
  Synthetic sequence.

SEQ ID NO: 21063 - protein, 182 aa, Artificial Sequence
  Synthetic sequence.
KVEELLKELLDRVKEVVDRIRRELEKALEESRRVVREVEERVKTANREVRKVVDDVRKRSDEKRLDDILKRVEEESRRSVEELRKRLRKVIEENRKLVEDLERKLERVIREVERLLEELRNVDEEDVRRVLEEIARLVRELEKMVRDVVKTSRDTVRKLREDVKKVVDENRKLAEKLKRDAD

SEQ ID NO: 21064 - protein, 182 aa, Artificial Sequence; identical to SEQ ID NO: 21063
  Synthetic sequence.

SEQ ID NO: 21065 - protein, 182 aa, Artificial Sequence
  Synthetic sequence.
RIRETLTKLLEDVKEVVRETDELLKRLNRRVREVVRETEERLEDLNREVRKVVRDIERETDDERLRKLLERVIRESERSVEDVRRHSEEVIRRSEKSVEDLKRHSERVIRTAKELVDRLQNVDEETVKDIVRKVKRLLEENRKLAEKITRDNEELLKENKEMLDEVRRRNTELLKRLREEAK

SEQ ID NO: 21066 - protein, 182 aa, Artificial Sequence; identical to SEQ ID NO: 21065
  Synthetic sequence.

SEQ ID NO: 21067 - protein, 182 aa, Artificial Sequence
  Synthetic sequence.
RIEEDATRLIKEVKDVVKETEERARKVNKEVRDVVRDVERRLKELNEEVERVIRDVKRRSDEKELDDLLKEVNKRSKKSVDDLKERLEDVIRASEKSLRELEKHSREVLKTVKELLDRLKDVDEKIADDVAKEIEDLVRRNREVVTEIEKKNRELVRRLRDMVRKVEEDNKRLLEELKKATD

SEQ ID NO: 21068 - protein, 182 aa, Artificial Sequence; identical to SEQ ID NO: 21067
  Synthetic sequence.

SEQ ID NO: 21069 - protein, 178 aa, Artificial Sequence
  Synthetic sequence.
SVRELVEEARKHSRKVAEESRKLVEDLTEESKRVIDESREKVERLREEIERVLREVKKEGRVDDKIVEKLRRTAEELRKRVKESNDRNREELEKLREKVEDSNRKNKKTLDELTKKIEDGEPIERVLEEVEESDKRDEERVRKLEREIRESNKRDKEIVDRLLDELRRIVEELRERAR

SEQ ID NO: 21070 - protein, 178 aa, Artificial Sequence; identical to SEQ ID NO: 21069
  Synthetic sequence.

SEQ ID NO: 21071 - protein, 178 aa, Artificial Sequence
  Synthetic sequence.
SVDEAVDELLKNSEEVIKDTERKARELLRHSREVNKRSERESERLKEEIERVLRKLKRDNKVDDKILEDLRKKLEDLERENRDSVRKNEETVARLLREVEKSNEDNRRTLKELKDLVRNGEPIEELVERIKDSNRRDKEIIKDLERKIRESDKRHKERVDDLARRVEEIVKELEEAAR

SEQ ID NO: 21072 - protein, 178 aa, Artificial Sequence; identical to SEQ ID NO: 21071
  Synthetic sequence.

SEQ ID NO: 21073 - protein, 175 aa, Artificial Sequence
  Synthetic sequence.
SEVKKVEKEAEDISRRSRELLEKIREEVERLSRRSEELLKDVERKVRKVIKEIEDKRSSEEAKELVDRIDETLKRLLEESRRLVKEAEDRLREVVKESEDLVREMERRLERLREEGSVDEETVRELIRDLRRNTKRVKEEADEMIRHLRENTERVEKRLRELREELKKVVERVRK

SEQ ID NO: 21074 - protein, 175 aa, Artificial Sequence; identical to SEQ ID NO: 21073
  Synthetic sequence.

SEQ ID NO: 21075 - protein, 175 aa, Artificial Sequence
  Synthetic sequence.
EMVDRATEKVRTLSDESRRLLKKVRDENRKTSERSKRLLDEIERRVKEVLKRIRTERSDEDARRLVDEVRKDLERIIEESERLVREVEDRNRRAIERSRKLVKDIERDLRRLVAEGSVDKDRVKRLIEELKENTERVEKSLRDLDRHNRRNTEEVKRSADELIEELKRVVDEVKK

SEQ ID NO: 21076 - protein, 175 aa, Artificial Sequence; identical to SEQ ID NO: 21075
  Synthetic sequence.

SEQ ID NO: 21077 - protein, 175 aa, Artificial Sequence
  Synthetic sequence.
DKADEIEETVRRVSETSERLVEEVRKDNERTSKRSDDLLKDIEDKVRKVLERMRRERLDEEARKLVEEVVRRLEELLKTSKKLVEELREKNRRLIETSKRLVEKVEKELKDARDEGSVDEEKVRRLIKELRDNTKKVAEELKKLDDHNERNVEEVKKRLEELIRRLEKVVEDVKR

SEQ ID NO: 21078 - protein, 175 aa, Artificial Sequence; identical to SEQ ID NO: 21077
  Synthetic sequence.

SEQ ID NO: 21079 - protein, 175 aa, Artificial Sequence
  Synthetic sequence.
DFVKKAKDDVKEVSKESEKLLREIEEEVRRVSKRSRELLETVRRRVEKVLRDMERERKDEKAEELVRRVEEDLKRVLKESEDLVREVEKRLREALERSRKLVEEVREELRRLVEEGSVDEDRVRELIKELEENTRRVEEKLRKLIEDLKRNVREVEERARRLIEELREVVERVKT

SEQ ID NO: 21080 - protein, 175 aa, Artificial Sequence; identical to SEQ ID NO: 21079
  Synthetic sequence.

SEQ ID NO: 21081 - protein, 186 aa, Artificial Sequence
  Synthetic sequence.
SDLERLKREAEELIERDKRLLRRVEEESRRTLEEDRRSLKESEDRARELIRRIEELAKKIKDKRELEERLRRLLRTLEEIVERNARLSRKLLEDSKKLVKELRELSERLLRTLERLVRELIRKKDKSDEMRDAARRLIEEITRSVEESERELKRLIEEDKRSVERSKKENDKLIEEVRRVVERVTK

SEQ ID NO: 21082 - protein, 186 aa, Artificial Sequence; identical to SEQ ID NO: 21081
  Synthetic sequence.

SEQ ID NO: 21083 - protein, 175 aa, Artificial Sequence
  Synthetic sequence.
DVEEVLRKLKKEVEEVIRRTEAEVAKVLKEVEKVVTETREEVRRVLEEVKRVVDDVRRRNRADDRLLKEALKRVRDLLRRVEEVSRKHRDDVRRLMEEVKEVSERTRRAIDEIEKKVRDVEEVRKTVEKLIDDNRRMLEEVVKRAKELIEHNRRVVDKVLKEAKKIVRDLEETVR

SEQ ID NO: 21084 - protein, 175 aa, Artificial Sequence; identical to SEQ ID NO: 21083
  Synthetic sequence.

SEQ ID NO: 21085 - protein, 175 aa, Artificial Sequence
  Synthetic sequence.
SVEEVLKKLLEEVRRVAEETRRRAEKLLDDDRKVAEESKKRAEELLKEVKDRVDDVRRRNTLDDRILKDILRKVAELVKELEEISKRSLDESKRLVEEVEKVSRETEERVRDIARRVKDMEKVARTIKKLIKENRKFLEEVEKRSRETLKTNKKVLRDLEKRAKKIIEDLERTLR

SEQ ID NO: 21086 - protein, 175 aa, Artificial Sequence; identical to SEQ ID NO: 21085
  Synthetic sequence.

SEQ ID NO: 21087 - protein, 176 aa, Artificial Sequence
  Synthetic sequence.
KIEELMKRLEDEAKRSLDESEKKLEELRRDSERSVREVEELLKELLDRARRVLEKLGDSEEARKVLERVRKLVTEVREHSERVSRENERLVKENRDHSRRLLERVRELVERVSRLTDEEEVKRVAREVEELIERNRRHSDRIAEEVKETLERNREKVRRVLEKLKKELEDVLEKRK

SEQ ID NO: 21088 - protein, 176 aa, Artificial Sequence; identical to SEQ ID NO: 21087
  Synthetic sequence.

SEQ ID NO: 21089 - protein, 176 aa, Artificial Sequence
  Synthetic sequence.
DIEELARRLEEAVKDSLRRVEEKLRRLEDESRRSVEDSDRKLKELIDRVRKVLKDLGESKEAKDVLREVRRLVEENRKHSEDVSRDNKRLVDEVRRHSEELLKEVKRLVDEVRRLDKDEVVRRVARRIEELLKENDDLVRRVAEEIKRTLKENNEHSDDLRRRIEELIKEITERRR

SEQ ID NO: 21090 - protein, 176 aa, Artificial Sequence; identical to SEQ ID NO: 21089
  Synthetic sequence.

SEQ ID NO: 21091 - protein, 176 aa, Artificial Sequence
  Synthetic sequence.
DIEELLERLRRRVEKSLEDSDRLLRKLEEDSKESVKRVKRLLEELIKRVKEVLKKAGNSEEAKKVLEDVERLVREVEKHSREVSERNKKLVDDNRKHSEDLLRTVRKLVEEVRRLTDKELVKRALEEIEKRLKDNRDHSRRLAETVKDTLDKNDKKVEEVRREIEELLRRLDEKRN

SEQ ID NO: 21092 - protein, 176 aa, Artificial Sequence; identical to SEQ ID NO: 21091
  Synthetic sequence.

SEQ ID NO: 21093 - protein, 176 aa, Artificial Sequence
  Synthetic sequence.
DIEDLLRELRKRVEDSLKKSEDRLRRLEEKVKRSLDEVEKELKRLLDEAKKVVDKAGNSEEAKKVLDDVKRLVDRVRRESERLLKEVRDLVRENKKHSKELLDEVDELVERVRRLDKDEEVRRVLERIDRLIKRNDDHSRKLEKEIEDLLRRNNREAEEVAKEVEKLLEDLERRRK

SEQ ID NO: 21094 - protein, 176 aa, Artificial Sequence; identical to SEQ ID NO: 21093
  Synthetic sequence.

SEQ ID NO: 21095 - protein, 182 aa, Artificial Sequence
  Synthetic sequence.
REIEEVVKELDDLLRRNDERVKRILDELEELIKKHDRRSDEVTKEIRELLRKLEREVERDKSKEDLERKLDELRRTVDELVRDVERHAREVLERVKELVERLERHSRRVLEEVEKLVREVVRTKEARELAEELKKRAKESVDRSKKALEELKKRAREAVRRSREKLKKLKREVEKVVREVRR

SEQ ID NO: 21096 - protein, 182 aa, Artificial Sequence; identical to SEQ ID NO: 21095
  Synthetic sequence.

SEQ ID NO: 21097 - protein, 187 aa, Artificial Sequence
  Synthetic sequence.
DELREILERVRRVLERSKELSEELLRRVEEVLRRLRKHSRDLEEKVRRILTEIEKRARERRDDDEKLLREVKKVLEDVERELDRSIERSEEVVEELKRRADRSIEESRRLLETVKKELEDLIERRREVKDLREKLDKLRRDLEEVLRRNEEIVREATRRIRKVLDENRKKVEELKRRAERVLEELRR

SEQ ID NO: 21098 - protein, 187 aa, Artificial Sequence; identical to SEQ ID NO: 21097
  Synthetic sequence.

SEQ ID NO: 21099 - protein, 187 aa, Artificial Sequence
  Synthetic sequence.
DDLRRIAKEVEKVLKTSEDLSEELKKEVKRVVDESREDSKRLREEVRKVLEEVKRLADRNEKDREELLDEVRRLLEEVRRLLKESIDRSKRLLEDVKKKLEDSIRESERLLRTVEERLKELIDKKREVRELKEILKELKKELERVLEDNRRKVKELEDELREVLKRNEKIARELEKELRRVLEEVRR

SEQ ID NO: 21100 - protein, 187 aa, Artificial Sequence; identical to SEQ ID NO: 21099
  Synthetic sequence.

SEQ ID NO: 21101 - protein, 187 aa, Artificial Sequence
  Synthetic sequence.
DELRELEERAKKVVDESRENSDRLAKKVKEVLKRSRELSDELRKEVERVLREIKERARRKDEPREDLLREVAKVLEEVKRRLEESIRRSKRLLDEVTRELEESIRRSEELVDRLRKKLEELIDRRREVERLRDILDKIAREVERVLEENRRIVTELKKELEKVLDENRKIVEELERRARKVLKELRD

SEQ ID NO: 21102 - protein, 187 aa, Artificial Sequence; identical to SEQ ID NO: 21101
  Synthetic sequence.

SEQ ID NO: 21103 - protein, 187 aa, Artificial Sequence
  Synthetic sequence.
DELRELLEEVRRMLRESRENSRKLAEEVERVLRESEEDSKKLKRDVEKILEDVRRKLERNEKDKKDLLKEVEDELRKVRKDLEESIRKSKRLLDDVRRRLEESIRRSEKLLRDIDKRLKELIDKRKEVDELRRILDELRRRAKKVLDDNRKIVRDLERELRRVLEENRKIVEELEKLLEKVLEELRR

SEQ ID NO: 21104 - protein, 187 aa, Artificial Sequence; identical to SEQ ID NO: 21103
  Synthetic sequence.

SEQ ID NO: 21105 - protein, 187 aa, Artificial Sequence
  Synthetic sequence.
KELEELAKTVEDLLRENDRLAEEVLRTVDDLLRKNDEISKRLLDTARKLLKELKDLKRENRGDKKDLLRTLERLLEKLKEDVDRSRKISEDLLREVKRLVDELRERSKRILDEVRKLAEKLIREKDKSEDVKRILEKLIRDVEKSLKDVDDRLRELIRRVEESLRRNEEILKEVERRAEEVVEEVRR

SEQ ID NO: 21106 - protein, 187 aa, Artificial Sequence; identical to SEQ ID NO: 21105
  Synthetic sequence.

SEQ ID NO: 21107 - protein, 187 aa, Artificial Sequence
  Synthetic sequence.
DDAERLLEDVRRLLEENDRISEEVLKTVKRIVDENDRLAEELLRTVDELVKRLKELRERNEGDKKVLDKEVKKILREVEKLVEELRRISKKLLDDVKRLVDESRKISEKILDDVRKLVTELIRKVKDFERIRKILEKVIKEVEDSLRRNSEIVERAVDRARESVKRVKEIVETVERKIRKVVDEVRK

SEQ ID NO: 21108 - protein, 187 aa, Artificial Sequence; identical to SEQ ID NO: 21107
  Synthetic sequence.

SEQ ID NO: 21109 - protein, 187 aa, Artificial Sequence
  Synthetic sequence.
SEVEEVKDRVTKLLKENDDISKELEERVRRLLEENDRHSREVEKTVRKLLEDLKRLAEENKGDKKVLTKEAKRILDEVRKLVKENDDLSRKLLEDVKRLVETSKRISEKLLRDVKRLAEDLIDKKRDSKRVKDILRRLVEEAEESLRRNEKKLRELEKRVRESLKRSHKINKELEERVKEVLDRVRD

SEQ ID NO: 21110 - protein, 187 aa, Artificial Sequence; identical to SEQ ID NO: 21109
  Synthetic sequence.

SEQ ID NO: 21111 - protein, 187 aa, Artificial Sequence
  Synthetic sequence.
DEVERVLEEAKKLLDTNDDLLRKLDDTVRKLVEDNNRISEEVRERVERLLRRLEELVRKNEGDKKKLEKDARDILRKVRELAKESDERSRKILEEVRRLAEKLKRDSERLLRTVERLVRKLIDDKRDSERVKRILDRVIKEVTDSLKRVEDRLRELIRRVEESLKRNREELRRLEERVKDVLDKARR

SEQ ID NO: 21112 - protein, 187 aa, Artificial Sequence; identical to SEQ ID NO: 21111
  Synthetic sequence.

SEQ ID NO: 21113 - protein, 187 aa, Artificial Sequence
  Synthetic sequence.
DRLEDLLRDVKRLLEENDKHSKEVEERIRKLVEDNNEISRTVARDVEEKLKRLRERTEEKRGDKKVLERDVERLLEEVDRLLKRSEEISERILREVRREAERNDEESERILKEVRDLVRDLIDKFRDSERVRRTLEELTRRVEESLKRSHEINRKVIREIEKSMDENKKELERLIDRARRVLEDVRK

SEQ ID NO: 21114 - protein, 187 aa, Artificial Sequence; identical to SEQ ID NO: 21113
  Synthetic sequence.

SEQ ID NO: 21115 - protein, 187 aa, Artificial Sequence
  Synthetic sequence.
SEAEEVLKRAEEILRENNKISRDLEEEVRRLLKENDDLLREVEETVERLLEELKELAKRNEGDKKELVKRAEDLLRRVRDLVRRLEERSKEILKEVKRLVEESKRRSEELLKRVRELAKELIDRKKDSERVKKILERVIRELEKSLKDNERKLRELEERVRDSLRRVEESLRRLERRVEEVLERVRK

SEQ ID NO: 21116 - protein, 187 aa, Artificial Sequence; identical to SEQ ID NO: 21115
  Synthetic sequence.

SEQ ID NO: 21117 - protein, 187 aa, Artificial Sequence
  Synthetic sequence.
DEMEKLRKDVKKLLEDNNKISRDVEKTVEELLRRNDEHSKEVLKRVEDLLRELKKLKDDKDGDKKELLKTLEDILREVAELLKRNDDLSRKILEDVERLARESKKISEEILREVERLAEDLIRKFDKSEDVKRILEELKKRAEDSLRENEKRLRELIREVEKSLRRSHEINRDAERKVRKVLDDVRR

SEQ ID NO: 21118 - protein, 187 aa, Artificial Sequence; identical to SEQ ID NO: 21117
  Synthetic sequence.

SEQ ID NO: 21119 - protein, 182 aa, Artificial Sequence
  Synthetic sequence.
SEIEELLERVKELLKRNRELVERVKRTVEELNKDNDRVVKEIEDEARRLLDELEKIMRRTSDKRTLDKILREVLERVRKLVEDLEEHSRRILKRTEELVRKLRKHSEDVKRTVDRLVKEVVRDDRMRRIAKKAIDDVRKSVEDSKRILDELRKSTEESVKRTRDILKRVLDEAKKVVEDLRR

SEQ ID NO: 21120 - protein, 182 aa, Artificial Sequence; identical to SEQ ID NO: 21119
  Synthetic sequence.

SEQ ID NO: 21121 - protein, 182 aa, Artificial Sequence
  Synthetic sequence.
DELEELRTRVEKLLKENNDLVREVLKTVKKLNDENRKLVERILREVERLLRELREIAKTTSDKDTLKKELRRVLEEVKKLLEELREHSRRILETTKELVRRLEEHSKRVLDTVEDLVRKVVRTEEMRKKAEELRKRVDESVKDTRKKLEELRKSTEKSVRDTDRILKDLERRAREVVDELEK

SEQ ID NO: 21122 - protein, 182 aa, Artificial Sequence; identical to SEQ ID NO: 21121
  Synthetic sequence.

SEQ ID NO: 21123 - protein, 177 aa, Artificial Sequence
  Synthetic sequence.
DVEEAVRELRETLDKSVERSERTVRELVKKLETSVEETREEVERVVEELDRVVEEAKKDVSEKIVDEIRKLVDKLRKEAKKVLEDSKRKVDELRKEAKKVVDESRERAEKLKKDLDERGAGAKEVRKEVKELVERDEDLVRKIREKVEKVVKDNKDLLRRIREAAKRVVREIRERLR

SEQ ID NO: 21124 - protein, 177 aa, Artificial Sequence; identical to SEQ ID NO: 21123
  Synthetic sequence.

SEQ ID NO: 21125 - protein, 184 aa, Artificial Sequence
  Synthetic sequence.
STMDEIRRIVEKVLKEDKDLAETADRLNRDSVRRDEELAERNKRTNERVVREIEDRLKKEKSEEVVKTIKELIERVVKRNEESIRESERLVRELVKKNEEIIRRSKKLVEEVERRAREILKSSEDKRLEDIVREVKKRLEDSLRDTERIVREVDERNKESLRRSKEIVERVNKLLRDVLERART

SEQ ID NO: 21126 - protein, 184 aa, Artificial Sequence; identical to SEQ ID NO: 21125
  Synthetic sequence.

SEQ ID NO: 21127 - protein, 179 aa, Artificial Sequence
  Synthetic sequence.
SSKEVADELRKKAEKVLDELRKIIRELERKNEDSLRRTEEIVRRLEEEAERVLRDLVRTRGEDDRLVREVERLLRELKRRLEELIRRSEELIKRSREEVDRVIRTVEKLLEELDRLLRANKGDIEDLRRTVDKLVEEIKDLARKLAKSSDDTVREDEKLVEELRKDVKRIVRKIKKDLE

SEQ ID NO: 21128 - protein, 179 aa, Artificial Sequence; identical to SEQ ID NO: 21127
  Synthetic sequence.

SEQ ID NO: 21129 - protein, 170 aa, Artificial Sequence
  Synthetic sequence.
SAEEVVRELDKELKKVLEDSRDLVRRLEEELRKVLEDNEEVVKEIERSSDDVLRKLGDSEEAREIVKRSRDELKESIDDSRRIVEKIRRDLERNIRKVEEIIEDIKRKLKDLRGSDELLRRVKELVERARRHSERLLEEVKRLVDEIRERSKELLERARRLNEEMKERTR

SEQ ID NO: 21130 - protein, 170 aa, Artificial Sequence; identical to SEQ ID NO: 21129
  Synthetic sequence.

SEQ ID NO: 21131 - protein, 183 aa, Artificial Sequence
  Synthetic sequence.
SDLEELFREVKELVDDNLRKSDKLRRDVEKRVRDNERRSEKVHEDNRRLIEKIERLVRRGELREEDVRRALEEIKDSLRRSLETSKKVLDDIREELKRSLDHSREVLEEIERLLEEILRKDKDSDRVRTLVKELRERAKKSLDDNRRMVEELRKRLEESLRRNKRVVEESEKIAKEVLDKVRT

SEQ ID NO: 21132 - protein, 183 aa, Artificial Sequence; identical to SEQ ID NO: 21131
  Synthetic sequence.

SEQ ID NO: 21133 - protein, 183 aa, Artificial Sequence
  Synthetic sequence.
KDAEDLERRVRELVEENNRVSKRLAEEVTRLVKENEDKVRELEKEVRDRAKELLDMKRRGEVREEEVKRVLREIEELLREITEHSKEVLKTIEKLLRDSLEHSRRVLEEIERLLETILRKSKDSERLKKLVDELRETLERSLRENEKVADELRKRAEKSLEDVKRVVDELRKIVDDVLKRVED

SEQ ID NO: 21134 - protein, 183 aa, Artificial Sequence; identical to SEQ ID NO: 21133
  Synthetic sequence.

SEQ ID NO: 21135 - protein, 183 aa, Artificial Sequence
  Synthetic sequence.
DDLEELFERVKRLLERNNEVSKKLEDDVRKLIEDNERRVERVHRENEKELRRIEDLKRRGEIREKDVKRALEEIKRSLDELLKHSKDVLEEIEKLLRDSEEHSKTVLKEIEDLLRDILRKDKDSERVRRLVEELRKLLEDSLEKNKRLVDELRKRAERSLREVRKLVERSKREAERVLEEVRK

SEQ ID NO: 21136 - protein, 183 aa, Artificial Sequence; identical to SEQ ID NO: 21135
  Synthetic sequence.

SEQ ID NO: 21137 - protein, 183 aa, Artificial Sequence
  Synthetic sequence.
SRVEEMFERIERLVRRNNEVSRRVHERNRELIKRNREKVKKVHDDNKKLIDDLRELKRRGEIREEEAKKVLEEIEKSLRELKKHSEDVLREIDKTLRESEKHSDDVTREIDELLKRILDEDKDSERVRRLVEEARRLLKKSKDDNRRVVKRSREEVTRSLREVEKLVDESRREAEKVLEEVKK

SEQ ID NO: 21138 - protein, 183 aa, Artificial Sequence; identical to SEQ ID NO: 21137
  Synthetic sequence.

SEQ ID NO: 21139 - protein, 183 aa, Artificial Sequence
  Synthetic sequence.
KELEEAFDRVRRLLEENKRKAEEVHRTNEELVRRNNEKSERVHRENEKEIERLDRAKKRGEIREEEAKRVLEKIERSLKRSEEHSEELEREVERTLRELEKHSEDVLKDIERLLKDVLRKDKDSERVKTLLKELRDRLKESRETVKELVDRSREEVKKSKKRNKKVVTDSRRRIKDVLDKVRK

SEQ ID NO: 21140 - protein, 183 aa, Artificial Sequence; identical to SEQ ID NO: 21139
  Synthetic sequence.

SEQ ID NO: 21141 - protein, 183 aa, Artificial Sequence
  Synthetic sequence.
KEAEDMLRKVRKLIKENEKHSREVADEVRKLVEDNDRKVDEVHERNRKLITDLRRLAEEGRVREKDVKAVLEEIEKSLRELRKHSRDVLKRIDDLLKENEKHSREVLKEIKRLLDELKKEDKDSERLKTVVTELEKRARDSLEKSKEINKRLREELKRSEERVERLVRKSEEEAKKVLDDVRR

SEQ ID NO: 21142 - protein, 183 aa, Artificial Sequence; identical to SEQ ID NO: 21141
  Synthetic sequence.

SEQ ID NO: 21143 - protein, 183 aa, Artificial Sequence
  Synthetic sequence.
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 21144 - protein, 183 aa, Artificial Sequence; identical to SEQ ID NO: 21143
  Synthetic sequence.

SEQ ID NO: 21145 - protein, 185 aa, Artificial Sequence
  Synthetic sequence.
SEVEEIFKRVTDLLKRNRDLVREILERSRRLVERNDREAKKILDDARRLIEELEDAVRKERDKDTLRKKVKELRDEVKRLVDRLRKHSKDVLDTDRKLVKELEDHSKELEKEVERLLEELERRSRDERVKKLLDELRERVKRSVEESRRVLDDSRRKSEDSLRRSEELLKRVEEIVERVAREVER

SEQ ID NO: 21146 - protein, 185 aa, Artificial Sequence; identical to SEQ ID NO: 21145
  Synthetic sequence.

SEQ ID NO: 21147 - protein, 185 aa, Artificial Sequence
  Synthetic sequence.
SEVEEIARRVDKLLKDNKRTVDEILKESRRLVKENNELVDKILREVEELLRRLEDEVRKERDKDELTRKVKELIDRVRKLLEDLRRHSEEVRRRDEELADRLRKHSKELEERVKRLLEDLRRKSTSERVEKLLRELEKRVKESVDTSREVLKRSREDSKRSEDRTEKVLREARKRVEDVADKVRK

SEQ ID NO: 21148 - protein, 185 aa, Artificial Sequence; identical to SEQ ID NO: 21147
  Synthetic sequence.

SEQ ID NO: 21149 - protein, 185 aa, Artificial Sequence
  Synthetic sequence.
REVEEIVKEVERLVRENDKVAKEIVDESKRLVEENRKRVEEIRREVEELIRRLEDAVRKERRKEDLARKVKELRDTVERLVRELKKHSEEVLRRDEDLVRRLRRHSEKLKKDVDDLVRDLERKSDDKRVKDLLEELRKRVKDSRKKSEELLEESERRSKKSLDDTRRVLKDARDIVEKVADEVRK

SEQ ID NO: 21150 - protein, 185 aa, Artificial Sequence; identical to SEQ ID NO: 21149
  Synthetic sequence.

SEQ ID NO: 21151 - protein, 185 aa, Artificial Sequence
  Synthetic sequence.
SDVEEIKKRVKELLEENKRLVETIEREVRRLIEENRRLAKRILDEVRRLLEELKDRVDKDRDKDELRKEVERLLERVKELLDALRKHSKDVLDTVKKLLEDLRRSSEELRRTVEELVRRLEERSDSERVKKLLTDARKEVERSLRESKKALDELRRIVEKSLRDTERLLRTAEKEVEDVLREVER

SEQ ID NO: 21152 - protein, 185 aa, Artificial Sequence; identical to SEQ ID NO: 21151
  Synthetic sequence.

SEQ ID NO: 21153 - protein, 185 aa, Artificial Sequence
  Synthetic sequence.
SEVEKIFRDVEDLLRRNEETAKEILKTSEELVRRNEELVRRILEEVRDLIRKLREVVERSRDKDELRRKVDELRREVERLVRELEKHSRRVLEEDKRLAEELRRSSKELEDEVKRLLDDLRRRSTDRRVEELLRRLAEAVKESLERSERLLRRSEEESRRSLKKTEDILREAREIVRKVAEEVKK

SEQ ID NO: 21154 - protein, 185 aa, Artificial Sequence; identical to SEQ ID NO: 21153
  Synthetic sequence.

SEQ ID NO: 21155 - protein, 185 aa, Artificial Sequence
  Synthetic sequence.
REVEEIVKEVRRRLERNDEVAERIVRESERLVEENNRLVEEILRRVRKLIEELLDLVRKSRDKSKLKKKVDELRRTVKKLLDELREHSKRVKEEDERLVDELRKHSRKLLEEVKKLADELRKRSTDERVEKLLRDLEREVDESRKKSRKLLERSREESDRSLKTTEDILREAERIVEKVEEDVRR

SEQ ID NO: 21156 - protein, 185 aa, Artificial Sequence; identical to SEQ ID NO: 21155
  Synthetic sequence.

SEQ ID NO: 21157 - protein, 185 aa, Artificial Sequence
  Synthetic sequence.
SDVEEIVRRAEKLVEDNDRVAEKIHEDNRRSNKRTLDEVRKILEEVRKLIKDLEDEVRRDRDKDRLRKKVKELKDEVERLLRELEDTVRRDKETSKDTARKLRKHSEDVEKTVRDLVTELARRSDDERVKRLLRRVEKSVRDSKRRSEKLLEDSERSSEKVEKDVRDVLKEAREIVRDVAEKVEK

SEQ ID NO: 21158 - protein, 185 aa, Artificial Sequence; identical to SEQ ID NO: 21157
  Synthetic sequence.

SEQ ID NO: 21159 - protein, 185 aa, Artificial Sequence
  Synthetic sequence.
EEVERIVEDVRRLLEENRELVKRILDEVRKLIKENNRLAREILETVRTELEKLRDLVRKLKSKEDLDRKVKELRRKVKELLDDLRRHSEDVRRRVKELLDRLRDSSRRLREEVRRLLDDLRRKSTSERVEKLLEELERRVEESVEESERVLREAEKIVRDSRKTTEELLEEAKRRVDEVAKEVKK

SEQ ID NO: 21160 - protein, 185 aa, Artificial Sequence; identical to SEQ ID NO: 21159
  Synthetic sequence.

SEQ ID NO: 21161 - protein, 185 aa, Artificial Sequence
  Synthetic sequence.
SSVDEILKDVRRSNKENLDLVEKILRESKKLVEENRRLVKEILDRVRKLIKELLRLVREDRDKDTLRKKAEDLERTVKKLLKELEDSSRDVIRRDKELVTRLKESSDRNLERVKKLAKELREESTSEKVEDVLRRLKRTSERSLEESKKLLEESEKDSDRSRKESEEVLREAEEIVKRVLKEVER

SEQ ID NO: 21162 - protein, 185 aa, Artificial Sequence; identical to SEQ ID NO: 21161
  Synthetic sequence.

SEQ ID NO: 21163 - protein, 185 aa, Artificial Sequence
  Synthetic sequence.
DDVETIVERVRELLEENNRLAREIVERVEKLLKDNDDLVKEILEEVDRRIRKLEEAVKRDRDKETLRKKVRELEERVKELAERLKKSSKELKDEVDRLLKELEDHSRDLERRVKELLDDLRRKSTDRRVEELLRKLEEDVKRSLEDTKRLLDELKKKVDESRKRSKDVLDKAREIVDRVRRSVEK

SEQ ID NO: 21164 - protein, 185 aa, Artificial Sequence; identical to SEQ ID NO: 21163
  Synthetic sequence.

SEQ ID NO: 21165 - protein, 185 aa, Artificial Sequence
  Synthetic sequence.
SEVEKIVRDVEESNKKTKKKVEDIEEEVKDLVRKNNELVKRILEEVKRLLEELKRVKKDDRDKDRLRKKVEELIRTVEELAKELEDHSRRVIETVRRLLERLRRTLEEDLKEVERLLDELRRRSDDERVKRLLDRLRRTSEEVLERVEEVLKKAEEIVRKSFEDSKRVLRKAEEDVKRVARDVEK

SEQ ID NO: 21166 - protein, 185 aa, Artificial Sequence; identical to SEQ ID NO: 21165
  Synthetic sequence.

SEQ ID NO: 21167 - protein, 173 aa, Artificial Sequence
  Synthetic sequence.
SVDEAAKEAEEIVETVERESRKLLEDSRRIVEEVKKRSEEILEEVRRRVEEVVKESKLKRLADELRKMVKKIKDDVERSNKKTEDDLRKSEEEVKRSNDTTREILKRIREVLKAGSPLERLLEALRRVIDEDRKRSKKLHEENKRVIERDKEISDKLLDDLRKLVADLRRRAK

SEQ ID NO: 21168 - protein, 173 aa, Artificial Sequence; identical to SEQ ID NO: 21167
  Synthetic sequence.

SEQ ID NO: 21169 - protein, 179 aa, Artificial Sequence
  Synthetic sequence.
REAEELEKEVKKVVDDSKKRLDELDEENRRVDETIKKISEDLTREVKDVIRRIRDGNLREDEVRKVVKEVTDKLEDSNRRVEELIRRTEKKLRDALERSKELSREVLEKARKLLEDKKDLEELRELVERLRRRLETVNRELERRVRELKRSNDESHRENREVIEELIKELKKVLDDVRK

SEQ ID NO: 21170 - protein, 179 aa, Artificial Sequence; identical to SEQ ID NO: 21169
  Synthetic sequence.

SEQ ID NO: 21171 - protein, 179 aa, Artificial Sequence
  Synthetic sequence.
DELREILRKVEKVVEDIERTSDKLRREVDKVVDDSRRKLEELEKEVKKVIEDIRDGNLREEEVREEVKRVVRKAEKLLEDSRRETEKVVRDAEESNKEVKRLIDEVKKELDRIIEEKDKVDRLKEAVKELAKRLKDVHERNKRLIDTLREKLKRINDELERSVRELKKELEEVIDRVRK

SEQ ID NO: 21172 - protein, 179 aa, Artificial Sequence; identical to SEQ ID NO: 21171
  Synthetic sequence.

SEQ ID NO: 21173 - protein, 179 aa, Artificial Sequence
  Synthetic sequence.
DEVEELKRRVDRLVEEIRKLSEELLKRNRDVDREIKKRVKDLEDKVRKVIRDIEEGNLRKEEVEKVVRDVKRELEELERRVRELVKRTIEEAERSNEEVKRIIDEVEKEADRLLEEKKEVRELDEVIKEIRRRLEKVHRDNRRVIDEVRRSNRDSERDIAEAVERLTRLLETVLEKVKT

SEQ ID NO: 21174 - protein, 179 aa, Artificial Sequence; identical to SEQ ID NO: 21173
  Synthetic sequence.

SEQ ID NO: 21175 - protein, 187 aa, Artificial Sequence
  Synthetic sequence.
DELEELRTTVTKLLEDLKKISDDLREEVRRLLEEVEEISKRLEETVRRIIKRVEDIVRRDGGRDERVVREVARILEDIERLLRESLKRSKEVLDEIEKLLRDSEKISRTILEKIERDLERLLRRKKDVKDVKEVVKKLRDELRRVLERNKEVIDRLREKAREVLEKDRKLVDDLREEAREVLERVKT

SEQ ID NO: 21176 - protein, 187 aa, Artificial Sequence; identical to SEQ ID NO: 21175
  Synthetic sequence.

SEQ ID NO: 21177 - protein, 187 aa, Artificial Sequence
  Synthetic sequence.
DELEEIKKEVEELVKTNERIVDKLREDNKRLVEEVKRISEELEREVRRIIREVREIVKRDGGRDKRVRDTVRKVLRDIEELLKRSLDISREVLERSAESLRRSLEISKEIADRIRKLLRKLLEDLKDVKDVEKLLRELEEEAKRSLKRNRDVIEKLREENKRLLDDDRRVVEELRKEAKDVLDEVEK

SEQ ID NO: 21178 - protein, 187 aa, Artificial Sequence; identical to SEQ ID NO: 21177
  Synthetic sequence.

SEQ ID NO: 21179 - protein, 187 aa, Artificial Sequence
  Synthetic sequence.
REVDELKKTAEKLIRDDERLVEEVLRTSKKLVREDEDMVRKLRKTIEDLIRRLTDVAREELKDKDELRKMVREVLERVKKLLEELRRHSKRILDEDRRLAEELRRHSDEIKDRVRKLVEDLLRRLDKVRDVKRVLDEVEKLVEDSKRETERVLRESEERSRRSLEETEKALKDLAKLAEDIKREVEK

SEQ ID NO: 21180 - protein, 187 aa, Artificial Sequence; identical to SEQ ID NO: 21179
  Synthetic sequence.

SEQ ID NO: 21181 - protein, 187 aa, Artificial Sequence
  Synthetic sequence.
REVDELRKRIEDLVRRDEEVARKVLEDVRRLVRRNREKARELLERVEKLVRDLKRVADRDLKDKETLKRMVDRVIEEVKRLVEELRRDSKRVIDEVERLVRELEDHSRRVKDEVEKLVRELLERFKDVEEVKRVLDELRKLVKDSERKTKEVVEKVREDVKDSLRRSEEVLKRVKELVDRVADEVRK

SEQ ID NO: 21182 - protein, 187 aa, Artificial Sequence; identical to SEQ ID NO: 21181
  Synthetic sequence.

SEQ ID NO: 21183 - protein, 187 aa, Artificial Sequence
  Synthetic sequence.
SDLEKLKERVDELIRRDDELVKRVLEESRRLVDRNKKKVDELRRRARKLIEDLKRVADRDLKDKRTLTEKAKEVEKTVDKLVKDLRRDSKKVKDDDEKLAEELRRHSKEILERVERLLEELLRRLDKVERVKELLDRLRKKVEDSREKTERVLKESRELSDRSLERSEEVLERVRREVREVVERLKK

SEQ ID NO: 21184 - protein, 187 aa, Artificial Sequence; identical to SEQ ID NO: 21183
  Synthetic sequence.

SEQ ID NO: 21185 - protein, 187 aa, Artificial Sequence
  Synthetic sequence.
DSLREVEKRIRELIRENEELVKEVLERSKRLVDEDRETAERLRKTVEELLKRLREVADKELQDKDTLREMVKKVIEDVRRLLEELRRHSEKILRDDKRLVDELRKHSEDVKREVDKLLKELLEELKDVDEVRKALEDLKRTVDESERRTEEVLKESEDLSRRSLKETEDLLRELEKRVKEVADRVED

SEQ ID NO: 21186 - protein, 187 aa, Artificial Sequence; identical to SEQ ID NO: 21185
  Synthetic sequence.

SEQ ID NO: 21187 - protein, 187 aa, Artificial Sequence
  Synthetic sequence.
SDLDEVRKEVKRLIDENRTLVDEIRRRIEKLIRENKKKVEELRKRAEELIRRLKEVADRDLKDKETLKRMVDRVLDEVRRLVEELREDSRDLERRVEELVRRLKDHSRELEREVRRLAKELLDRLDKVRDVKRLLDDLKRLVKESLDETERVLRELRKEVKDSLRDSERALREVEDLVRRIKKRVEK

SEQ ID NO: 21188 - protein, 187 aa, Artificial Sequence; identical to SEQ ID NO: 21187
  Synthetic sequence.

SEQ ID NO: 21189 - protein, 187 aa, Artificial Sequence
  Synthetic sequence.
DEVKKLEEDVRRLIEENEELVRRVKKTSDDLVKRNKEKVEELRKRVEDLIRRLREVERRDLKDKDELRRKAEEVLRRVKKLADDLKKDSRDVLETDRELVERLKRHSEDLKRRVEELLKDLLDKLKDVDEVRKALERLRDEVRRSVTDTDRVLKESEDRSRKSLEDSERVLRELEELVKRILDDLAR

SEQ ID NO: 21190 - protein, 187 aa, Artificial Sequence; identical to SEQ ID NO: 21189
  Synthetic sequence.

SEQ ID NO: 21191 - protein, 187 aa, Artificial Sequence
  Synthetic sequence.
SEVDRLRETIKRLLEENKELVERLRERVRKLIRENEKKVEELRDRAKKLIDRLREVRTRDLKDKDKLRKVIEEVERRVRKLVDDLRRDSDRLEEAVRRLLKELEDNSRELKKEVERLLRELKERKKDVRDVERALKELRDRIEESLRRSEEVLKELEERVKESRDESRRVLEEVRRLVEEIKRRAEK

SEQ ID NO: 21192 - protein, 187 aa, Artificial Sequence; identical to SEQ ID NO: 21191
  Synthetic sequence.

SEQ ID NO: 21193 - protein, 187 aa, Artificial Sequence
  Synthetic sequence.
KDVEDLEREIDRLLDEDRKVVEDLERKIKKLIDDNKRLVDKLREDVERLIRRLREVTEKELKDKDTLRKMVRDVKETVKRLLEELERNSREVLKTVKKLLDDLRRHSKRIKEEVEKRVRELLERLKDVKKVKEVLDELRKRVDRSLEEAEKALRRLEKLVRDSLRRSEEALERLKRLVDDVKKKVED

SEQ ID NO: 21194 - protein, 187 aa, Artificial Sequence; identical to SEQ ID NO: 21193
  Synthetic sequence.

SEQ ID NO: 21195 - protein, 187 aa, Artificial Sequence
  Synthetic sequence.
SELDEVKRRAKELVDRDKKLVKEVLDTSRELVRRNEELVRRILEEVRKLIEDLAEVTKRDLKDKDTLREMVKRVKEEVERVLRELERNSREVLKRDKKLADELREHSREVLERVERLVRDLLEKKKDSKEVKELLDEVRRLAEESRREVERVLRESEKRSRESLKKSEDALERAKKLVEDIKDEVER

SEQ ID NO: 21196 - protein, 187 aa, Artificial Sequence; identical to SEQ ID NO: 21195
  Synthetic sequence.

SEQ ID NO: 21197 - protein, 185 aa, Artificial Sequence
  Synthetic sequence.
SEEDKIREIVDRVLKESEKLIEEIERRVDKVLKRIKELTDEIKKRAEDVIREIEDIVRKERSERVEKRVKELEKELDEMAKESNERVRRLVEEVKKELREVLKDSRRLSKEVEETLKRLLEEKKEVDELRKVVEEIKRELEKIDKKLEEVVRRIEKKLEDILKENSKAVREIRELLKKVKRELEK

SEQ ID NO: 21198 - protein, 185 aa, Artificial Sequence; identical to SEQ ID NO: 21197
  Synthetic sequence.

SEQ ID NO: 21199 - protein, 186 aa, Artificial Sequence
  Synthetic sequence.
DEVEELKRRVEKLLEEIERLTKTHEDRSRRLIEDIRDSNRKLKEDAERLIKEIEELKRKVKDKETLTREVERLLRELEEKLKRDLKRVEDVLRDNERSVRESEKRSRELLERLKKLLEELKTKSKDSEELKKVVDDLRREAERILRRDEEAVKRSEKLLRDILEHVKRVVDEIREELKRILDRVRE

SEQ ID NO: 21200 - protein, 186 aa, Artificial Sequence; identical to SEQ ID NO: 21199
  Synthetic sequence.

SEQ ID NO: 21201 - protein, 186 aa, Artificial Sequence
  Synthetic sequence.
DEVREIEKRVRDLIREIEKSNRDLEREAKRLIDEIDDLSRKLKEDADKLIEEIKELKKKVKDKRELTDRVRKILEEVERLLRESIERSKEVLKELEKLLRDDLKKVEDVLRTVEKILKDLLRRDKDSEEVRRVVEKLRRLLKTITEHVKEVLDRLRREAEDALRRDKEVADRIREEARRILEDVKK

SEQ ID NO: 21202 - protein, 186 aa, Artificial Sequence; identical to SEQ ID NO: 21201
  Synthetic sequence.

SEQ ID NO: 21203 - protein, 186 aa, Artificial Sequence
  Synthetic sequence.
DDVKRIEKEVRRLLREIERLTREHEKESRELVREIEELSRRLEEEIKRLIEEIEELRKRVKDKEKLTRDVERIKRRVEKLLKESEDRSKRVLDENRKSARESIERSREVLEELKRLLEDLLRRDKDSKEVRDVVKRLEEEIREVLAKDEEVARRSVEALADILRRDKDVVDRIRKLLKEILDRVRK

SEQ ID NO: 21204 - protein, 186 aa, Artificial Sequence; identical to SEQ ID NO: 21203
  Synthetic sequence.

SEQ ID NO: 21205 - protein, 174 aa, Artificial Sequence
  Synthetic sequence.
DREEVVKEIKKRLEDLNRRVREVVKKIDRELEKLLEESKRVVDDLRRRLEELKKRIKGDDAKRKVEEIVKEVEKILKRVIDDNKRLVDELKRLLEEVIRRSETSVRRLEDVLRREIQDERELERLVKEVEKTNERLLDELRKAAEEVAKRSEDTLRELRDIIKKVEERATDIAR

SEQ ID NO: 21206 - protein, 174 aa, Artificial Sequence; identical to SEQ ID NO: 21205
  Synthetic sequence.

SEQ ID NO: 21207 - protein, 174 aa, Artificial Sequence
  Synthetic sequence.
SKEDVVREIEKTLKDLLDDSRRVVRESEERLKELNRRLREVVKESKRRLDEALRRITGDELKERVRKLVEDLRKINKESIERSEKSVEELRRHSRKVIRDNEKLVDDLRRVLRRDIQDTEELRRLVDKVREDSERTLERDRRLAKEVSDRNKRLVEENRKIVEEVLKTIEELRR

SEQ ID NO: 21208 - protein, 174 aa, Artificial Sequence; identical to SEQ ID NO: 21207
  Synthetic sequence.

SEQ ID NO: 21209 - protein, 174 aa, Artificial Sequence
  Synthetic sequence.
EREKVVKKIKEDLDRLNEEVKRVVDESRKLLKRLNERVEEVIREIRKTLEELTRRITGDRMKERAEEIVKRVDDILKKVNKDSERSVRELERHSREVIERSRESVRRLEEVLRREIQDERELERLVAEVAERNKKLLKDDKDLARKVAEDNEDLLRRLRDEVEKVRRTADEIRR

SEQ ID NO: 21210 - protein, 174 aa, Artificial Sequence; identical to SEQ ID NO: 21209
  Synthetic sequence.

SEQ ID NO: 21211 - protein, 174 aa, Artificial Sequence
  Synthetic sequence.
SREEVVDELRKRLEELNKEVREVVRESERKAERALEEVEEMVKRVREELEKLKRDIKGDEMRREVDEIVRKVEEDLERVIREVKKLIDDLRRHSEDVERRSKESVDRLKEVLERDIQNKDDLRRLLKEVAERNRKLLEDDEELAERVLREVRRLLEELRRRLKEIKERLDEIRR

SEQ ID NO: 21212 - protein, 174 aa, Artificial Sequence; identical to SEQ ID NO: 21211
  Synthetic sequence.

SEQ ID NO: 21213 - protein, 174 aa, Artificial Sequence
  Synthetic sequence.
SREEVVRRADKLLKDLNKRVKEVIERSERKLRELNERVRDVVRKIEKRLEELERRIKGDELKDRVRRIVEELERKLREVIKRSEDSVEELRRHSEEVNRRSRESVERVKEVLKRDIQDEEELKRVITKVLRDNEELLKTDEELAEDVARKNKKLLDDLEKTVKEVMDRAEELRR

SEQ ID NO: 21214 - protein, 174 aa, Artificial Sequence; identical to SEQ ID NO: 21213
  Synthetic sequence.

SEQ ID NO: 21215 - protein, 174 aa, Artificial Sequence
  Synthetic sequence.
SREEVVRDIERRLRELNKRVADVADESRRRLEELNEKLRRVVEESRRRLEELRKEIKGDEAKKEVERLVEELERINRESEERSKKSVEDLTRHSKKVNDDSRKSVRRLEEVLRREISDDDTLRREVKKVERENERLLEEDRRLVREVTRRNEKLVKDNREIVKEVLERAKELTR

SEQ ID NO: 21216 - protein, 174 aa, Artificial Sequence; identical to SEQ ID NO: 21215
  Synthetic sequence.

SEQ ID NO: 21217 - protein, 174 aa, Artificial Sequence
  Synthetic sequence.
SREEVVKEIKDRLKKLNDDVKRVIKESEDLLRKLNEEVRDVVRKIEETLEELLRRITGDRLAEEVKKIVEELTKRLRDVIRESEKSVEELKRHSEEVDRRSKKSVERVEEVLRREIQDEERLKEVVAKVAKENKDLLRRDEELARRVAERNKKLVEDLRRLVEEVRRRAEELRR

SEQ ID NO: 21218 - protein, 174 aa, Artificial Sequence; identical to SEQ ID NO: 21217
  Synthetic sequence.

SEQ ID NO: 21219 - protein, 175 aa, Artificial Sequence
  Synthetic sequence.
SESERVEELLKEVAKRVKEVSDRSKRLLEEIERRVKEVSDESEELLRRIIDEAKKVDRRREVIKEAADRARDVVRKSRELVRKVVEELRKLLEESRELVKKVMDELRKMIEDLKRTGVEERVVDRVRRELEKLIKDLEENSREVERSLRELIEHLKKNVEDVEREAKRVIDELKT

SEQ ID NO: 21220 - protein, 175 aa, Artificial Sequence; identical to SEQ ID NO: 21219
  Synthetic sequence.

SEQ ID NO: 21221 - protein, 178 aa, Artificial Sequence
  Synthetic sequence.
SLEEKLRRVLDELRKTIETLLKTNKDVLKKLEEDVKRIIRRNEEVLRDLERKVRDLKKKGGKEEEVRRLLRELRRINRESEKEIEELLRELRRLSEEHKRRVERLLEELERILSEVEPDERLKRVVDELRKRAKKLLEDVERVIRKSEEEARRLLREVEKVVRELDREAEKLVEEVRR

SEQ ID NO: 21222 - protein, 178 aa, Artificial Sequence; identical to SEQ ID NO: 21221
  Synthetic sequence.

SEQ ID NO: 21223 - protein, 178 aa, Artificial Sequence
  Synthetic sequence.
SSEETLRDILKKVEERSEETLRHNERVLEEVRKEVERILRRNEEVLRRLEKEAKELKKRGGEREKVERLLKELRRINEESRKEAERLVRELKRVSREHLEESKRLLEELDKVLKSLEPDERLKRVVDDLERRIRELLERDERVIRRTEEEARRLLDDVRRVVEELDKRAEDVVKEVKD

SEQ ID NO: 21224 - protein, 178 aa, Artificial Sequence; identical to SEQ ID NO: 21223
  Synthetic sequence.

SEQ ID NO: 21225 - protein, 178 aa, Artificial Sequence
  Synthetic sequence.
DEEETLKKILDDVRKVSRDTMEENKTFLEELSKVADKIIRDNEKVLDDHRKAAEELKKRGGREEDVKRLLDTNREINERSEREVERLAEELRKISEESLEKSARLLKKAEDVLRSLPPDERLKRVVDDIRRSLEELLKRDEEVVEESRKEVKRLEEEVREVVTRSDKLMDELLKKVKR

SEQ ID NO: 21226 - protein, 178 aa, Artificial Sequence; identical to SEQ ID NO: 21225
  Synthetic sequence.

SEQ ID NO: 21227 - protein, 175 aa, Artificial Sequence
  Synthetic sequence.
SEKEEVLREAREEAKDIERRLERLLERDKEVIDRVEKDLERLLRENKKLIDDVRRRVEEEGPDERLKKELRDSLRESAERVKDLLRRLEEHLRRTAEELRKLAEDLRESIKRLRERIGDDEVMDEIRRLAERVERRLREVLERSKKLVDDLRERLKEVLKRIEDLYRRLEEEADR

SEQ ID NO: 21228 - protein, 175 aa, Artificial Sequence; identical to SEQ ID NO: 21227
  Synthetic sequence.

SEQ ID NO: 21229 - protein, 185 aa, Artificial Sequence
  Synthetic sequence.
TAKEVLDEIRKVHEDLNRKIEEVLKHSEDVLREVEERNERSVRHSEDMLRRLEERIDRKGREEELRRELDKDLDRLRREHEEHHRRLKKTLDDLRKEHEELARKVKKVSEDAERKLDEVRRKLKDNEEVLRKLLEENKKEIRRLEEELKRLNEEVKKRIKELEDSSRKENDRVRERIRELDERVK

SEQ ID NO: 21230 - protein, 185 aa, Artificial Sequence; identical to SEQ ID NO: 21229
  Synthetic sequence.

SEQ ID NO: 21231 - protein, 185 aa, Artificial Sequence
  Synthetic sequence.
TLDEAARTIEELLREVEERARRVLRHSEKVLDKVRKENEDSLRHSDEVLRRVEREAEKKGIDESLLKRLKEVLKRLRDEHREHHEDLKRRLKELKDKHEKLLRDLKRVLDEIRERVKEVKRDLKDEEEVIEKTLRDVERRLRDLEDKLRKLNEEVEKTIRDLRRSSEALNKKVKDLIKKLLDEVK

SEQ ID NO: 21232 - protein, 185 aa, Artificial Sequence; identical to SEQ ID NO: 21231
  Synthetic sequence.

SEQ ID NO: 21233 - protein, 185 aa, Artificial Sequence
  Synthetic sequence.
TLDEVAKEIEELLRRVEEENRKSLEHSERVLDEVRERNERSARHSEEVLRRLREEVRRKGIEEDKLRELEKRLEELRDDHRKHHEDLKRTLDELRKRHEDHHRRLKEELDRIRDEIRKVRRDLKDNEKVIKETLDRVRETIKRLIKSSRDLNEEVKRRIRELIESSRKKNEDVKKTIEELLRRVK

SEQ ID NO: 21234 - protein, 185 aa, Artificial Sequence; identical to SEQ ID NO: 21233
  Synthetic sequence.

SEQ ID NO: 21235 - protein, 185 aa, Artificial Sequence
  Synthetic sequence.
TADEVLKEIEDVHRRVNTENRKSIEHSKKVLEEVRRTNEKSIEDIERLLREVEKRIRDKGTEEDLLRKLEKVLDEIRKRLEDHHRTLEEVLRRLEKEHEKHHRELEEVSKDAKKKLDRLRKDLKDDEDVLRKALEENERLIRELEESSRRLNERVKELIRELEKSSKRLLDEVKKLIDELREEVR

SEQ ID NO: 21236 - protein, 185 aa, Artificial Sequence; identical to SEQ ID NO: 21235
  Synthetic sequence.

SEQ ID NO: 21237 - protein, 185 aa, Artificial Sequence
  Synthetic sequence.
TLEEVVEEIRRRHEEVNRRNRESVENSREVLERVEEDNKDSLRRIRELLERVARKLDERGVDETLKRKLEETLERIERELRKHHEELKETIERLERKHEEHHRRLEKVSRDAEREIEKVKRDLKDDEDAIRDMLRRNEERLRRLIESSEKLNRESRDVIRKLIESSRDLLRKVKETIEKLEEEVR

SEQ ID NO: 21238 - protein, 185 aa, Artificial Sequence; identical to SEQ ID NO: 21237
  Synthetic sequence.

SEQ ID NO: 21239 - protein, 185 aa, Artificial Sequence
  Synthetic sequence.
TLEEVVRDIERVHEEVNESLKRVNETTTDMHRRLNEEAKRVLEEIEKLLKDVEKKIRDKGTEEDLLRKLKETLDRIRKKLEKLLRDLKRKSDEAKKEDEKLEEELRRRSEDVKRKLEEVRKKLKDDEDAVKRELDRNREEIKKLEKRIRDVLKKNKDLIDKVREELKRLLDEVKKRIDKLAEEVK

SEQ ID NO: 21240 - protein, 185 aa, Artificial Sequence; identical to SEQ ID NO: 21239
  Synthetic sequence.

SEQ ID NO: 21241 - protein, 184 aa, Artificial Sequence
  Synthetic sequence.
SLDEAAKEIEELLRRSHEELKRVVKEIRDLLRRSHEELRRALEEIERLLDEVRRKLEERNVSEKLKKELEEVVKKVRDDLKRIREENKDDIRRLEKKLDDLRRKNEELIKKLREDLRRLKEEPVDDETVKELLRRVRKLVRESIEEVKTLLREAEEKVRRNERKVEEILRRVRETIRRLEERIK

SEQ ID NO: 21242 - protein, 184 aa, Artificial Sequence; identical to SEQ ID NO: 21241
  Synthetic sequence.

SEQ ID NO: 21243 - protein, 184 aa, Artificial Sequence
  Synthetic sequence.
SLDEALERIRRMLKRSHDENRRVAEDIKRLLEESHRENERVVKEIRDVLDKLREDAERNNISEELRDRLRRVVEDVERKLRESTKKNKKLIDDLRKRLEESSKRNKERIDELEKRLEDIKRKPVDDEDVKRLLDDVRRTVEENIRRSETELRDVKRRVTETIRESERLLEEVKRIIDKLREEAK

SEQ ID NO: 21244 - protein, 184 aa, Artificial Sequence; identical to SEQ ID NO: 21243
  Synthetic sequence.

SEQ ID NO: 21245 - protein, 184 aa, Artificial Sequence
  Synthetic sequence.
GLDEVLKEIRELLKESHDRLRRVLEEIEKLLEDSHRRNEEVVRRIRKVLEEVREKAERDNISEELRKKLEKVVREVEKRLEESTRKNRKLIEDVRRELEELKRKNEKVLDDLEKDLKRAKDEPVDERLVKELLDRARDKIRRNIEELERKLRAVEEKVRRTIRESEELLDRVRKIIEDLEREAT

SEQ ID NO: 21246 - protein, 184 aa, Artificial Sequence; identical to SEQ ID NO: 21245
  Synthetic sequence.

SEQ ID NO: 21247 - protein, 184 aa, Artificial Sequence
  Synthetic sequence.
DLDEALKEIERLLEEVERRNKEVLERIRRLLKRSHEELKRVLEEIEKLLRDLKKRVDDGNVDDELRKRAEKVIREVEDKLRRIEEKNREMIKRLEDELRRSSEELKKEVKRLRDELKDIKDKPVDRDSVRDLLRRAKERLDELIKTSKELLDRARKKVKENEEELRELLKDVRRIIKKLTEEVR

SEQ ID NO: 21248 - protein, 184 aa, Artificial Sequence; identical to SEQ ID NO: 21247
  Synthetic sequence.

SEQ ID NO: 21249 - protein, 182 aa, Artificial Sequence
  Synthetic sequence.
SELEDLLREVKELIDRLIDDSRRLVKTAEELIREAIKRSEDLLEEVKRLIDRVTEMVERGELDEDRLRELERRIAELIKRSKELSDELRRRIEKIIEDSKRRTEEALERIRRKIEELKKKRDDERVREVLERIKRLLEELKKRDEDSVREIERLLEELKRRNDRVVDEIRKLLKELAERVKK

SEQ ID NO: 21250 - protein, 182 aa, Artificial Sequence; identical to SEQ ID NO: 21249
  Synthetic sequence.

SEQ ID NO: 21251 - protein, 184 aa, Artificial Sequence
  Synthetic sequence.
DLDEVIRELEKLLKESHEAVKRVIKKSEDLLRDSHKKVKDVIRRSEDLLRKLEEEVRKNGLTEIEKRLRERAKELRDDAKRLEEENRKIIEDLERHARDLERKNRRIIEEVRRLLKEIKDRNSDDRTLLEELRRRIEELLKENRELLKRHEDKSKKLLEDNERLLREHAKKSDEIRRELRERVR

SEQ ID NO: 21252 - protein, 184 aa, Artificial Sequence; identical to SEQ ID NO: 21251
  Synthetic sequence.

SEQ ID NO: 21253 - protein, 178 aa, Artificial Sequence
  Synthetic sequence.
DEVERAKDVLDELRRRVEEELRRWKETSERLREESERALEKSEARLREAAEKLERVKRNNVSEDELKKLIDELDRILKELRKEHKELVEKWKKTIDEVRETLKRLLDKLEEILEKLARDGVDEEVLRDIREKLRELAERLKRLLDDDKRVLDEVRKANEDLLRKIKEDIEELRKELEK

SEQ ID NO: 21254 - protein, 178 aa, Artificial Sequence; identical to SEQ ID NO: 21253
  Synthetic sequence.

SEQ ID NO: 21255 - protein, 178 aa, Artificial Sequence
  Synthetic sequence.
DEDEEVKRTIEELRKEVEKTLREIEKSLKESEDKSRKHLEEVKKSLKETEEEVDELKKRNVDKEDLDRVVKKMEDNLKRLEDTARKLVREMRENLKRIKKRLEELTERLERTLDELRRRGVDEKVLRELEERVRRLKKELKRVLDDYKRKLEEAERRNRKVLKEYEDSLRELADRLRR

SEQ ID NO: 21256 - protein, 178 aa, Artificial Sequence; identical to SEQ ID NO: 21255
  Synthetic sequence.

SEQ ID NO: 21257 - protein, 178 aa, Artificial Sequence
  Synthetic sequence.
DEDREVRKTIEKLKRDSERHLEEMKRSAEESRKEVDKLLKKIKDSLRRTEERVRRLKKNNVSEEEVERLVREARENLERLREELERLERELRANLERLRKTAEDLTRRIRETLKELEDRGVPEEVLRELRKIVEELRKRNEDVLEEYERILRELKERLDRVLKEYEDRLRELEKELRD

SEQ ID NO: 21258 - protein, 178 aa, Artificial Sequence; identical to SEQ ID NO: 21257
  Synthetic sequence.

SEQ ID NO: 21259 - protein, 178 aa, Artificial Sequence
  Synthetic sequence.
SEAEKAKETIDRLADRVRKLLEEIKRSLDDSRRKSKETVEENEKTLDRMRKEVDAAKERRVSEEELERLIRKLKKTLDELRRRHEKLVEDLRRNLERIKRRLEELTREMRETLERLAREGLDEEVLRTLEEIIRRLTKELEDVLREYERELRRLEEENKRVIDKTEEEIRRLADRLRR

SEQ ID NO: 21260 - protein, 178 aa, Artificial Sequence; identical to SEQ ID NO: 21259
  Synthetic sequence.

SEQ ID NO: 21261 - protein, 178 aa, Artificial Sequence
  Synthetic sequence.
EEDERADETLKRIKRESDETVKKNERTITELLKRVKRLVDEIRKSLEETARRVDSAKKRNVSEDELRKLVKELEDNLRRIAEELRRLEEELRRILEKLAEDHKRLIDKIRKILKDLADRGVSEEVLRKFRKILEEAAELNKEVIDRSRKIIEDASRLLREVLEDYETKLRELKDKLDT

SEQ ID NO: 21262 - protein, 178 aa, Artificial Sequence; identical to SEQ ID NO: 21261
  Synthetic sequence.

SEQ ID NO: 21263 - protein, 172 aa, Artificial Sequence
  Synthetic sequence.
SLKEVIDDLERIIRELEKRNREVIKRVRKIVREAEEKNEDVIRKLKETIERLERELDDEDLLRELREKLRRLVEHVKKVIEDLREEIRRLEKHVEDEIKKSKDRLDELTKRLKDLDSRELRDEIRKIKKKNDEHLKRLEDELRKLLEKSDRHVKELEDRIRKAAKEVKDAKD

SEQ ID NO: 21264 - protein, 172 aa, Artificial Sequence; identical to SEQ ID NO: 21263
  Synthetic sequence.

SEQ ID NO: 21265 - protein, 172 aa, Artificial Sequence
  Synthetic sequence.
SLEDVIRDLARIIEEAERRNKTVLDELRKTIKELVEENEKVLDEDDKKSRELEKRLDKEELLDRLRKENKKLKDHVRKKNEEAKKRLKELEDHVRRVIEELKRELDKLRREAKDLGSRRLREEIKRLLRESEKHVEDLRREIERIKRENEEHLKKWRRDSERLEKEVEDAKR

SEQ ID NO: 21266 - protein, 172 aa, Artificial Sequence; identical to SEQ ID NO: 21265
  Synthetic sequence.

SEQ ID NO: 21267 - protein, 181 aa, Artificial Sequence
  Synthetic sequence.
DELEKLRDDARRIEEKHRRTVEKDKDVVRRMDKEVKDHVRRLKELAKKLEDDVRKRGDEKVIKELEEKLKRIHEESEKTKRKLKEDADRLEEDNERVKKESEDKLRELRERARKVKEDGIDKRSVDEVLREITEIVERVMELNDKSVEETRRIVERLKEEIDTVNDEIAKIVRKVIEEIKR

SEQ ID NO: 21268 - protein, 181 aa, Artificial Sequence; identical to SEQ ID NO: 21267
  Synthetic sequence.

SEQ ID NO: 21269 - protein, 181 aa, Artificial Sequence
  Synthetic sequence.
DELERLKEAAKRLADEVKEHVDRSRENAKRLKEEVEEHVKRLEDVARTMDEEVKRRGDDRVVKRLREILKKLHEESERTIRRMRRNLEENHRRTEESKKRLRDKLEELKRRLEKFKEDGVDKESVDRVLKEIEDIVRRLEERLDESNKELKEIVDDVTEKLERVNRKIAEIVKRLSDEIRK

SEQ ID NO: 21270 - protein, 181 aa, Artificial Sequence; identical to SEQ ID NO: 21269
  Synthetic sequence.

SEQ ID NO: 21271 - protein, 181 aa, Artificial Sequence
  Synthetic sequence.
DELEELRRAAEEMEKEVREHVKRSEKNAKDLEKEVREHVKKLREVLRRLTEKVKRRGDERVIEDIRRTLKELKDESDETEERMRRNLEENHRRTEESKRRLEEKLERLARKVEEVKRKGIDKEKVDRVLEEITREVERLKKELDESNERLERIVRKVIEELRKVDEDAEERVRRLEEEIRR

SEQ ID NO: 21272 - protein, 181 aa, Artificial Sequence; identical to SEQ ID NO: 21271
  Synthetic sequence.

SEQ ID NO: 21273 - protein, 181 aa, Artificial Sequence
  Synthetic sequence.
DDLDRLREAAERMAREVEDHVRKLKDLIRRVRERVERHVKKLEDDLKRVKEEVDRRGDKKVVDKLRRDLERLRRETEKSKRELEEDLKRAKDESRKTLTRLRDALERLREEVKRVEDKGIDKDKVRKVLEDIKRIVDRLEERIREVDKDLERIVRELMKRLDEVNKRLEDTVRRLSEEIRR

SEQ ID NO: 21274 - protein, 181 aa, Artificial Sequence; identical to SEQ ID NO: 21273
  Synthetic sequence.

SEQ ID NO: 21275 - protein, 185 aa, Artificial Sequence
  Synthetic sequence.
DLIEEIKKLAEDHHRRVKEVLDRNREVAERLKKRVRRIVEENKRLAEDVTRKIKELKRRVKDRDELRRRVEEIERRLKKHIDDSNRRITELKEEVERHLERSERELEKSKRDLERKLREVEKRKRTEDLRRVLEELREIVTRNEKEIRDTIRELEEIVKRLKEDNDRSVRELERILEELREELER

SEQ ID NO: 21276 - protein, 185 aa, Artificial Sequence; identical to SEQ ID NO: 21275
  Synthetic sequence.

SEQ ID NO: 21277 - protein, 175 aa, Artificial Sequence
  Synthetic sequence.
DSDEEVRRVLEKVEEDVRRLAKDIRDSVRRSEERIDELVKKLEKSIDESRRRVETTADNVEELKKIIKDSKEELKKVVKTVRKVLEDSKRELEKVLEDVKRTIKDLKDEVRKMREEGRVDERLLEEIEKVVEDLRRKAEELIEKNERLLRRLEEVAKELDKRNKELLEELIRRNE

SEQ ID NO: 21278 - protein, 175 aa, Artificial Sequence; identical to SEQ ID NO: 21277
  Synthetic sequence.

SEQ ID NO: 21279 - protein, 175 aa, Artificial Sequence
  Synthetic sequence.
SEADKVREVLKRVKEEIDRLVEEIEKVNRDSRREVEKLVEKLRKSLKESKDRIARDLDRVDEVRKILKDSKERLEKVIREVRKAIKDTHEELRKRVEDVERELKRLVEEVEDMIRRGNVDEELLRKIEEVLRRLTEDAKRLIRRNREILKELRELAKRLDEENKELLDELIKKAR

SEQ ID NO: 21280 - protein, 175 aa, Artificial Sequence; identical to SEQ ID NO: 21279
  Synthetic sequence.

SEQ ID NO: 21281 - protein, 182 aa, Artificial Sequence
  Synthetic sequence.
SMIEKVREVLKEVADRVRRLLEENKKSIDDSARALEELIKRIRESLRKSEEDLKREVRGEEERRKVRRLLEESKRKIDEDEKRVEKRLRDSEKSSRDLAEDLRRVLEDIERKIEEVAKRLKDDSEFVKRILDEVDEILKRLERRVKEHSRKNREELEKIRKEAEEILRENEELLEKIVRDAR

SEQ ID NO: 21282 - protein, 182 aa, Artificial Sequence; identical to SEQ ID NO: 21281
  Synthetic sequence.

SEQ ID NO: 21283 - protein, 182 aa, Artificial Sequence
  Synthetic sequence.
EMVERLEESIDRSRKELDRLIEENKKVLEEVEERVRRLIEKLKRSIEESEERLRRKVRGEELAREVKKLLDDSRRRLEELKERAERVLRELKKSSEDLARDVKRLLKESREKLEELARKLKDNDEVVRRLNEENKKLLEDIRRRAKDHSRRVREILEDLEREVEKMNEENKDLLERIVRRAK

SEQ ID NO: 21284 - protein, 182 aa, Artificial Sequence; identical to SEQ ID NO: 21283
  Synthetic sequence.

SEQ ID NO: 21285 - protein, 182 aa, Artificial Sequence
  Synthetic sequence.
SMIEALKENIRRSEEEIRRLIEEWRKVSEDIEREVKKLIKELEESIDESAKRLREKVRGEEELTRVEKLLRDSEEELKRLAEELEEVLKRNKDKVKEEVERARKLLDDSRRKLEKAERDLKDDSDFVRKLLEENNELLKEIKKRVEKVLEESKELLKELREKIRRLNEKNKKLLEEIVRRAK

SEQ ID NO: 21286 - protein, 182 aa, Artificial Sequence; identical to SEQ ID NO: 21285
  Synthetic sequence.

SEQ ID NO: 21287 - protein, 178 aa, Artificial Sequence
  Synthetic sequence.
SEIEKVVKDLRERLKELRESVKRLDDKNRELLERLEREVEEMDRRNEKLLRDLKRQDRDEKDLRRVIEKSKEDLRRLEEKLKEVIKRSEEELEEHVKRTRDVIERLKRRVEKLARDLDKEELLRTLEKVLREIAEELERLNRKVRESIRESARRLKRLIEKLERSIRRSAEELRKRAK

SEQ ID NO: 21288 - protein, 178 aa, Artificial Sequence; identical to SEQ ID NO: 21287
  Synthetic sequence.

SEQ ID NO: 21289 - protein, 178 aa, Artificial Sequence
  Synthetic sequence.
DEIDKIVKKLRDILREIEKRAKEVNKRNKELLDELRERVKDLDRTNEELLRELKDSDRDKKDMERVIRESEDRLRKLEEELRRVIERSERELRRLEKEARDVIEEMERDVRRIAKDLDSDKLLKKLKDVLDEIAERIKELIRELRESIKKSAEELKRLIDRVRRSIEESAKRLEDRAR

SEQ ID NO: 21290 - protein, 178 aa, Artificial Sequence; identical to SEQ ID NO: 21289
  Synthetic sequence.

SEQ ID NO: 21291 - protein, 178 aa, Artificial Sequence
  Synthetic sequence.
SELEKILEKLRRIVEELAKSVRKLNEENKELLKRLADSVKKLDDDNKRLLTDLRRRDNDEKDAKRVIDKSRDDLRKHVERSREVIEDSKRKADKHVEDTKRVIETLKREVDEIARELDSEELLRTLEDVLRKIAEDLERMNRELKRSIKKSADDLKRLNEKVKRSIERSAEELRKRRT

SEQ ID NO: 21292 - protein, 178 aa, Artificial Sequence; identical to SEQ ID NO: 21291
  Synthetic sequence.

SEQ ID NO: 21293 - protein, 178 aa, Artificial Sequence
  Synthetic sequence.
DEIKKIVEEIKKTLEEIDKSVRELIRRAREILRELEESVRELIRRNSKLLEDLRRQDRDEKDARRVIEESRRELEEHRKRSEDVIRKLREEVEKHVRETEEEIKRIEDEIRRLKEKLDKDELLKELEDVLKEVAEEIKRLNERLKKVLEEIERTLRELNRRLEENIRRSARALEETRR

SEQ ID NO: 21294 - protein, 178 aa, Artificial Sequence; identical to SEQ ID NO: 21293
  Synthetic sequence.

SEQ ID NO: 21295 - protein, 178 aa, Artificial Sequence
  Synthetic sequence.
SEVEDLLRRIEKILEDLRRSVEELLKRIEDALRRLEEEIRKVTEESKRLLEDLTRRDTDEREAREMIKENEKKLRDLEKKLRELIKRLKEEVDKHVKDTRDVLTRIREEVRKMAEKLDKRELIEEVEKVVKRVEEALKRLNDRVRETLDEVRKRLEDAIRRWREESERIARELEKRTT

SEQ ID NO: 21296 - protein, 178 aa, Artificial Sequence; identical to SEQ ID NO: 21295
  Synthetic sequence.

SEQ ID NO: 21297 - protein, 178 aa, Artificial Sequence
  Synthetic sequence.
SEADEIVRRIEELLKELEREIRKVIRDSERLLKELEDSVRELLKKIRDVLDELTKSDRDEKEARDVIRKLAKEVEDHLRRSKEVIDRNRKKLEDAEEKLKELIERIKREIDEIKRRLDSEELLRKLEAVLDKVKKDLKKMIDDWRRVSERIARELEKLNRRVKEELDRVKEALDERTR

SEQ ID NO: 21298 - protein, 178 aa, Artificial Sequence; identical to SEQ ID NO: 21297
  Synthetic sequence.

SEQ ID NO: 21299 - protein, 178 aa, Artificial Sequence
  Synthetic sequence.
SEIDEVVERIKRTLEEAEKRVKKASEDHKRRLDELRKKVEKLIEDNERTLEAVARRKIDEELLKELEKESEDRLRKLKRDAEEVTREMKKTSDELAEELKRLKDEIRKELERLEREGIEERLLRKLRKVVKDVDDRLKELLEENRDVVRRIKEELEKLLEKVRRSIEESRRRMRETRR

SEQ ID NO: 21300 - protein, 178 aa, Artificial Sequence; identical to SEQ ID NO: 21299
  Synthetic sequence.

SEQ ID NO: 21301 - protein, 178 aa, Artificial Sequence
  Synthetic sequence.
SEVDEVLKDIRRILEEARKRVEELDRENKRILDEVREKVKELNERNKEILRAAEERKIDDDLLRKLVEDSRRLLKELEEELRRLTERSKKLLKELAEEMDRLVKEIEDKLRKLREDGIDEKLLRDAKRVVEEVSKALKDLLKEVEDSVRRSKREMEKLLEELRESVKRSEEELRRTSK

SEQ ID NO: 21302 - protein, 178 aa, Artificial Sequence; identical to SEQ ID NO: 21301
  Synthetic sequence.

SEQ ID NO: 21303 - protein, 182 aa, Artificial Sequence
  Synthetic sequence.
DEVEDLLRRNEELLKRLLEEIKKLTDEHREELKRLAEDVKKVVEDVRRLLKELEEMVRRGELDEKTLDEARRRLEKLLKELKEKIDRVKEEMEKSNRKLEKKIRDAKRTTEEILKRLKDKGVDEKLVRKLEESVRRSTEELEKALKRNNDVIRRIAEALDDLLRRLEKVIREIEKKLRDDTR

SEQ ID NO: 21304 - protein, 182 aa, Artificial Sequence; identical to SEQ ID NO: 21303
  Synthetic sequence.

SEQ ID NO: 21305 - protein, 182 aa, Artificial Sequence
  Synthetic sequence.
DRVEEAVKDIERLLRELKRDVERLVRENEKILKDAKREVDELTKDHRRKVEELDEMVKRGELDKDTVDRVKKEMKETNEDLSRKATEIKKRSEDILRRLEEKIREVRKRLEKLLEELRREGVSEDLLRKLEKVVRDVEKKLRKLLEDLKRSIDRSTRELEKLNEKNNEVIRDIERRLDEAET

SEQ ID NO: 21306 - protein, 182 aa, Artificial Sequence; identical to SEQ ID NO: 21305
  Synthetic sequence.

SEQ ID NO: 21307 - protein, 178 aa, Artificial Sequence
  Synthetic sequence.
SEIEKLIEEIRRVVKEIKREVERAIRENEKLLRESKRRNDELIKEIERVVEELKKRNVPEEDVRKVLADLEKKLEELHREDRKLIKESEELLKRLMEEAEKILEELKRRLDELIRRRGRDRLIEELEKVLRDVEKVARDVLRKLRRSIEESRRRSEELNKTVKKVLEDVARTATERSR

SEQ ID NO: 21308 - protein, 178 aa, Artificial Sequence; identical to SEQ ID NO: 21307
  Synthetic sequence.

SEQ ID NO: 21309 - protein, 178 aa, Artificial Sequence
  Synthetic sequence.
REIEEAIKDVERVLRESEERNRRLIERIKRMLKKSEDENRKFIEDNKRLADDLRRRNVPEEDVRRTIERSRRELEKLVKRDEDLLKRLEEELRKLHEDDRRLLEELERKVEDIIRKRGRTEDVERLRKVIEEVKRRMKELNERLKEELREVAKRSRDLNKELRESIEESADRARRRRK

SEQ ID NO: 21310 - protein, 178 aa, Artificial Sequence; identical to SEQ ID NO: 21309
  Synthetic sequence.

SEQ ID NO: 21311 - protein, 178 aa, Artificial Sequence
  Synthetic sequence.
DEIERLREDIKRVLEESTRRNKKLLDEIRKALDESRRKNEEAIRRNEEVVRDLKDRKVPDKKVKEVIDRNRRMLEELVRDDKDLLKRLEERVRELHETDRKLIKDLRELLRRIIEKRGETDKVRTLRRELEEVARALEELNRRVEEELDEVRKESERLNKELEDSIRKSAEDAKRTTK

SEQ ID NO: 21312 - protein, 178 aa, Artificial Sequence; identical to SEQ ID NO: 21311
  Synthetic sequence.

SEQ ID NO: 21313 - protein, 174 aa, Artificial Sequence
  Synthetic sequence.
DEKDKAIEDVRDLLRRNEEVARRMDKRLKDLLDTIRKKAEDLDRELKRLLEEAERLVREGTTEELVKKLKKELDDSRRRLEKLIEELRKRLRDSIRELEEHLKRSEEELRRLLEEVKDVKELEKVLEEIRRRSEELLKHHAEVIERIERDVERLRRHHEDTIRKIKEKVDRDRK

SEQ ID NO: 21314 - protein, 174 aa, Artificial Sequence; identical to SEQ ID NO: 21313
  Synthetic sequence.

SEQ ID NO: 21315 - protein, 174 aa, Artificial Sequence
  Synthetic sequence.
DEDREAIKEVEKLLRDNERVARRLDEEVKELLDEMRRRSEEMDRELERLLEEAKRLADKGTREELVKELEKRLDESHDRHRKLVEELEERLERSIEELRKHLDDSRRRLKELEDRVDKVEELKEVLREVDKRSKELLKHHKRRIEEVRKRVRELNKHHEDVIRKIKKKVREDRK

SEQ ID NO: 21316 - protein, 174 aa, Artificial Sequence; identical to SEQ ID NO: 21315
  Synthetic sequence.

SEQ ID NO: 21317 - protein, 174 aa, Artificial Sequence
  Synthetic sequence.
KEAEEAIKRVEDLLRRNKEVAERIIREIRRLLREADETSKRMDEDLRRLLREAEDLVRRGTTEEVLEELKERLKESHKEHKKKVDELIERLRKLLEDLERHIRKSDRDLDRLREEVKDVRELDKVLERVKRESDRLLKEIEKVVREVEERLRRLNEHHEKVIREIEKKLEDDRR

SEQ ID NO: 21318 - protein, 174 aa, Artificial Sequence; identical to SEQ ID NO: 21317
  Synthetic sequence.

SEQ ID NO: 21319 - protein, 174 aa, Artificial Sequence
  Synthetic sequence.
DEDREAIERVRRLLDENRKVVEELDERLKELLRDAEEKSRRVIKTLRELLKEIEDLARRGTDREVAEKLRRALEELHRRHREMVKELKERLERSIKRLEEHIRKSKEDLDDLRRKVDKVDELRKVLEDVERASKELLDHHRDVIRRIEEELKRLNKELEKVIREIERAVEELER

SEQ ID NO: 21320 - protein, 174 aa, Artificial Sequence; identical to SEQ ID NO: 21319
  Synthetic sequence.

SEQ ID NO: 21321 - protein, 174 aa, Artificial Sequence
  Synthetic sequence.
DEDRDAIRKVEDLLRRIEEIVRRLIEEVKRLLEDNRRKSKRFIERVDELLKEMEKLVREGTDAEMVRELKDRLRRLHEEHADHVRDSARRLDELLRELERKIKELEDRLRDLEEKVKDVKELEELLRRVEREVEKLLTDLRRLLREVKETSKRLNEELKRRADEVEKKADEDRK

SEQ ID NO: 21322 - protein, 174 aa, Artificial Sequence; identical to SEQ ID NO: 21321
  Synthetic sequence.

SEQ ID NO: 21323 - protein, 181 aa, Artificial Sequence
  Synthetic sequence.
SSKDRIRKVLEEVRETLDRLAKRIEKSLRDSAKRVEDLAEENRTSLKETKERIDELIKRRKDRDRAEEVKKRLDESRRHVEEDEKRVREDLRRSADEARRVLDELRKTLEKLRKEVEDVIREGKLGEELIRRIEEELKRIEDTVEKIIRKDEKLLEDIERESERHIREDKELLKELEKEER

SEQ ID NO: 21324 - protein, 181 aa, Artificial Sequence; identical to SEQ ID NO: 21323
  Synthetic sequence.

SEQ ID NO: 21325 - protein, 181 aa, Artificial Sequence
  Synthetic sequence.
SSDKEIEDVLRKVKDELDKLARALDESLKRSEKDIDRLEEELKESHDRTREEIRKLIEERNVDKLAEDMKRKLKESLKEAREVVDEVRKRLERSRREIEKMIKKLEEDLRTLERKVREVIKRGRLGDELIREIKKVLDRIREEIERLLREDEELLERLREDAKRILDKNKELLDELRRRVK

SEQ ID NO: 21326 - protein, 181 aa, Artificial Sequence; identical to SEQ ID NO: 21325
  Synthetic sequence.

SEQ ID NO: 21327 - protein, 181 aa, Artificial Sequence
  Synthetic sequence.
SADRKLEEVLKKVEDDIRDLERRLKRSLDESKREVERLERENRRVLEEVEKKVRADNVDEERLREIKRVVDEAKESLRELVRRMRKVLEDSTREIEELRRRLREVLKEIRKEVKEMRDRGESEETVKRIIEKIERILRKLKRDAERILDKDRKLLKKLEEESRKHIEDVKRLLEELERRTR

SEQ ID NO: 21328 - protein, 181 aa, Artificial Sequence; identical to SEQ ID NO: 21327
  Synthetic sequence.

SEQ ID NO: 21329 - protein, 181 aa, Artificial Sequence
  Synthetic sequence.
ELEEKLKRSLEDSRRRVEELRRTNEEVLREVEEEIRRLIKENEDSLRESKKRVDDRNVEREKLEKAKKVLEDSERSLRKLAKEARDVLREMRETLRKLEEKMERVLRESEKEIRRVATRGESKETVDKILEDDKELLRRLEEESKRHIDEVRKILEDLERRSRRHIEEDKKLITELEKETK

SEQ ID NO: 21330 - protein, 181 aa, Artificial Sequence; identical to SEQ ID NO: 21329
  Synthetic sequence.

SEQ ID NO: 21331 - protein, 181 aa, Artificial Sequence
  Synthetic sequence.
DLDERLRRSLKRSKEEVERLRKENEEVLRRSKETTKELIKTNEKVLEDVERLVRESNVDEERLRKAKEVLDRLRESLKKLAEESRRLNKRLEETLRKLVRDMEEVLRRSEEKIKEVDTRGESRETVEKIIKEDEDLLRKLKEESDRHIKDVERVARENERESKRHIEEVRKVLDELREETR

SEQ ID NO: 21332 - protein, 181 aa, Artificial Sequence; identical to SEQ ID NO: 21331
  Synthetic sequence.

SEQ ID NO: 21333 - protein, 181 aa, Artificial Sequence
  Synthetic sequence.
SAEEKLEEVLKRVAERIEELIRRNRRVLDRVREEIKRLVEENRKSLDESERRVRERNVSREKLERAKELLDRSKDSLRRLEEELRERLKDLERTLKELEERAKRKLEEIKKEVKDVADRGESEETIERIIKKIEDILRKLEEESERHIRRVEEELKEMEKRSREHIEEDKRLLEELERRTK

SEQ ID NO: 21334 - protein, 181 aa, Artificial Sequence; identical to SEQ ID NO: 21333
  Synthetic sequence.

SEQ ID NO: 21335 - protein, 181 aa, Artificial Sequence
  Synthetic sequence.
SAEDELRKVLEKVREDIDRLADENRKVLKRSKDETKRLIKENREVLERVEEIIRRDNVDRKDLEEARRVLEEARRSLEELVERSKRLNDRLEETLRELIKEAKRVLEEAEREVREVATRGESEEAIERIIRRIREILERLRKKSEEHIRRVEDVARRNEEESREHIKTVEKILEELKRKAD

SEQ ID NO: 21336 - protein, 181 aa, Artificial Sequence; identical to SEQ ID NO: 21335
  Synthetic sequence.

SEQ ID NO: 21337 - protein, 179 aa, Artificial Sequence
  Synthetic sequence.
SEVEELIKRLKKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRKEVEELDRRIEKVLKEIEEKIREVIKEWERVHREVNELLKRLIDENRKVLDEIRKLLEEKSK

SEQ ID NO: 21338 - protein, 179 aa, Artificial Sequence; identical to SEQ ID NO: 21337
  Synthetic sequence.

SEQ ID NO: 21339 - protein, 179 aa, Artificial Sequence
  Synthetic sequence.
SEAEDLIRRLKEVLDELKKKADDLIRDTKRLLDEIRKKSEDHIKRDKELLKDLKRRDTRKDEAKRVLEESERTLRELERDLERLLEKDRRDMEEMVKELRRVLEELRREVERLKEERKEVDRALREIEKVLKEIKELIEKVIRDWKRVHDEVNEELRRLIEKNRKSLKETADELDRKRK

SEQ ID NO: 21340 - protein, 179 aa, Artificial Sequence; identical to SEQ ID NO: 21339
  Synthetic sequence.

SEQ ID NO: 21341 - protein, 179 aa, Artificial Sequence
  Synthetic sequence.
SEVEKLIKEDKELLERLKRDVERLIEELRRTLKELKKESEKHIEDDKRLLDDLRDRDTDDKVAKDALRRSKETLEELVEKLKRVLDELRKKVKELMDRARRVLEESRKRVEELKERRKEMDKLITDIRRSLDETRRRIEKLIREIEKVLREIEETLRELEKRNRESLERTRETLERKSK

SEQ ID NO: 21342 - protein, 179 aa, Artificial Sequence; identical to SEQ ID NO: 21341
  Synthetic sequence.

SEQ ID NO: 21343 - protein, 183 aa, Artificial Sequence
  Synthetic sequence.
SEVDELIERDKKLLRDVERDVRRLNKEVRDILDEIRKDVEDALKENKELLDRLREMVKRGEADERTAEELRKTSEDLLRELEKRAREIEERLRRTLEELAKRLERVIRESRKLLEDLRRRRREMREVLKRLEDSSKDTTDKLRELLRSHKKVIDEVREKLKELLDRYRKVSDEIREEIDRARK

SEQ ID NO: 21344 - protein, 183 aa, Artificial Sequence; identical to SEQ ID NO: 21343
  Synthetic sequence.

SEQ ID NO: 21345 - protein, 183 aa, Artificial Sequence
  Synthetic sequence.
SEVEKLIEDDRKLLEDAEEEVRRNNREIERILDKAREDVKRIIKEIEDLLREADEAAKRGEVDEDVVREVAKRIRDLLEELRRRAEEIKRRLDRSHEELRRALEEVDKRSKELLDDLRRRKKDAEEAKRRIKKSIDDSRRELKRLLESNRKVIEEVKKTLEELIRTLEEVVRRVEDRLKKLAD

SEQ ID NO: 21346 - protein, 183 aa, Artificial Sequence; identical to SEQ ID NO: 21345
  Synthetic sequence.

SEQ ID NO: 21347 - protein, 185 aa, Artificial Sequence
  Synthetic sequence.
DSVEELLKRLRDLLEESKRRAERLIREIERLLRESEKRVRELNRRLEELLREAEDRVRKEGPTERLEELVEELKRRLKRSSDELKKHLDESRKRLKEIIEEVERHIERSVREMRRILEELRKEGAPEDALRKLEKVIREIEREHRRLLEEIRRVLKEVDKRHDEVRKSHEDVIRRIEERLERLKK

SEQ ID NO: 21348 - protein, 185 aa, Artificial Sequence; identical to SEQ ID NO: 21347
  Synthetic sequence.

SEQ ID NO: 21349 - protein, 185 aa, Artificial Sequence
  Synthetic sequence.
DSVERLIEEIRRLLKRSEEIARKLIRDAEKLLEEHRRRVEELNREIERKLEELDEKARRRGPTEELKDTVRKLREDLDRSLEDLRRHSERLKEELDRLLKELEEHIERSKKRLDEIEEEVRKEGVPREALEKIRKVIKEVKDTHRDLLRRVRDVIRRIREASKETERSHREVIERVRKRLDELTK

SEQ ID NO: 21350 - protein, 185 aa, Artificial Sequence; identical to SEQ ID NO: 21349
  Synthetic sequence.

SEQ ID NO: 21351 - protein, 185 aa, Artificial Sequence
  Synthetic sequence.
KSVDDIIREIRKLLEDHKRRVDELLERLKKLLEDHRRTVDKLIKDLERLLEELARRVKREGPTERVRKLVKEAEDRMRELTKRLEEHSKKLKDDLRRILEDLRKHSDDLRRRLEKLLREVEEEGVPREALERIREEVRRVEEASERTLRELEKVVRRIERESEKLKRELEKVVEDAKRTLEKLIE

SEQ ID NO: 21352 - protein, 185 aa, Artificial Sequence; identical to SEQ ID NO: 21351
  Synthetic sequence.

SEQ ID NO: 21353 - protein, 185 aa, Artificial Sequence
  Synthetic sequence.
SSIEKLLEELKELAKRHEDEVKKLIRELEDLARKHKERSEKLNEEIKKLLKELADRVRERGTTEEVEEMIKEVRERLERSHDDHRRHSERLERELRRLLKELREHSDRLRRELERILKEVDEEGADERVRRRLRKVVEEIKERSDRTIREMEKVIREIKEESRRLNKSHEEVIRDVKRRADELRK

SEQ ID NO: 21354 - protein, 185 aa, Artificial Sequence; identical to SEQ ID NO: 21353
  Synthetic sequence.

SEQ ID NO: 21355 - protein, 185 aa, Artificial Sequence
  Synthetic sequence.
SEVEDLLRDLERLLEEHRERVERLIKRLRELLERHKRTVEKLNRDVKEKLRKLKKEAEDKGPTEELEELVKRVEEDLRRSLKELREHSERLKRELKELLDRLRDHSRELEERLRRILKKLEEDGAPEEALRRLKRVVEEIKRRSDRLIEKAEEVIRDIEEKSEETLKSHREVLERVKKILTDLRK

SEQ ID NO: 21356 - protein, 185 aa, Artificial Sequence; identical to SEQ ID NO: 21355
  Synthetic sequence.

SEQ ID NO: 21357 - protein, 185 aa, Artificial Sequence
  Synthetic sequence.
DEIDRLLEDLRRLLEEAERRVTEIIKRIKKLLEEHERRVRELNKDLRRLLEEAEDVVRRKGPTEELEDLARKLKETLEESLRRLEEHSRRLEKELRDLIDELRKLIKEVKDRLEEILREVEKRGVPEKARRDLERVVTEIDRELKRLEEDIRRVLEEVKRRSEDLRRSHRRVIEDIKRRLEELRR

SEQ ID NO: 21358 - protein, 185 aa, Artificial Sequence; identical to SEQ ID NO: 21357
  Synthetic sequence.

SEQ ID NO: 21359 - protein, 185 aa, Artificial Sequence
  Synthetic sequence.
KEVEDIIREIRKLLEDHERKVKELIDEIRRLLEEHERTVRDLNRRIKKLLEEAKEFADRKGPTEEADKLIKELTERLKKSLEDLKRHSDELKKTLEEILERVREDSERLEKRLREIEDKIRRDGVPKEMIDRVRKVVEEVKKRSRETLERIRKVIEEVKARSKELIESHEEVIKRVEETLKRLKD

SEQ ID NO: 21360 - protein, 185 aa, Artificial Sequence; identical to SEQ ID NO: 21359
  Synthetic sequence.

SEQ ID NO: 21361 - protein, 177 aa, Artificial Sequence
  Synthetic sequence.
SLEEEIKKLLKEVRDVNDRLKETIEDLAEKIERLAKRMIERIEEILREVDRLVKEVNLPEEMKKRVRDLLERIRRELEELLKELRKLLKRIRERHDELKKRSEENIKRIEDELRKTGEEDVIREILKEIRKHLRDSEEENKKTLDTLRKILEDLTKAAEDILEEIRRELDRLRKEAT

SEQ ID NO: 21362 - protein, 177 aa, Artificial Sequence; identical to SEQ ID NO: 21361
  Synthetic sequence.

SEQ ID NO: 21363 - protein, 179 aa, Artificial Sequence
  Synthetic sequence.
SELEDILRRLREEVKRLREESRKLLEDNRRLVEEVKRESDKVLKRLKDKADRLKELAERGDLDEEMAERVERELRRILEEHKRKSKEIEDESEKLDREHKESTREVVERIKKELDDARRRGIPTREIKTVIDELTRELERLNREHEDLTRKLREELKKLNKRIKDLIDTLKKLLEDLKK

SEQ ID NO: 21364 - protein, 179 aa, Artificial Sequence; identical to SEQ ID NO: 21363
  Synthetic sequence.

SEQ ID NO: 21365 - protein, 171 aa, Artificial Sequence
  Synthetic sequence.
SEEEKLRELVKEVEKRTRELNENLRRSIEEVERDTEELDKNLEKSIREVKKVLDDLNLSDDDVRKVEEDLRRLHEEHRRHVERSRRRLEELYRRHERHARESKKELKELEDRGEPAEDVLRRIRELLERNEEVNRRLDEASKRLLEENRRKNKKLDDDSKELLKRLTERAK

SEQ ID NO: 21366 - protein, 171 aa, Artificial Sequence; identical to SEQ ID NO: 21365
  Synthetic sequence.

SEQ ID NO: 21367 - protein, 171 aa, Artificial Sequence
  Synthetic sequence.
REKERLEKVIRELETKARELNKNLKKSIDDVRRETERLNENLKRSVDELRKRLKDLNLSRDDVERLDEELRKLEREHHEHVERSDRELKKLYDRHEETIREVEERARELKERDEPAEEVLKELRKLVEELERRNRELDKRSKDLLRENRELNKDLDRKSRELMERVERKTR

SEQ ID NO: 21368 - protein, 171 aa, Artificial Sequence; identical to SEQ ID NO: 21367
  Synthetic sequence.

SEQ ID NO: 21369 - protein, 171 aa, Artificial Sequence
  Synthetic sequence.
SEEEKLERLIEDLERKLKELNDNLKESIDRVRKRTEELNRNLRESIKRVKEELERQNLREDTVRDLEEKLRELHKRHEDHARRSDKRLKELHKEHEDLIREVEKRLRELRRRGEPAEEVLRELEKLVEDLERENRRLDKESKDLLEENKKVNKDLDDESKRLLEEVSKEAK

SEQ ID NO: 21370 - protein, 171 aa, Artificial Sequence; identical to SEQ ID NO: 21369
  Synthetic sequence.

SEQ ID NO: 21371 - protein, 178 aa, Artificial Sequence
  Synthetic sequence.
SDKEDVTRLLEEVSRASERSRKRWKDSSDEVKRTSEESIRRLRELLERLRERIERVIREKKDDDLRRKLERLLERLERIIRELEKRSKELNDKNEEDAERVTRESKELNDRLKKEIDRDITDVDELRKKIEEIVKRDEDLVRRLLEDSKRLAEEDRRLLEEVKREIDEIRKRIDEEVK

SEQ ID NO: 21372 - protein, 178 aa, Artificial Sequence; identical to SEQ ID NO: 21371
  Synthetic sequence.

SEQ ID NO: 21373 - protein, 182 aa, Artificial Sequence
  Synthetic sequence.
DEIDELVRRIEELAERHHRRVDEIVKRNEEVLKELDERARRLVRENEEVLKRLEETVRREGPRDELAERVEEHLRDSERRVRELERRLEEHIKRSEEELDESTKRLEDELRKVAEELKRRNMEERAEKRLRDVLEKLRRDVERNREEIKKSAEDVRREVKRVTDELKESIERVRKRVKELKD

SEQ ID NO: 21374 - protein, 182 aa, Artificial Sequence; identical to SEQ ID NO: 21373
  Synthetic sequence.

SEQ ID NO: 21375 - protein, 181 aa, Artificial Sequence
  Synthetic sequence.
EAERKVKTVVDELRRIVDELAKELEESLKRTDETIKRLARELERVDRELEEIIKELERKGLSEEEVRKLRETLKKLHEENRRVIEELEREVRESEETLRRVIEEIKKRLEDLRRKLDKLAKDGRVDDEVVRKVEEEAERIKKRIKDLVRRDEKLVEDMRRRIKRLVEKNRKVAEKMRTDTD

SEQ ID NO: 21376 - protein, 181 aa, Artificial Sequence; identical to SEQ ID NO: 21375
  Synthetic sequence.

SEQ ID NO: 21377 - protein, 185 aa, Artificial Sequence
  Synthetic sequence.
DLEELLRKVLEELRKIVEDARRENEKSLRESEKIVREVEELNKKVLEEVEKKIREVIEEKKEDKELVDEMRRVLKELEDRSRKLTDETRKKLKESEEKSRKLTEETKKVLEDLRRKLKEVADRGESEETIKRIVDEIRKEAERLLRRHRKSVKEDKDLAKKIREDHKKSVEDIERTLEELEKRAK

SEQ ID NO: 21378 - protein, 185 aa, Artificial Sequence; identical to SEQ ID NO: 21377
  Synthetic sequence.

SEQ ID NO: 21379 - protein, 175 aa, Artificial Sequence
  Synthetic sequence.
SEIEELVKEIKKVADEVRRRHEKSVREIERKLEELDKKVKDLVDEDKKLADELRRRNEDKETLDRVLKESEEKVRRLARDLERVLRESREESRRLVEDTRRLLEELEDKVRRINAGDRVRRELERVLRDVERIIRDVKRTNKRVDDDVERRIRELRKELEDSLRRSKRIVDEVRR

SEQ ID NO: 21380 - protein, 175 aa, Artificial Sequence; identical to SEQ ID NO: 21379
  Synthetic sequence.

SEQ ID NO: 21381 - protein, 175 aa, Artificial Sequence
  Synthetic sequence.
SEIERLVEEIEKLLRKMAEEHKRSVERDERLARKLKRENEEHIKTDEELVDRLRRRNEDEKRLKEVLDRSEKSMKELKDRNKKVLDESKKESEDIKRRTEKLLEEIEERIRRINAGDRVLRELKRVLDEVKKIIEDVAKENEDSDRRSKKIIEDVVRENKESLDRSREEIERVRK

SEQ ID NO: 21382 - protein, 175 aa, Artificial Sequence; identical to SEQ ID NO: 21381
  Synthetic sequence.

SEQ ID NO: 21383 - protein, 175 aa, Artificial Sequence
  Synthetic sequence.
KEIEELVKRIEDEARRLKEEHKKSVREIEELLKRLTEEVRKLVERDKKLAEDLKDRNEDEKRLTEVLRESEERIRELVKRAKEVLEESRKRSEDLARENRKVLEDLRREVERINVDDEMLRLLEKVLRDWEEIVRRVKEANDDVNRRVEETLRDLKRKLDRSLEDSERIIREVAT

SEQ ID NO: 21384 - protein, 175 aa, Artificial Sequence; identical to SEQ ID NO: 21383
  Synthetic sequence.

SEQ ID NO: 21385 - protein, 184 aa, Artificial Sequence
  Synthetic sequence.
SVEDELRKVIKENEDVLREVEERVETVIKRNREVIEEVAREVERVIEETRRLLKEIEKAGVDEDELRKVEERVRKHAEELRKILEDLRRSSRKLAEEARDILRDLKRTSDELRKEAEKVTKDGDSEESIKRLLEKIRKHSEEVKETIRRLLEKIEEHTERVKREIDKMLRSNEDLMRRIKEEAE

SEQ ID NO: 21386 - protein, 184 aa, Artificial Sequence; identical to SEQ ID NO: 21385
  Synthetic sequence.

SEQ ID NO: 21387 - protein, 184 aa, Artificial Sequence
  Synthetic sequence.
SIKEKLDEAIERNERVLRRVEEEVRKSNEKNKEVLRRVSEEVRKVIEELEDLLRKIAEKGVEEEKLKRLRDELDKIRRELEKRLEDLERSTRDLVRKLERILEELKRTSDELRKEVEEVDKRGTSDETAERLLRKIEKHSREVDETIRRMLEEDERHIKEVEDTIREMLERLKRLIDEAEKDAK

SEQ ID NO: 21388 - protein, 184 aa, Artificial Sequence; identical to SEQ ID NO: 21387
  Synthetic sequence.

SEQ ID NO: 21389 - protein, 182 aa, Artificial Sequence
  Synthetic sequence.
DEVREVLKKIRELIKTNREHVTRLLRTIEELSRRSEEMIRRILEEIEKLIKDVRRLTEEGELTEEKAEKLRRDVEEIVKEAEKRLRDSNEEVKRLVDEHREVNKDLERRLEDEKRRLKEENLPEEMEKLLEEAIKEAREDSRRSDREVEEVLRKHKKVNDRVREEIERVLRKLEELLKKDRT

SEQ ID NO: 21390 - protein, 182 aa, Artificial Sequence; identical to SEQ ID NO: 21389
  Synthetic sequence.

SEQ ID NO: 21391 - protein, 182 aa, Artificial Sequence
  Synthetic sequence.
SEVDEIVRRLEELIRRNTEKVERLLERHERLIRELKERVKELLRKHEELAKEITELTKRGESTDEVIEEIRKRSDELNRRLEETLKRIRDDSRRTLEDLKRHSEKSRKDLEELLRDAERKGTGKEARDRIRKVLEELKKKNKELEERIRKVSKELEKVLEDVKRESEKVSKELRERLERSKT

SEQ ID NO: 21392 - protein, 182 aa, Artificial Sequence; identical to SEQ ID NO: 21391
  Synthetic sequence.

SEQ ID NO: 21393 - protein, 185 aa, Artificial Sequence
  Synthetic sequence.
SELERLEKEARDIVENLKRVLEELAKDVKRLLKESDELLKDLREKVREILERIEELARRNISEELVKEVTKRVRDEVERLRRRLEKVHRDHERTVKRIDEEIRRHVERSEEEVKRVEDEVRRRNMDETAKRELERLVKELRDVHREVEKRLKELAKELREVNKRIKDDLDRLVEALEEVLDRVRR

SEQ ID NO: 21394 - protein, 185 aa, Artificial Sequence; identical to SEQ ID NO: 21393
  Synthetic sequence.

SEQ ID NO: 21395 - protein, 184 aa, Artificial Sequence
  Synthetic sequence.
SELEELKRRIDELLKENEEILRELEERVRRLNKENRDLLRKLEEEAKRLVEEVRRVAEEGRSEEVLDALRRELERIVEEVRRRIEESLKKVEDLLRRAEEVIRETHEKLRKVAEEVREELKRRRVTEVKERIEKVLKDLERRNRESEKEVRRLLKELKESIDDSRRRVDELVKRLRKVLEDIRR

SEQ ID NO: 21396 - protein, 184 aa, Artificial Sequence; identical to SEQ ID NO: 21395
  Synthetic sequence.

SEQ ID NO: 21397 - protein, 177 aa, Artificial Sequence
  Synthetic sequence.
SAEETLEKLIRDLEKSIRKSAEDLERLIRELEKSVRDSAKLLRDLIREVRDVVRDVVRAKGDREEVKEIRDRVEKAVEKLERVIKESEDRLKELVDRARKVIEDSKKELDEAVKELERRKADKDVAERVKELDKRNKDLLKRLEEEVRRLIKENERLLRELAKEVKELLERIKRAAG

SEQ ID NO: 21398 - protein, 177 aa, Artificial Sequence; identical to SEQ ID NO: 21397
  Synthetic sequence.

SEQ ID NO: 21399 - protein, 177 aa, Artificial Sequence
  Synthetic sequence.
SAEDKLRELEKKLRKSIKESADRLRKLNEELRRSVRESAERLKELIREVEEVLRDVVRKRGRTEEVERLEEEVEKLRRELEKVIEDSERELEEHVKRTKEVIDDSKRLLEEMVEELKRRKATEEVEDEVRRLDEENKKLLEDLKRSVDELIERNKRLLEELTKRVKELLDKIRKTAE

SEQ ID NO: 21400 - protein, 177 aa, Artificial Sequence; identical to SEQ ID NO: 21399
  Synthetic sequence.

SEQ ID NO: 21401 - protein, 177 aa, Artificial Sequence
  Synthetic sequence.
SMEDSLRELIRKLRESVKRSAEELRRLNKRVEDSIRDSARKLRELIRRVEEVVKEVVETRGRTDKVDRIKKKVDDLREKLERLIRESEELLERHVEKTRRVIERSKEELDKVEEDLRRREARERVEDDVRRIDDENRRLLEELKKSVDELDKRNEELLRRAEKEVRDLLREIREAMR

SEQ ID NO: 21402 - protein, 177 aa, Artificial Sequence; identical to SEQ ID NO: 21401
  Synthetic sequence.

SEQ ID NO: 21403 - protein, 178 aa, Artificial Sequence
  Synthetic sequence.
DAEEELERLLRESERVSRDSARRLRELLKKLRRSVERSRREIDRLLKELEDVIREVIKRKKEVRELVKKLRDDLEDLTRKLKELVKRSEDLLRKLEEDIERLIETSRKRNKELEDRIRERKADKDLAREVEKVVKEDEDILRRAEEEVERLIETNRDLLRKVEREVKELVEKVEEDER

SEQ ID NO: 21404 - protein, 178 aa, Artificial Sequence; identical to SEQ ID NO: 21403
  Synthetic sequence.

SEQ ID NO: 21405 - protein, 182 aa, Artificial Sequence
  Synthetic sequence.
SELEELKREVDELTEEHKELLKRLTERVKELSERHKELLERLRERSERLVRRIRELAKRGEPKKDLVRELEELLKENNKLLEDVDREMKKTNDELREEIDRVRRRMEKTNKELEKTIKEVNLDDEVLRKAEELLRRNNRVIEEIEKRLRELLKENNDVIKEIRERLEKSNKELRDVAREVAK

SEQ ID NO: 21406 - protein, 182 aa, Artificial Sequence; identical to SEQ ID NO: 21405
  Synthetic sequence.

SEQ ID NO: 21407 - protein, 182 aa, Artificial Sequence
  Synthetic sequence.
SELEELKKKVDDSIRENERLLRELTEDVKRLSKEHKDLLKRLEDKVEELIRRARELAKRGEPKRDLFDELRKLLEKLRKDIEKAKREMERTNTELEKKIRDALRRTTELDKELEETIRRVNLDDDMLEKAKKVHDEHRKSVEESTERLKELLRRNNEVIKDIARRLDELLRKLEKVVKEIAK

SEQ ID NO: 21408 - protein, 182 aa, Artificial Sequence; identical to SEQ ID NO: 21407
  Synthetic sequence.

SEQ ID NO: 21409 - protein, 182 aa, Artificial Sequence
  Synthetic sequence.
DELRELEEEVRKSIETNRELLERARERVERLSEEHRKLLEKVKEDSDRLVEEVKDLERRGEPKTDLARRLDDLLRKNNDILRRLKEDMKRTNKELEDLIRELVKTTRDLDRRLKKLIDDLNLDDEVLRRARTLHDEHRRSVEESERRLKELLERNNEVIKDIERKLDKSNKELKDEAEKVKK

SEQ ID NO: 21410 - protein, 182 aa, Artificial Sequence; identical to SEQ ID NO: 21409
  Synthetic sequence.

SEQ ID NO: 21411 - protein, 182 aa, Artificial Sequence
  Synthetic sequence.
SELEEIEKKVRELTKRHRELVERVRKTVKELIETNRRLLETLTERIKRVLEEVRDLERRGEPKRDLKKRLEDIIRRLAEDIERVKRETDKLLEELKRIIEEVEKEMRETNKELDKEIKDANLDDKALEEAKRVLRENNEVIKDIKRRLDELLKELEKSVRESEERLRRLLEEVKRVIEEVAT

SEQ ID NO: 21412 - protein, 182 aa, Artificial Sequence; identical to SEQ ID NO: 21411
  Synthetic sequence.

SEQ ID NO: 21413 - protein, 182 aa, Artificial Sequence
  Synthetic sequence.
SSDREVEERVKRLTDRHRELLKRVEEEVKRSIKRNKDLLDELRKESEKLVKEARDLARKGKPKRDLARELRKLLEDNNRKLEEVDRETDELDKRLKERIEELEREAKKTNDELRELIKRLNLDEDVLRLAEKLLKDNNKVIDEIRRRLDRLHEEHKKSVDDSREELKKSNKKLEEVVREIEK

SEQ ID NO: 21414 - protein, 182 aa, Artificial Sequence; identical to SEQ ID NO: 21413
  Synthetic sequence.

SEQ ID NO: 21415 - protein, 185 aa, Artificial Sequence
  Synthetic sequence.
DDLREVEKEIRRIAEESKKLLEEIERAVEKILRDSRRVLEELARRAKRLLEELDKLKKNGLDKEDLERKLRELERRLEELLEELERISERTKEELKRLEEKLKKFSEDSDRRLRKILEDLERRGVDEDVRREVKRLVDELREVDRKIEEDLRELVRELEKVNREIRKRIEELVRRIKEVADEVRR

SEQ ID NO: 21416 - protein, 185 aa, Artificial Sequence; identical to SEQ ID NO: 21415
  Synthetic sequence.

SEQ ID NO: 21417 - protein, 184 aa, Artificial Sequence
  Synthetic sequence.
DMEEKMRRITEEWRRVTEEIERRHREVIKKWRDVSREIAETHRRVIDELRRVLERIAERNPSEDLLRKLKKEIEKLERDNRKLIDDDRRLLERVERKNERLIREDRERLKEAEKRIKEVEDRGIDKDIVDKELERLREEIRTSKKESDEVVKENEELIRDSKRKSEKVVRDNKRVIKEAEEKAK

SEQ ID NO: 21418 - protein, 184 aa, Artificial Sequence; identical to SEQ ID NO: 21417
  Synthetic sequence.

SEQ ID NO: 21419 - protein, 182 aa, Artificial Sequence
  Synthetic sequence.
DEIEELLKEIKKLVDELRKRIEELAREHKRLADELRKKIKKLKDEHDRLVRELEKLAEKGRSDDKVLKKIEDDSKRTREDLERAIREAEDRSRRTSEDLERAIKEAEDRLRKLAEDLKRRGGGKEVKDKLDKLREELKRVADKLRDDLRELHKRLKEVADRLRKLLEDANRTLREVLKETKR

SEQ ID NO: 21420 - protein, 182 aa, Artificial Sequence; identical to SEQ ID NO: 21419
  Synthetic sequence.

SEQ ID NO: 21421 - protein, 177 aa, Artificial Sequence
  Synthetic sequence.
SAEESAKRLKEELKKSLDRSREELDKLRKDNEKVLRDVEERLRRLIEELKKVLEDIKKDKGRTEEVEKLRKKVEDMARELKERLKDLERSLRELEKKLRRELERSEEEIRKLERDLDREEVREELEKRVEKLLRDDKRRLDELRKESEDHIREIEDTLRRIEEEVKRLLKEMRDKLK

SEQ ID NO: 21422 - protein, 177 aa, Artificial Sequence; identical to SEQ ID NO: 21421
  Synthetic sequence.

SEQ ID NO: 21423 - protein, 185 aa, Artificial Sequence
  Synthetic sequence.
SELETIARRVEKLNEDVERLLREAKKEADRLIKENEDLLREAERKVREIIERIRRLAERGEPKRDLLKEIEELLRELKETVERLIKTSRDLLKRLAELVEKVKRELEDSLRKLKKEAEDLIRKNDDKEVKEKLTRLLKSHEDVIREVSRRLKELLDRYREVSDRIRKTLEELLKELRRVVEEVRK

SEQ ID NO: 21424 - protein, 185 aa, Artificial Sequence; identical to SEQ ID NO: 21423
  Synthetic sequence.

SEQ ID NO: 21425 - protein, 185 aa, Artificial Sequence
  Synthetic sequence.
KDLEEIERKVRKLNEDDKKLLDDLRKEVEKALRRNEESLRKSREDAKKIIKEIEDLARRGEPKRDLLRKLEEDLKRVEDEVRKNEKRSRDLLDRLRRILEDLIRESERSADELRRDMKRLIDDKDDKEMKDALRELLRSHRKSSEDTKRELERLLREYEKVSRDVKRDHEKLLREIREVIEEVKK

SEQ ID NO: 21426 - protein, 185 aa, Artificial Sequence; identical to SEQ ID NO: 21425
  Synthetic sequence.

SEQ ID NO: 21427 - protein, 185 aa, Artificial Sequence
  Synthetic sequence.
SELDEIRRRVEELIETDKDILRRIAEEVRKALEDNKKSLRESEEEVRRLLEEIKKLADRGEPKRELLERLERLLEELRKKVEENERRSKKLARELRERAKEIKKRSDDLNRELRKRMKELIDRIDDEEMKKLLEDLLRKSEDSTRETRKRLKELLDRYEEVSKKIKKRHKELIEELRKVIDDVRR

SEQ ID NO: 21428 - protein, 185 aa, Artificial Sequence; identical to SEQ ID NO: 21427
  Synthetic sequence.

SEQ ID NO: 21429 - protein, 182 aa, Artificial Sequence
  Synthetic sequence.
RVEETLTRALKEIEEVIRRVDEESKRTIRSHREVIREVDEIHTRLLERLKKVIDDIRRRNVPDDDLRRILRELEEHIKRSKEELEKSLRDLERHSDELRRRLRELLERLRKIVEELDRAKSDDDRLLKEARDEVRKIIEEIRRLLEEHERTVKKLNEDIRKRLEESERTVEELLKRLRDRAR

SEQ ID NO: 21430 - protein, 182 aa, Artificial Sequence; identical to SEQ ID NO: 21429
  Synthetic sequence.

SEQ ID NO: 21431 - protein, 182 aa, Artificial Sequence
  Synthetic sequence.
SMEEELKRLLESHEKVIREVRKTSEDTLRSHRKVIEEAKEEHKKLLEEIKRVVERVRKRNVPDEDLKRILEEVRRHVEESKKRLRDSFEELRRHSEELERRLRESKKRLERLVRELEREDSRDETVLREARKEVEKLNEDIRRLLEEHKRVVDELNKELRRLLEESRRRVKELIRRIEEEAR

SEQ ID NO: 21432 - protein, 182 aa, Artificial Sequence; identical to SEQ ID NO: 21431
  Synthetic sequence.

SEQ ID NO: 21433 - protein, 182 aa, Artificial Sequence
  Synthetic sequence.
SVEERLRELIESHRRVIEKVERDSRRTIRSHEEVIKEVKKISEDTLREIRKVIEEAKKRGVPDDELRELLKRLKEHSEELKRRLEESLKDLKRHSDELRKRLEESLRRLKKLIEELRRADSRDETLLRDAERRVEELNEEIRRLLEKHVRDVDRLNKEIRDLAREHKERAEEIIKRIEEKAR

SEQ ID NO: 21434 - protein, 182 aa, Artificial Sequence; identical to SEQ ID NO: 21433
  Synthetic sequence.

SEQ ID NO: 21435 - protein, 186 aa, Artificial Sequence
  Synthetic sequence.
SEMERLERRARELLRRNEELMDDLRRKAEELLKRNDRLVKEIEKKVREVLRRIEELKRRGEPKREVARKIEEILRRLEETLRRIKEESDRLDEELKRELERVKRESEELDRELRKLIEDVERRVTDSKRLEELLRRLNEEHKRISDELRKLLDEALERHRELSRRLEEELERLLREIERLVEEVTR

SEQ ID NO: 21436 - protein, 186 aa, Artificial Sequence; identical to SEQ ID NO: 21435
  Synthetic sequence.

SEQ ID NO: 21437 - protein, 186 aa, Artificial Sequence
  Synthetic sequence.
DDMERLEEEIKEILDRLRRLLERNRRVNKEIDERSKELVKRLEEKARRLLEELRRLKDRVTDKETLERRLRELLRELERLIREVEERLKKLHEDHKRHIERSDEEMKRLLDELRKRIEDVKRKLERVKELEKKAEDVLREVKKVIDEVRTDSKRLNENLRESIKDVKREAERVLREVEEAIREVER

SEQ ID NO: 21438 - protein, 186 aa, Artificial Sequence; identical to SEQ ID NO: 21437
  Synthetic sequence.

SEQ ID NO: 21439 - protein, 186 aa, Artificial Sequence
  Synthetic sequence.
REAEELKKEVDRILEELKKLLKENEDLNRDLDRKSKELLKENREKVERLRKELRELKDKVTDKDKLAKRLEELLKDLADHVERSRKKLEDLHREHEDHIRKSEEELKRLLKEVEDLIRELRERKKDVKELEDEAKRLKDEVEKLIEEIKRKSDELNKNLRDSIRRVEETTRDLLRKIKKLIDEIKK

SEQ ID NO: 21440 - protein, 186 aa, Artificial Sequence; identical to SEQ ID NO: 21439
  Synthetic sequence.

SEQ ID NO: 21441 - protein, 171 aa, Artificial Sequence
  Synthetic sequence.
SIEEALEDLARRIKKILDDLRREAERLLREVEELLKRVEEANRRLRRTIEEALKRLARDKKKADEIRRRHEELEKRSKENLDKIREDLERLKKRLEDELKRIEEELRKLREEGVEVETAEREIRRILEEIRRLAEEARRRIEEVLKRIKKHLEESKRRNEESLERIEREAR

SEQ ID NO: 21442 - protein, 171 aa, Artificial Sequence; identical to SEQ ID NO: 21441
  Synthetic sequence.

SEQ ID NO: 21443 - protein, 179 aa, Artificial Sequence
  Synthetic sequence.
SVEETVDELKKRIEKILREIKRVNEELAKRNEDVNEEWRREVDKMIKDIERILRDVLRKEDSEDLRRRVEEVKRHLKRNKDEVEKKSKENKDRVRTSHERLRDLLRRIRERLEELERRLKDLDIEKLKRDAERILEEIKRAVDTSREESERTLKELRDMVKESRKDAEEVLERIDRDKR

SEQ ID NO: 21444 - protein, 179 aa, Artificial Sequence; identical to SEQ ID NO: 21443
  Synthetic sequence.

SEQ ID NO: 21445 - protein, 179 aa, Artificial Sequence
  Synthetic sequence.
SVKETLEDLIKKIRDLLKRVRDENKRLAEDNERLNREVEKRNRELIKRIEDELEEVRKREDSERVRKIIEDVKRRLDRSHEEVKRISEKNRRDVKRSTEELEKLAEDAERRLDELDKLLKDLDIRDLKREIEKILREIKKALEDSRRKSKETLDRIREVLKTSEEDIKRILKEIREAAR

SEQ ID NO: 21446 - protein, 179 aa, Artificial Sequence; identical to SEQ ID NO: 21445
  Synthetic sequence.

SEQ ID NO: 21447 - protein, 178 aa, Artificial Sequence
  Synthetic sequence.
SREEVVKEIEKRVEELNRRLEETVRRVIEEMKRLNKESKEVSKKIVDEVRKLLDDVRREKGETEELKRLEERIREAEKTSKKLNDDHERESRKLARRLEELLERHKRETRRIIEEMRRAKLEEDELRRLLERIEKTVRELKREIEKILEDATRTVEDLKRKNEELLRRLKKLADDVKK

SEQ ID NO: 21448 - protein, 178 aa, Artificial Sequence; identical to SEQ ID NO: 21447
  Synthetic sequence.

SEQ ID NO: 21449 - protein, 184 aa, Artificial Sequence
  Synthetic sequence.
RVEEILRKASKENKEVIDRDRRLAEEATELNKRVVEEDRKVMKEVTKELEDVLRRAREEGLDEEKLRRLEEELRRLTEEWREEIRKDEKTVEELRKKWEDVSRELERRHRELERELKKSLDDGNTDKLLRELEERSKKVLEESKKTSEDLLRESEKHVRDWREKSRKLEEKVKRLVKKVKDTTD

SEQ ID NO: 21450 - protein, 184 aa, Artificial Sequence; identical to SEQ ID NO: 21449
  Synthetic sequence.

SEQ ID NO: 21451 - protein, 184 aa, Artificial Sequence
  Synthetic sequence.
RAEDIIRELKRRNEEVLERDRELMERAARELREVLERLKDIAREASKELKRVLDELRKRGLDEEDLRRLEKELRDLEREIDRTLKEIEKRLRKLKREWEKVSDDLRKKHEDLIKKLKDDLRRGTSDEVVERLARESERVLRESEETSKDLKRKVDEELRRIEDTIRRLLKRVKDLVKKIEDTSR

SEQ ID NO: 21452 - protein, 184 aa, Artificial Sequence; identical to SEQ ID NO: 21451
  Synthetic sequence.

SEQ ID NO: 21453 - protein, 184 aa, Artificial Sequence
  Synthetic sequence.
RLREIIEKLRRDNEKVIEEDRRVAEEVRKALEKVLREDRKMADEVTKELERALKELEDRGLDEKKLEELRRRLRKLVEDWKRVSERVEKELRELTEEWEKVSRDLEKRHRDLVRKLEDDLRKGTTDEVIKELEKRSKDVLDESRDESRKLLERVERLLKKIREDSERLLERVEELLREAEETAR

SEQ ID NO: 21454 - protein, 184 aa, Artificial Sequence; identical to SEQ ID NO: 21453
  Synthetic sequence.

SEQ ID NO: 21455 - protein, 184 aa, Artificial Sequence
  Synthetic sequence.
SVEEIIRKLEEDNRDVLRRDREVAKKVEDENRKVAEEDDRIVRRVAEELKRVLKELEDKGLEKRELDRLRKELKELVERLEDVSRRMKETVKRLRDEWEKRSRELEKTVRELVKKLRDELRKGISEKVIEELKDESRKHLEELEKDSKRLEDESKKHLDDWRRTSEKLLEDVERRVREIEEESR

SEQ ID NO: 21456 - protein, 184 aa, Artificial Sequence; identical to SEQ ID NO: 21455
  Synthetic sequence.

SEQ ID NO: 21457 - protein, 179 aa, Artificial Sequence
  Synthetic sequence.
SSEEVVRELDKEIRKSIEDLKRIVRENEEENKRSVEDVREKAKRNEERLRKVLKEADERKRDEDLERKLRTVKRELERSIEELEKHIEKSNRDVKKSAKELEDHLRDSKRRMKELAERLKDVDIRELAKRVKRIVDENKRVAEEHHRKVERIVRENEKLLKEHHDRVEELVRRIKEEVE

SEQ ID NO: 21458 - protein, 179 aa, Artificial Sequence; identical to SEQ ID NO: 21457
  Synthetic sequence.

SEQ ID NO: 21459 - protein, 179 aa, Artificial Sequence
  Synthetic sequence.
SEEEEVRRVLEELEKKVKRLTEEHRRRLDELRKKVKDHSRKNKELLERLREEIKRIKGAPSEDIDRIEEEARRRLEESERSSRELKKDLERTLEKLRRDSKRLVEEMERVLRELRKRGGSEEAKRVLEEVEKRVRELVKTNEDVLREIEEDVRRLVKENEDSIKESKDRLRELLERLKQ

SEQ ID NO: 21460 - protein, 179 aa, Artificial Sequence; identical to SEQ ID NO: 21459
  Synthetic sequence.

SEQ ID NO: 21461 - protein, 181 aa, Artificial Sequence
  Synthetic sequence.
DEVEEIRKILEELAREAEKVVRETRKLLEDIRKEVEELNDRNRRLLEELERRVRDIKRRGTSEEKLKELEDRVEKAIRESREELKRLEDKIRKRIEEDRRKIEKLERKVKKVIDEIRKRTRRDEIRRVVEDVERRLRELLDRWRKVSEEVEKRLKELIDELRESIERSADRLRKLIEELKR

SEQ ID NO: 21462 - protein, 181 aa, Artificial Sequence; identical to SEQ ID NO: 21461
  Synthetic sequence.

SEQ ID NO: 21463 - protein, 181 aa, Artificial Sequence
  Synthetic sequence.
REVEEIKKTLEDIRREAKELLDRTRELLDRLRKSVEELNRDNERLLREAKDEVEKVKRDGTSKEVVDELMRKLKRLIEESKRKLDEHVKRTKEVIERDREELKRLKRKLDDTIRKIRSRTREEEIKKVVERVEREIEDLIRRWEEVSRDVEEKLKDLNKKVEESIRRSAKDLRELLREVEE

SEQ ID NO: 21464 - protein, 181 aa, Artificial Sequence; identical to SEQ ID NO: 21463
  Synthetic sequence.

SEQ ID NO: 21465 - protein, 175 aa, Artificial Sequence
  Synthetic sequence.
SRAEKVLKRVTDLIRELLRTVTELVRRNREVIEELLRRVAKLHRDNRELNKKVLEDVRRDGPDDRLVETLKRHNEEVTKTLERLKRELEKHLEKSARDVEKLKKDLRRVAEEVRRELGDNEVVDELRRRIREVEKTLDRLLEESEERARRVLKELDRLLEESRKSSREVIEEAKR

SEQ ID NO: 21466 - protein, 175 aa, Artificial Sequence; identical to SEQ ID NO: 21465
  Synthetic sequence.

SEQ ID NO: 21467 - protein, 180 aa, Artificial Sequence
  Synthetic sequence.
SVEELLKKLEKENRDVIREMKKLLDELEEENRRVIEEWRRITKELEDRNRRVREEIPESDELRKLVEELKKHLEDDKRRAEKAARDLKDHLRRLEETIRKMEEELKRHLDKLRRDIERGTDEEIIRRLVKHNKELVDEIRKTIERLREHNRKLVEKVREDVKRSTKHNRDLVKEVRDRAK

SEQ ID NO: 21468 - protein, 180 aa, Artificial Sequence; identical to SEQ ID NO: 21467
  Synthetic sequence.

SEQ ID NO: 21469 - protein, 180 aa, Artificial Sequence
  Synthetic sequence.
SLEELLDRLRKLNETVIRDMERVLKELEERNRKVIKEDRDVLEELARRNEKVKRDIPPDDELRKLAEDLERHLRDWEDKSRKLEERLRRHLKEVKETIEKIEEELKEHLRDVERKIREGTDEEIAKELVKHNEKKVREIKKTIDDLRKHNEELVKEIRETSERLREHNERLLREALRRAK

SEQ ID NO: 21470 - protein, 180 aa, Artificial Sequence; identical to SEQ ID NO: 21469
  Synthetic sequence.

SEQ ID NO: 21471 - protein, 184 aa, Artificial Sequence
  Synthetic sequence.
DLEEVVKDLERKLRDVARKDRKLVEDSRKILKDVVDKDRELVERSRRILEEVLERIRRRGTDETTVKDIKRRLDEVLKENDDDSKRATEELRKLLEDNKRKSDEARRRIKKILDEIKDETRKGTSRDTARKLLEDVADELRRWLEDSERLHKENKDTIEKWLRRSRKLHEENRKLIEDLLRTVT

SEQ ID NO: 21472 - protein, 184 aa, Artificial Sequence; identical to SEQ ID NO: 21471
  Synthetic sequence.

SEQ ID NO: 21473 - protein, 184 aa, Artificial Sequence
  Synthetic sequence.
SLEDVLRELKERLERSHRKLRELVRRLEEDLKRVLRELEKIVDEVRKINEDVRREVERRGVDEDTLRRITKLSEDSLREAEELLEDIRRVVEKIKRELEKMLEEHRRTLEKIEKELDEVRRRGEDEDIVRKLLEDVRKLVEELDRRAKELEERVKKVVDELLEKARRLLEKNRRTVEKILRDVK

SEQ ID NO: 21474 - protein, 184 aa, Artificial Sequence; identical to SEQ ID NO: 21473
  Synthetic sequence.

SEQ ID NO: 21475 - protein, 182 aa, Artificial Sequence
  Synthetic sequence.
SEVEKLLREVEDRDRRILKKVKELLDEVRRLIEDHLRRSEDALRRVRKRIEELKELVERGDLDEETLKKVKDELRRLIEELRKHAEELKRRLEELERTLKEELDEWKKELDKLLEDLRKDEKSERLEEMLRRLKKSIEDSVREVRKVLKEAKDIARKVIEDTKRLLEELKRIMKKVLDELRK

SEQ ID NO: 21476 - protein, 182 aa, Artificial Sequence; identical to SEQ ID NO: 21475
  Synthetic sequence.

SEQ ID NO: 21477 - protein, 182 aa, Artificial Sequence
  Synthetic sequence.
SEIEELVERVKARDEKHLRDSEKLLEEVKRRDRKLEEDSKKLLKDVKDLLRELEEVAKRGEVDEETVKDLERRVREMLKESRDRTKKWADELKELVERLRRHIEEWRKELKRELERLEEESDDERLRKLLDDLRKSIEESRKRSEEILREAEDTMRKSVETNERLLEELERELRRVVEELRR

SEQ ID NO: 21478 - protein, 182 aa, Artificial Sequence; identical to SEQ ID NO: 21477
  Synthetic sequence.

SEQ ID NO: 21479 - protein, 182 aa, Artificial Sequence
  Synthetic sequence.
DEIERVLEEVERIDRELLKRSEDLLREVRERDKELEERSKRLLEKARRLIETLRDMARKGEIDEETAKRVEETLRREVEKSREDTRRWEEELKELLKRSKEETDRWKEELRKKVERLEDKDKKERVKTIIDEARKSIDDSVRENKKVLDELKETIERSKKKNEDILREIEKILEEVREELRK

SEQ ID NO: 21480 - protein, 182 aa, Artificial Sequence; identical to SEQ ID NO: 21479
  Synthetic sequence.

SEQ ID NO: 21481 - protein, 182 aa, Artificial Sequence
  Synthetic sequence.
KDVDELLERVKRRDEELERKVEKLLKRVRDLIREHDEKVKELEDEVRDRIKKLLEMAERGEVDEETVKDLKRRLKELLDKLRKETEDLKRDLEELIKTLEEEIRRWKEKLEEDAKRLRDKEKSEELERVLRELKRSIETSTRRLRKILEELRRILEESERKVEEVLKELERIAREVEERLRT

SEQ ID NO: 21482 - protein, 182 aa, Artificial Sequence; identical to SEQ ID NO: 21481
  Synthetic sequence.

SEQ ID NO: 21483 - protein, 182 aa, Artificial Sequence
  Synthetic sequence.
SDIEDVVRKVEEEVRDHNRRVEELLKRVERRDRRLEETVEELLKEIEDKLRRLKEMAERGEVDDKTVKDLKEELERLLRRLEREIREWEKELRRLVRELERETKELEDRLRRLIEELRRRERSERLEKLLRELEETLRRSKERVKEVLEDLKRTITESKRRLKKILDEIRKRLEEVERDLKR

SEQ ID NO: 21484 - protein, 182 aa, Artificial Sequence; identical to SEQ ID NO: 21483
  Synthetic sequence.

SEQ ID NO: 21485 - protein, 184 aa, Artificial Sequence
  Synthetic sequence.
SLEEVVDKLRRDSEESLKKNETVLRRVTKELTELLKRWREASERLKEELREVLERVRKKGLEEREVRKLEDRLRRLLEEDKRLLDEVKRRIEDLRKKWEDETRKVKERHEDLLRKIEEVRKRGTTEDTLRKLAEEVKRVVRDDEEKVKRLEEEVKEEVKKLEDDLRRSEERVERTIREIEKRAK

SEQ ID NO: 21486 - protein, 184 aa, Artificial Sequence; identical to SEQ ID NO: 21485
  Synthetic sequence.

SEQ ID NO: 21487 - protein, 184 aa, Artificial Sequence
  Synthetic sequence.
SVEDLVREVERRLKTVLDEDEEVLKRVEDESRESIKENEEVLREVSERLDKVLKDVRRRGLEERLVRDLERKITELRRKWDEDTKRAKEEHEKLTREWRKRSEELRKRIEDLLRELRERLKEGTSEEDLKRLEDRVEEEVRRAKRESDELLKRVRRTVEDDKRRLRELREEVKDLLERIREAEK

SEQ ID NO: 21488 - protein, 184 aa, Artificial Sequence; identical to SEQ ID NO: 21487
  Synthetic sequence.

SEQ ID NO: 21489 - protein, 178 aa, Artificial Sequence
  Synthetic sequence.
SEVDEVRKRSEKVVEENERRIEESERRIAKLVKEVRDVIEDAKRRVEEILRRLEEEMRKGIDEKTIKDLKEEIKKVLEDLERRIREIEKKLRKVTEDDRRTLKKVREDNKRLLDDIRRKLRSKDVLEEMRKTHERVIKEWERAHKEVNEKLEKIIRELEKVLEEVEDEAREVIRRLET

SEQ ID NO: 21490 - protein, 178 aa, Artificial Sequence; identical to SEQ ID NO: 21489
  Synthetic sequence.

SEQ ID NO: 21491 - protein, 179 aa, Artificial Sequence
  Synthetic sequence.
SASEDLERVLRELAKEVEKLLRESEKLLKELEDLARELLERDRKLLKELEEKVKRLKERRADEDKIRTLEKEMRDVLRESEERIRRLEETVKRVLDENKKRTDDLKKKLEDILEELERRNSAEERVLDDVRKRIEDLVRELKKVNEDIEKKVRELIERLRRSLEKSKEDIRRLVEELRR

SEQ ID NO: 21492 - protein, 179 aa, Artificial Sequence; identical to SEQ ID NO: 21491
  Synthetic sequence.

SEQ ID NO: 21493 - protein, 179 aa, Artificial Sequence
  Synthetic sequence.
DMSEELEEILRRLEEESRRHLRTDEELLRELEEKIRRLLREIEEILERLKKRIDEVKTRNTSEETIKKLIEDAKRVLEEIEEKVKRLVDEAREVLDTSRKTLRELVEKMRETLDRARKRNSAEERVLKRVKDRIDELIRRNEESLERTRDEIRKLIEELKKVLDRVKEEIEKLVEALKK

SEQ ID NO: 21494 - protein, 179 aa, Artificial Sequence; identical to SEQ ID NO: 21493
  Synthetic sequence.

SEQ ID NO: 21495 - protein, 179 aa, Artificial Sequence
  Synthetic sequence.
EMTERLERVLEELKRKSDEHIKTDEELLRRLEKKSRDHLRELEEILRRLEREAREVKRNRTSEEVIKELAKRLRESLERLRKTLDELVKDMERVLRTSERTLEELVRDLERILKELKDADSADREALKKVEDAIDKLRRDNERSLERTKREIERLIRENKDVLDKIEKRIRELIEELER

SEQ ID NO: 21496 - protein, 179 aa, Artificial Sequence; identical to SEQ ID NO: 21495
  Synthetic sequence.

SEQ ID NO: 21497 - protein, 179 aa, Artificial Sequence
  Synthetic sequence.
SADEKLDKILREMKKRSDDHIREVEKILRDLDREVKEILKKDEKLLRDLDRRVKDVKRRRSSEETIDKLIKEAEKVLRDSEDEVRRVVEKMEKVLRDLERTLKELIERLEEIVKRLKEERSADDEVLKRVEETVRRLVEENKKVLDRVREEIRKLIEELRDSLRRSEKRIRELADELRR

SEQ ID NO: 21498 - protein, 179 aa, Artificial Sequence; identical to SEQ ID NO: 21497
  Synthetic sequence.

SEQ ID NO: 21499 - protein, 182 aa, Artificial Sequence
  Synthetic sequence.
DLEDILREIARLIERLIDENRKVLEEIARRLKELIEELKKSLKRSEELLRRLEKELKDSGKKTEELTEKLKRILDESRKEIETLEEKLRRVLKKLKESLDKLVEEMKRTLEDLERKIRRDGPDKDLLRTLEKVAEDLKRRSERHIRELRRTLEDLERDVRRLLREDEEKLKRAAEEVKEAIK

SEQ ID NO: 21500 - protein, 182 aa, Artificial Sequence; identical to SEQ ID NO: 21499
  Synthetic sequence.

SEQ ID NO: 21501 - protein, 182 aa, Artificial Sequence
  Synthetic sequence.
DLEDVLRDIERLLRDLIRRNKEVLDRIRELIKKLIDENRKSLKRSKEELERLIRELAKSGKRDDRVLEKLKKVLDDSRKTLEELAKKAKETLDRIKKSLEELAKKLEDVLRELEREIRRDGPSEELLRRLREVLERLKRESEKHLEELKKILEDLERESRRHIEEDKRLLKELKEEVDERIR

SEQ ID NO: 21502 - protein, 182 aa, Artificial Sequence; identical to SEQ ID NO: 21501
  Synthetic sequence.

SEQ ID NO: 21503 - protein, 182 aa, Artificial Sequence
  Synthetic sequence.
SLEEVLKRIEDELRRLIEENKESLERSERLIRELKKRLEEVLRRIKKLLEELIRRLEESGKRDDRVRKKLKDVLDDLERRVREAVERLKKVLDDSRRSLEELVKKLKKELDRLRERVKRDGPDKKLLEDLKRTLDELRRESEEHIRRDERLAEELAREVEKLLKDMERILRELAKEVEDRIK

SEQ ID NO: 21504 - protein, 182 aa, Artificial Sequence; identical to SEQ ID NO: 21503
  Synthetic sequence.

SEQ ID NO: 21505 - protein, 172 aa, Artificial Sequence
  Synthetic sequence.
DASRRVEEKLKEVEERVRKLLEEDRKRLKDSKRKVEELIERDKTELKKVKDRADGGVPKDEARDELRKLKEKSRRDLERLADDLRRLNEKSKEDLKKIKREAEKLLEELEREKGADKKVIDTVRKRLKELLDELKKSVEDTHRENRRVLKELEESHKRTNERLDDLLRELER

SEQ ID NO: 21506 - protein, 172 aa, Artificial Sequence; identical to SEQ ID NO: 21505
  Synthetic sequence.

SEQ ID NO: 21507 - protein, 185 aa, Artificial Sequence
  Synthetic sequence.
SLEDVVRRVREELERLLRTHEEVIRRVEEELRRLLEEYRKVSKEIEEDLRRLLKEVRDRNIEDEKLRRLEKKLRELIKRSRELLEELRRRAEEIVRRLRDSLRRLKEDIRRIVEKIDKDREDGRPVEDLLREIKKELEDVKRKVDKLNEEVERILKKAKDEVKEAIKENRDRLRRLRDEVRRLKK

SEQ ID NO: 21508 - protein, 185 aa, Artificial Sequence; identical to SEQ ID NO: 21507
  Synthetic sequence.

SEQ ID NO: 21509 - protein, 185 aa, Artificial Sequence
  Synthetic sequence.
GLEDVVRRVEKRLEDLLRRYKKVSERLEREHRRVLDEYRKVSEEIDKILRDLLKEVRDSNIDEKKLRRLEEELRRAREESKKLLRELEEDIKDNLRKSEKLLEELRREAERLREEIEELRRRGEPVEELLKEIEKLLKDIERTVEKALKENKDSIRRSKEKVDRMIKRNRELAKELEDKVRELKR

SEQ ID NO: 21510 - protein, 185 aa, Artificial Sequence; identical to SEQ ID NO: 21509
  Synthetic sequence.

SEQ ID NO: 21511 - protein, 180 aa, Artificial Sequence
  Synthetic sequence.
SIEDILRELADTIRRLTEESEKILRKAEELLRRLTEEWRKSLKDLEDLIRKLIEEIRRRGLPEKDVRKIEEELKRLIEENKERLDRITRKLEEILKELRTSSDRLREELEKLLRDLKRLKDRDGEEEIKKLMDEIRKKVEKHLREVEKVLREVEEEVKRELRKSEELARRIEEKIRREKK

SEQ ID NO: 21512 - protein, 180 aa, Artificial Sequence; identical to SEQ ID NO: 21511
  Synthetic sequence.

SEQ ID NO: 21513 - protein, 180 aa, Artificial Sequence
  Synthetic sequence.
SEVEEALRRMEETIRRVREKLKKSLEDMRREIERIRRELEKSLEEFERDIERITRDIRRRGPGDKELDDIRKELEKKREEHHRRLDEIRRKLEEDLRRHHKDLDDIRRELEKRKEDLRRAKLVSDDALRKIEELVKRLDRELREVNKEIEKVVRELKEELKRVDDEIERLVRELRKEAER

SEQ ID NO: 21514 - protein, 180 aa, Artificial Sequence; identical to SEQ ID NO: 21513
  Synthetic sequence.

SEQ ID NO: 21515 - protein, 185 aa, Artificial Sequence
  Synthetic sequence.
DEIDEIRKVAERLEKEARELVKENEDDLKRHKERVDEIVKKIEEKVRRLEETARKLKEERRDSEELERVIKRLRDELRKLKEEVRREIKRLEDNHKELRDDNKRKNEELKKKVDDLEREVRRLPETEELKKVLEDLRRVLEKVHKLNREVLDKHREIVKRLSDKIKTVLRKLEEILKRAEEELRR

SEQ ID NO: 21516 - protein, 185 aa, Artificial Sequence; identical to SEQ ID NO: 21515
  Synthetic sequence.

SEQ ID NO: 21517 - protein, 179 aa, Artificial Sequence
  Synthetic sequence.
SIEELLEEVERVVREVERRLDELLERNRRVIEEVRRRDDKLTKENEDVIRDVRRAGNISDKATDELRRSHEAERRRSEEDKKRLDDSHKELEKEVEKTKRRIREELKKERDKARRSRRPEEDLIREVEKRLEDIKDLLRRMKEEVERHSREVEDRLRRSEERWRDHSKKVKERLDRATT

SEQ ID NO: 21518 - protein, 179 aa, Artificial Sequence; identical to SEQ ID NO: 21517
  Synthetic sequence.

SEQ ID NO: 21519 - protein, 173 aa, Artificial Sequence
  Synthetic sequence.
SLEEEVRRLLEEIKRLADENRDYVRRSLETNKKTNKDNRDEIRKALERIKRLAREIERIRKEDLDRTIEKLKRELKKLREDNEKRSKENEKSDRDVTEENKRRAKRIRDELRRTGVDEKLLREVEELLRRVEEEHERLHRENRKLNDKDRETLERLIREVDDLLRKLEEEARR

SEQ ID NO: 21520 - protein, 173 aa, Artificial Sequence; identical to SEQ ID NO: 21519
  Synthetic sequence.

SEQ ID NO: 21521 - protein, 174 aa, Artificial Sequence
  Synthetic sequence.
RVDELLEEVRKLVKDVHDTTEELLKEVERRLDEVKKRVDRSNEEVKELVKEAVKRSGETEEIRRLDEELRKAIEKDKRDLEKIEEDLRREADKIRRENEELKRRLEEEEDKIKKRPTDDTKIEELLRRIEKYMRESKERIDRLLERIDEVLEKNERDVRKLLEDIRRMIEKDDT

SEQ ID NO: 21522 - protein, 174 aa, Artificial Sequence; identical to SEQ ID NO: 21521
  Synthetic sequence.

SEQ ID NO: 21523 - protein, 185 aa, Artificial Sequence
  Synthetic sequence.
DTIERLLEDIKRILDKNRRDARRVLEEIKRSNEKNREDIKRIEEEIDRLLKEIKKKAEEDRSGEEAKREEEKLKREIERLERELEKIERENRKKMKEIRDDLDRLRRDNERRRREKKKEMDRRITNKDVVKEVEELLKRVEETHRKLNKEVEELLERDERDLRRLIDDVRRLLEEVRKTLEDLRR

SEQ ID NO: 21524 - protein, 185 aa, Artificial Sequence; identical to SEQ ID NO: 21523
  Synthetic sequence.

SEQ ID NO: 21525 - protein, 182 aa, Artificial Sequence
  Synthetic sequence.
RELEEARERIKELLEEIKDEVRRWREKIKRLLEDSRRKAERLKEDIKRLLEEIKKLSDDGRLDERIEERLRRELERIKRELEKYRKELEEDTRRDEERLRKIKEDLDERMRDIRRELKERVTDEDALRDIERLLREVDDAFRRLVEELRRLNEEVHRTTDELIREVEDMLRKVEEALKREKD

SEQ ID NO: 21526 - protein, 182 aa, Artificial Sequence; identical to SEQ ID NO: 21525
  Synthetic sequence.

SEQ ID NO: 21527 - protein, 178 aa, Artificial Sequence
  Synthetic sequence.
EEIERVLEEIKRTADEIRKEIERVLEKSKKLLDDHHEEVKRMLERIRDKAKKVTDRGGGSRELDKIKKDLEDELRRLEEKSRREHEEHKKELDKIKKKLRDTERDLERKLKEITDRDGEDKVVEELRKILERLKDLVRDLERKLDELNKRVRDRVEENRKELEKLLREARDRIRELER

SEQ ID NO: 21528 - protein, 178 aa, Artificial Sequence; identical to SEQ ID NO: 21527
  Synthetic sequence.

SEQ ID NO: 21529 - protein, 183 aa, Artificial Sequence
  Synthetic sequence.
SLEDRLREVLKRYEDRSRDLERELKRVLDEYDDSSRKVAEELKKVLDEIRETVERIKKDVDEKDLRRIKELLKRLEEEVKRTVDENRREAEEIKRKVKKETDENRREADERRRDLERRKGKPRREKEVADLVKKLEDDLRRTSDKVRRVVEEIKRRLEELERRYKALVKKLRDKLREIKEEVR

SEQ ID NO: 21530 - protein, 183 aa, Artificial Sequence; identical to SEQ ID NO: 21529
  Synthetic sequence.

SEQ ID NO: 21531 - protein, 181 aa, Artificial Sequence
  Synthetic sequence.
DVEEELKKVDDKVEELVRKVIEDIRRALERVRELVERVRRKLEETNKKLKKLVEDIVRKKGRRKELEETLRRNHERLTRATERLKELEERLRKSVEEIERTLKERLDRHHRELDKVREDNGPSEKVEELLRKSEELAKRIEDDVRRVLRKLEDTVRRIKEEIDRLLKDNERIIEEVKRRAD

SEQ ID NO: 21532 - protein, 181 aa, Artificial Sequence; identical to SEQ ID NO: 21531
  Synthetic sequence.

SEQ ID NO: 21533 - protein, 181 aa, Artificial Sequence
  Synthetic sequence.
SVEEIIEDMLRKVRELVRRVRELLREVDEKLKKLVEDVRRRLEKTNKELKDLVEDIVRRSGERKELKETMKRNHEELTKVDKELEEEKEKHHRELERADKELEDIIRRLEEEVKDLKDKKGGSEEAKRVLDKLRKTAEDIKRTIDELLKRSEETIKKIEDKIDKLVKKNKELVKRIEDEAR

SEQ ID NO: 21534 - protein, 181 aa, Artificial Sequence; identical to SEQ ID NO: 21533
  Synthetic sequence.

SEQ ID NO: 21535 - protein, 186 aa, Artificial Sequence
  Synthetic sequence.
SLRELLDEVRRAVEESNRELERLLEEVDRSNRESHRELKRLLEKIKKLAEEVERELERKGTSEDEKKKLDDEKEKLDRLLRKLEEESKEAKERNDERMRRLRKESEEVKRTLEEIERRLEKQGDVSEEEVKKAVEDLKRLVDTHKKRVEEVIDELRKHSEKHSEEVRRVITELARRLEELLDEIRR

SEQ ID NO: 21536 - protein, 186 aa, Artificial Sequence; identical to SEQ ID NO: 21535
  Synthetic sequence.

SEQ ID NO: 21537 - protein, 179 aa, Artificial Sequence
  Synthetic sequence.
SAEEKVEDELRKHHEEVKRLLEEIEKTMRDHHREVEETLKDSRRELKRIEEEARKVKERRVREEELKKIEEDLEREHREHEKRLRDLRRESEKKVRELKEKLDRFRDTSRKRTEDLRREGSASEDILRKLEEEVRRNDKELRDLLEELKDLVRRNDEELRKLNEEVRKRVEELIEELRR

SEQ ID NO: 21538 - protein, 179 aa, Artificial Sequence; identical to SEQ ID NO: 21537
  Synthetic sequence.

SEQ ID NO: 21539 - protein, 179 aa, Artificial Sequence
  Synthetic sequence.
SIEEMLKRVKEESKRSNDKIRDVLRKVEETSRRSKERIDKLLRDVERTVEEVIRDVKADESIVRDLKRILEKLREDVERTKRRDDERLEKLKRDVKREEDRDREDNERLERETRKSRRPEKDVLDRLRRYVEENRRRVEKLIRDLEDAVRRNEDDARRVAKEIEDVVREIKDRVDKTRT

SEQ ID NO: 21540 - protein, 179 aa, Artificial Sequence; identical to SEQ ID NO: 21539
  Synthetic sequence.

SEQ ID NO: 21541 - protein, 178 aa, Artificial Sequence
  Synthetic sequence.
SEVDKKLEDIRRRLEKLERETEESLDRVRKELEDLEKESRESLKRLREDLERVKKTKLDERTLDDKIEEMKKRNEEHRKKSEDSARELEKRNREHTKRLEDVERELREELERLDRSGVDKKKADELRRVIEEIIRRLRELDEKHRRLVEEIIRRLEELNREHSKVVEEIARELKKTAK

SEQ ID NO: 21542 - protein, 178 aa, Artificial Sequence; identical to SEQ ID NO: 21541
  Synthetic sequence.

SEQ ID NO: 21543 - protein, 177 aa, Artificial Sequence
  Synthetic sequence.
SLLEELKRSIEESIRTLKELLDRLEELIRRIAEEIRRLLEEHSRKTEEVIRRAEKAGVPREDLEELADRLRKNNKRLEELVKELIDRLRRLLEDLKRRIEKYAEDLKRELAELRRVKDEKVIEELKRKLEEENKRLKKVVEEIAKTLKDLLDEVRRRIEDSLRKLEELLERVERKTR

SEQ ID NO: 21544 - protein, 177 aa, Artificial Sequence; identical to SEQ ID NO: 21543
  Synthetic sequence.

SEQ ID NO: 21545 - protein, 177 aa, Artificial Sequence
  Synthetic sequence.
SLLEKLEKLIRDIKRTVDKLLEDNEETIRRIIRDIERLLKRHSDETREVVRTLKERGVPDRRLEEVKRRLEKNNRDLEDEIRRVAEELKRSLKKLKEDIERLAKKLEDDLRELRRVQDKDVIERIERELRELLKKLKEDADRHNEDAERKLRRLRDTIRRSLKKLEEDLRRLSKEAE

SEQ ID NO: 21546 - protein, 177 aa, Artificial Sequence; identical to SEQ ID NO: 21545
  Synthetic sequence.

SEQ ID NO: 21547 - protein, 186 aa, Artificial Sequence
  Synthetic sequence.
SRVEETLKRLEDELKRIEEEVRKLLDELRRHLEENRRRTEKLLRELREELERVRERVEKGDRSEDELREELERIAKKLDDELRRHNEHLERSKKRLEDILRELEERIREVARRMEKTLEDLRREGVDEKLLRRLERLVREIKRRLEELLKRLADLVRELKKEHERLNRELEELVRRIKERLKEAEK

SEQ ID NO: 21548 - protein, 186 aa, Artificial Sequence; identical to SEQ ID NO: 21547
  Synthetic sequence.

SEQ ID NO: 21549 - protein, 178 aa, Artificial Sequence
  Synthetic sequence.
EEEERIKERLDRSVEELKKSADKMREEIERSEKKLKESADRVRKEIEDALRRIREEDRDKKELDEEIKRLRDRLREHERETEEENKRLRKRLEEHVRETEKNNERLRRELEKVERNGLEEDVVRRVEELLRRHEEVTKTINREIEELIKTHERSTRELNKEIKELIERLEETIKERTR

SEQ ID NO: 21550 - protein, 178 aa, Artificial Sequence; identical to SEQ ID NO: 21549
  Synthetic sequence.

SEQ ID NO: 21551 - protein, 178 aa, Artificial Sequence
  Synthetic sequence.
KDAEELERRLRKSAEDLKRSAEEMKKRLDKSREDVKRKVEEAKKIVEDLEEDLKKRDTDDELLERTLKTLEKILDELEKDLRDNNKRLREDVERHKKETEENNRRLRREVEEVERKGLSEEMVKRLRELLRTHEEITERINRKIEKLLREHEEETKRLLDDLRRLLEELRKKIEEEKR

SEQ ID NO: 21552 - protein, 178 aa, Artificial Sequence; identical to SEQ ID NO: 21551
  Synthetic sequence.

SEQ ID NO: 21553 - protein, 178 aa, Artificial Sequence
  Synthetic sequence.
DEEERIEEELRKSTEKLKESLDRMRRDIEKSAEDLRKSVEDVERDMRRLLEDIEKRDTDESELRDRIRRAEEDVRRHLRETRENNERLREKLEKHVEDTERNNERLRREVEKVERNGLDKDALERVRRLLERHERETRRINEEIERLIRRHVEETKRVNKRIKRLLDELKRRIEEKSK

SEQ ID NO: 21554 - protein, 178 aa, Artificial Sequence; identical to SEQ ID NO: 21553
  Synthetic sequence.

SEQ ID NO: 21555 - protein, 178 aa, Artificial Sequence
  Synthetic sequence.
SEEEEIKKRIDDARKELEESTREVRERLRDSMRRLDESLKRVEEEIRKLADDIRRREVDEELLKDTIRRARERLKRHERETEKNNKRLKEEVERHVEETKRRIDRLREEVEKLERNGLEEEVVRRVRELLKRLKEEVDRINDEIRKLLEDHKKRTEEVNETIKRLIDRLEEELRRRRE

SEQ ID NO: 21556 - protein, 178 aa, Artificial Sequence; identical to SEQ ID NO: 21555
  Synthetic sequence.

SEQ ID NO: 21557 - protein, 186 aa, Artificial Sequence
  Synthetic sequence.
SEVEKIIEKIRREEDRNRREVEEKLKRIREHVRRNEEDTRRIIRELRELLKEALDRLRRGDRSKEVLKRLVEKIVEDVKRLLDRHREHSERSVRELRKILEELRKHIKKTVDDLRKILRDVREKGADEKLLRELEELIRRVKKRHDELLKEVADLVKEVEDRHRKLNEELERVAREIEETLKRELD

SEQ ID NO: 21558 - protein, 186 aa, Artificial Sequence; identical to SEQ ID NO: 21557
  Synthetic sequence.

SEQ ID NO: 21559 - protein, 179 aa, Artificial Sequence
  Synthetic sequence.
SEVETLLDKIRRDNEDLNRRVREELERIRKADEDVNREIEKVLRDIEEAIRKLKRDRLDKDKLKKTLDDLRRRVKEIEDKLREHIKRLEDRLRKIKEDAERHIRELEKRIRDFKERRKEADELVRRLEKILREHEENIKRIVEELERLLEEHKKNLEDLKRRLRDILRKVEEELDRTRK

SEQ ID NO: 21560 - protein, 179 aa, Artificial Sequence; identical to SEQ ID NO: 21559
  Synthetic sequence.

SEQ ID NO: 21561 - protein, 179 aa, Artificial Sequence
  Synthetic sequence.
SETEELVKKIDKRDKEVKERAKRVVDEIKERDKRVNEEIEKVLRDIERTIKKVREDRLDEDELRRVLEELERRIREIEDRLRRHIEELKRKIDKTKRDLEKHIKDIEDELREVKEKRKEAKEMVDRLRELLERHEKTIRDLVRTLEELLERHRKNIEDLVRELRELLDRAREELKRTAD

SEQ ID NO: 21562 - protein, 179 aa, Artificial Sequence; identical to SEQ ID NO: 21561
  Synthetic sequence.

SEQ ID NO: 21563 - protein, 182 aa, Artificial Sequence
  Synthetic sequence.
SDIEEALKKIKKMTRELREEIKKTEEESERRAKELEKEVRDYLRKVEEEAKRLKDTKASTEELRRTLERSREESEEILRRLEKTHRDHKRKLDEIKKKLKDVNEKIEREIRKILKDKGEDEDIRRVLEELKKVLEENNRVIEELARRLDELNKKLRELLERIKKTLDDLNKRLEKLIRDTEK

SEQ ID NO: 21564 - protein, 182 aa, Artificial Sequence; identical to SEQ ID NO: 21563
  Synthetic sequence.

SEQ ID NO: 21565 - protein, 182 aa, Artificial Sequence
  Synthetic sequence.
SKIEKMLRDIEKKTKELEDEIREALKRLREIAEKLKDEVEKYIRELRELLKRLAETKSSDEDLKRELKKSEDRSREIVKKLERVIEKVEREVREIKKKLETTNREIEKEIREILKRDGEDEKIREALERLRKILRENNEVIRELVERLRKVLEDLKRTVKTIEDRLRKVNEDLKRLIEELER

SEQ ID NO: 21566 - protein, 182 aa, Artificial Sequence; identical to SEQ ID NO: 21565
  Synthetic sequence.

SEQ ID NO: 21567 - protein, 179 aa, Artificial Sequence
  Synthetic sequence.
SEAEKLIEDIKKLIEDHKKRTKELIDEIEEDIKKHREDVERLLRDIERLIEELERENSKDDRVVEEVEDSLRKIKRTLEELVKEHRKKLKEIKEDLKRDLDRVEEVLKRVEDDLRRRDTSEEVERKVREAVKDVRRVLDESRRRLDTAIRKVEEDLRKSREDLERAVKKLRDVLEELKR

SEQ ID NO: 21568 - protein, 179 aa, Artificial Sequence; identical to SEQ ID NO: 21567
  Synthetic sequence.

SEQ ID NO: 21569 - protein, 179 aa, Artificial Sequence
  Synthetic sequence.
SEVEKLERKTEKILKDLKDEVKRAEEETRRILEELKKMLEDMEKRTREILKRIRDLARDGRSRREDLERILRRHNDEIRKIKERLEEKLERHNRKIKRIDDELKKTDDEHNRELDEAKKRGVSEKKLRELNTELTRLIDEIRKRLEELNERLRKLVEEIEERLRRLNEELKRLVEEIRR

SEQ ID NO: 21570 - protein, 179 aa, Artificial Sequence; identical to SEQ ID NO: 21569
  Synthetic sequence.

SEQ ID NO: 21571 - protein, 178 aa, Artificial Sequence
  Synthetic sequence.
KELEDTAEESKRELEKIRDEVRKEEEESEKLLRKIEKELREYAEKTRRILEKLRRDQLDKDELRRTLEEHRRETKELRDRLERTLERHEKRSEDIREKLKELLRRHEEKSEDELRKRPDEEVARLLKKLNDELRRLIREIEERLRKLNDDLRELIERVEERLRRLNEELEKVIRELET

SEQ ID NO: 21572 - protein, 178 aa, Artificial Sequence; identical to SEQ ID NO: 21571
  Synthetic sequence.

SEQ ID NO: 21573 - protein, 178 aa, Artificial Sequence
  Synthetic sequence.
DEVEDTERRSKKKLEELEEELRRTATESKRTLEELKRRLEDEERRSRDALRRLKEANLDEDKLRKVLEEHRKRSKELKERLEEDLRRHRKKSKELKDRAEEALKRHREESKRRLDERPDEEVKRRLERLNEEIEKLIRDIERTNRELNKELEDLIKEIEDRNRKLNEDLRRLIDELRK

SEQ ID NO: 21574 - protein, 178 aa, Artificial Sequence; identical to SEQ ID NO: 21573
  Synthetic sequence.

SEQ ID NO: 21575 - protein, 182 aa, Artificial Sequence
  Synthetic sequence.
SELEEIAREVKETSKRHEEHVRRSEEEVKKTLKRLKEHVDKSSEDAERTLEELERRLRRDGKDERLEEELDKTIKRLEEHVKDNIRKLRETLDRLRRHIDRNRKESKRLLEELKKRIDEVRKRNVRDDELRRLKEELKENIERAEESHKELADRLRELIKRIKERHEELLRRLRKLLEEIRK

SEQ ID NO: 21576 - protein, 182 aa, Artificial Sequence; identical to SEQ ID NO: 21575
  Synthetic sequence.

SEQ ID NO: 21577 - protein, 178 aa, Artificial Sequence
  Synthetic sequence.
SAEEDLERLIRALKKVLDDHERLLRELLRRLEEVVRRHKELLKKLNRDLEEVLKDIKEKKRDKRELEEELKRRLERHRRESEKSKERVERALREVKKKLEKSIRKLEEELRKVEEKLRKDGATDETDKEVRDTIRRIRKHSREVAEEVRKIIEELRRHSKKMADDSKRTIDELRERAK

SEQ ID NO: 21578 - protein, 178 aa, Artificial Sequence; identical to SEQ ID NO: 21577
  Synthetic sequence.

SEQ ID NO: 21579 - protein, 185 aa, Artificial Sequence
  Synthetic sequence.
KVEEELDRLLKEIEKIIEEHRKKNKKLNDDIRRLIEEHERDLRELLKELEKLIRDLKKDLRDVEKLKRELEEILKRLAELIEESKRRLDDELRRHEKRSRDSVEKLERELKKLEDELRRLKEEGIDDRAVEEVRKRIEEILKRIRDNSKRVEEETRELLERIRRNSERLRRDVERLARELEEKKR

SEQ ID NO: 21580 - protein, 185 aa, Artificial Sequence; identical to SEQ ID NO: 21579
  Synthetic sequence.

SEQ ID NO: 21581 - protein, 178 aa, Artificial Sequence
  Synthetic sequence.
SDEERLEEKLRRVEREVEKKLKRLKEELEEYARRVKEMSDRHREEVERFEEEVRRRGGGGEDLDRRIRTLKKRSEELLRESEKRSEEIIRRLEKTLRDLEREVDKIRRELKEELERKDDDTLRKLMEKIKRALEELLKRLEDLVRRIEEELRRLNEELRKNIREAEERLRKLKEDAER

SEQ ID NO: 21582 - protein, 178 aa, Artificial Sequence; identical to SEQ ID NO: 21581
  Synthetic sequence.

SEQ ID NO: 21583 - protein, 180 aa, Artificial Sequence
  Synthetic sequence.
SADEILKEIEDTIRKLIEDNKRTLEEHERRTRKLIRELRELLKRHKTESRRLAEELKKDGDKDLSEEIRRIIEKLKKDNEKLERDVRRLEKKMRDDNRKLKEDNKRVAEEMKKTLDKLKKDRVSGEEVRKRLEELKKKVERENRRHREHLKKVAKEVKRTLDEIRRHLEEVKERVKRARD

SEQ ID NO: 21584 - protein, 180 aa, Artificial Sequence; identical to SEQ ID NO: 21583
  Synthetic sequence.

SEQ ID NO: 21585 - protein, 172 aa, Artificial Sequence
  Synthetic sequence.
SEEEELKRRVDEVRKRTKEIIEELKRHVDRNERTVREIIKRLEEEVRRVAEKVKRGELDREELRELIKRIDEKLKKTLDDVRKHLEDSLRRIEDILRRHEEESKKIEDDMRREVKNSKVVEDVRRTLKRLNDELRKVVKDARELHERLLRDLKRVIDRIRERLKRLLDEAEK

SEQ ID NO: 21586 - protein, 172 aa, Artificial Sequence; identical to SEQ ID NO: 21585
  Synthetic sequence.

SEQ ID NO: 21587 - protein, 180 aa, Artificial Sequence
  Synthetic sequence.
DEVETLAREVKKSNDDDRRKTKKTADDVEKKLEDLKRRDEEVRERVEEDLKRLREKVKGDELRRIVEEIAREVKELLDRSKDLSRRVAEELRRLLRESKEIVDRVARKTEELLKEVRKDDKKEVLDRVADEIRRLNKETNDVDRDVRRRIDKLVEDVKRVTEEVSKEIKRLAEEVDRRIT

SEQ ID NO: 21588 - protein, 180 aa, Artificial Sequence; identical to SEQ ID NO: 21587
  Synthetic sequence.

SEQ ID NO: 21589 - protein, 180 aa, Artificial Sequence
  Synthetic sequence.
DEVEELKRKVRESNKRDEDETRRTEERVEREVRRLEEEVKDVKRKVERELERIAREIKGDELRRIVEEVAKRIDDLIRRIDEIIKRVRKEVKRLLDESRKIVKDVARETEKLLRDLERDDKREVVKEVEDRIRKLNRETNEVDKEVRKRVDDLIRDLERVLREVKEEVDRLVRKVEEDAK

SEQ ID NO: 21590 - protein, 180 aa, Artificial Sequence; identical to SEQ ID NO: 21589
  Synthetic sequence.

SEQ ID NO: 21591 - protein, 187 aa, Artificial Sequence
  Synthetic sequence.
DEVEELVKRAEDILERLKREVDRLIKESEDLNRRIRKHVEDTIKEVRKRLEELRKEVEDRATEEVRKVVDELRKEVERLVRESREVVKRSLEISKRLAEEAKEVLERLRELVKKLVDELRKKKDDERAKDLLKEVVERVTRVAKAVKEKLDEVVRESREVIKRVEEKNRRVLEEVERVARELKKAID

SEQ ID NO: 21592 - protein, 187 aa, Artificial Sequence; identical to SEQ ID NO: 21591
  Synthetic sequence.

SEQ ID NO: 21593 - protein, 187 aa, Artificial Sequence
  Synthetic sequence.
DEVEELVRRAEEELKRLRKHVEETVERSKKLNDEIKKHVDRTVKEAKDELRRLREEVKKRGDERVEKVVEEVDKLVEELVRTSKEVVRDSLRKSTELAKRSRDLVDEVRRLVEELVKELRDKKDREEAKKLLEDVARRVRKVAEELKKKNKELLETSDRVIEKVRKKNEDLKRTVDEVARRLEEAIK

SEQ ID NO: 21594 - protein, 187 aa, Artificial Sequence; identical to SEQ ID NO: 21593
  Synthetic sequence.

SEQ ID NO: 21595 - protein, 178 aa, Artificial Sequence
  Synthetic sequence.
SEVDEVVERLRRISEELDRRVKKLVKDARRISKELEEAVRRVVKTAKDANKELRKEVRERRTDESVVRENHKTIEDVVRELEKVLEEDRKTVEEVVRAARKVVEDDEKTVEDIVRLAKAGVDVDTLAEDAKRSARETEEILRRLVKKLEESARDTKRIIDELDKELKDSNEEVRRRLK

SEQ ID NO: 21596 - protein, 178 aa, Artificial Sequence; identical to SEQ ID NO: 21595
  Synthetic sequence.

SEQ ID NO: 21597 - protein, 174 aa, Artificial Sequence
  Synthetic sequence.
DEAEEVVKDVEREVRRLEKENRDLVERSKRLVERLEKESRDLVRKSREDVKRLREKGVPEDVVRKLEEVSRDSARRLKESNDESRRVSDESKKKLEESLEETRRVVDRVRKLLREGVDEEELRKDVERVVKKDEDITDEVRKENDEVVKKNEDIIDELRKKNEEVLRRVDEEAR

SEQ ID NO: 21598 - protein, 174 aa, Artificial Sequence; identical to SEQ ID NO: 21597
  Synthetic sequence.

SEQ ID NO: 21599 - protein, 174 aa, Artificial Sequence
  Synthetic sequence.
SEVEDVVRKVRELVKRLRDESRRLVEESRRLVEELEKRSRDLVKTAEDIVRELKEAGVPEEAVDKLRKVVETLKDELRRSNEKSERASRESKDRLKKSNDESERVVREVEKLLRAGVDKDELDKEVKEAVKKNREIIRRLEKRNRDVVEENRKIIEDIEKKVRDVVREVRREAK

SEQ ID NO: 21600 - protein, 174 aa, Artificial Sequence; identical to SEQ ID NO: 21599
  Synthetic sequence.

SEQ ID NO: 21601 - protein, 184 aa, Artificial Sequence
  Synthetic sequence.
SSLEEVAERVKKLVRELEESTKTVEELVRRLVTELRKSTEKVRRDVDKLVKELEEIIRDVKDKRELERVIREVMKRIEEILERNSRLIDEVMRRLEKILREDEKLIEDVARRAREIAKRLLDERDTREVKRLVEEVEKLIERLRRESRRLIERVRREARELKEESRRLEEEVRKKIEELARRVK

SEQ ID NO: 21602 - protein, 184 aa, Artificial Sequence; identical to SEQ ID NO: 21601
  Synthetic sequence.

SEQ ID NO: 21603 - protein, 184 aa, Artificial Sequence
  Synthetic sequence.
RDLEEVKKKVDKLVRELEESSKKVRKDVEDLVKELEDTTRDVKRLVEELVTRLKRIIEKVDRKKDLRKVIEDVAEELTRIARRDKELIDRVAEELEEILKRNTDLIKKVADELRRILDELLRKRDTREVKKIIEDVEREMERLERDSRRIVKEVREEADRLRKESKRLEEDVKRKLKELRERVN

SEQ ID NO: 21604 - protein, 184 aa, Artificial Sequence; identical to SEQ ID NO: 21603
  Synthetic sequence.

SEQ ID NO: 21605 - protein, 184 aa, Artificial Sequence
  Synthetic sequence.
DELERVKEKVDKLVAELEKSTDDVKKKVEDLVRELERSSEKVKKDVDRLVKELEDIIRRVKDKDRLLRTIREVAKTLEKILEDNKRLIREVARRLRRILEEDKKLIEEVMRRLEEILKDVIRKRDTREVKKVVEDVRREAKRLKERSKKLEDEVRDLLRELEKRSDEITKRVREEMKRLEDEVK

SEQ ID NO: 21606 - protein, 184 aa, Artificial Sequence; identical to SEQ ID NO: 21605
  Synthetic sequence.

SEQ ID NO: 21607 - protein, 184 aa, Artificial Sequence
  Synthetic sequence.
DELEDVKRRVEKLVRELEESSKEVRKRVEDLVRELERTTEEVEKLVRDLVRRLEDIIRRVKDKDDLRRVIERVMKELERILKEDKDRIRKVMEDLKRILEENDRRIKRVAEEIRKILEELLRRRDTEDIKRLEEDVERKLRRLEEESRRIVEEVKKEAERLKERSERLTKEVRELADRLAREVD

SEQ ID NO: 21608 - protein, 184 aa, Artificial Sequence; identical to SEQ ID NO: 21607
  Synthetic sequence.

SEQ ID NO: 21609 - protein, 184 aa, Artificial Sequence
  Synthetic sequence.
RELEEVKRRVERLVRELEESLRRVRKEVEDLVRDLERVSKEVEDTVRELVRRLDEVIRRVKRKEDLLRLIDKVAKELEKILKKSLDDSRRVMERLEEILERNSRLIKKVMKEAEDILKELIDRRDTREVKTLVEEVRRLLEELERRSRKLVKEVRDEAERLKREDEEIIREVRELLKELERKVR

SEQ ID NO: 21610 - protein, 184 aa, Artificial Sequence; identical to SEQ ID NO: 21609
  Synthetic sequence.

SEQ ID NO: 21611 - protein, 181 aa, Artificial Sequence
  Synthetic sequence.
DELEEVKRTVEELLERLERVNKDVKRKVKELLDRLREVDDRVKKEVKRLIEEVKNVDTDKKDVEKIVKEVEKTLKDLVRRVEEINRRVAEDLRRLLEEVERINDEVRRRLERLIEELLKDRDTEEIKKLADRVRRELKRSEDHTKRLAEEVRKDLEESRKHTKELEKEVEEELRRLKKEVR

SEQ ID NO: 21612 - protein, 181 aa, Artificial Sequence; identical to SEQ ID NO: 21611
  Synthetic sequence.

SEQ ID NO: 21613 - protein, 181 aa, Artificial Sequence
  Synthetic sequence.
SELEEAAKAVEKLAREAEKSSEDARRAVERLAREAKRANDEAEKAVRELAERARRADRREEEADRIAEEAAKEAERLAKEAKEINDRAAEEARRLAEEDREVAERAAKEAERLAKELRDTRDAKEAKKLAKEAREIADRLRRESEEIAREAEKIAKELADHTRELAERARRIADKLKKDVK

SEQ ID NO: 21614 - protein, 181 aa, Artificial Sequence; identical to SEQ ID NO: 21613
  Synthetic sequence.

SEQ ID NO: 21615 - protein, 178 aa, Artificial Sequence
  Synthetic sequence.
SAEDLIREVRRRVKELERKLEEILKRSEDLTRRLREEAERILKESRDRVRKLEEDARREAREDKDLVEKVIRELEKAIRHDEEVVRRVEELLKKVNKEVRDVIRKIRKLLKEVDKELEKRGESKEVIKKIRDILRRLSEELEKVLEDSERILRRLEDELRESLKRTEEILRELRRELK

SEQ ID NO: 21616 - protein, 178 aa, Artificial Sequence; identical to SEQ ID NO: 21615
  Synthetic sequence.

SEQ ID NO: 21617 - protein, 176 aa, Artificial Sequence
  Synthetic sequence.
SVDEVLKEIEDALRRLKEEVERVLKENEDELRRLEEEVRRVLKEDEELLEELKRKVREIDEVDRVVDEIRKLSREILEKVKKVVKEIRDSLETVKRRVDDVVRRLKELLDEIKRDNDEKKIRDVAKEIRDRLKELEEEIEEVTRRNKKLLDDVEEEIRRVHEKTRRLLETVLRRAT

SEQ ID NO: 21618 - protein, 176 aa, Artificial Sequence; identical to SEQ ID NO: 21617
  Synthetic sequence.

SEQ ID NO: 21619 - protein, 175 aa, Artificial Sequence
  Synthetic sequence.
RLEEVVEEMERLIRDLEKKVEDARERNERLVRESRKKAEELIKELRKLLRELEEEIRKGSKKVVDEIRRVVEEVVKEIKKLLERNEEVSREVEERLRRLVEEIKRVVEEAIKLLREGIDVETVLKRVREVIRRVEETIKRLDDRNKESSEDVERRLRELLREVREIIKRVREKTR

SEQ ID NO: 21620 - protein, 175 aa, Artificial Sequence; identical to SEQ ID NO: 21619
  Synthetic sequence.

SEQ ID NO: 21621 - protein, 175 aa, Artificial Sequence
  Synthetic sequence.
RLEDVVRESKKLVEESERRVREAIRRNEELVKDSEREAREVIEELKELLRRLEEELKKGSEEVVEEIRRKIKKVVEDIKRLLDRNREVSEKVVRDLERLIREIREINRRAVELLKRGVSVEDLLREVRRVDKEANEKIEELDRRNKKSSDDVKKKIRDLKREVKKVIDEVRERTR

SEQ ID NO: 21622 - protein, 175 aa, Artificial Sequence; identical to SEQ ID NO: 21621
  Synthetic sequence.

SEQ ID NO: 21623 - protein, 181 aa, Artificial Sequence
  Synthetic sequence.
SELEKVLTESRDVVRRATKRLREVHKKTKEVVDRLREKLKRVEDEVRKAVRELEEKVRDEDVVRDVARRLEELLKELERVVREIERELERVIRETEEVIKTIDELLKRVNERVRKVIEEKKDKRLEDVLKESKKLTDDLRKDAKRVLDEDRRLVEELKKELDEARKRVEDLVREVKDRARR

SEQ ID NO: 21624 - protein, 181 aa, Artificial Sequence; identical to SEQ ID NO: 21623
  Synthetic sequence.

SEQ ID NO: 21625 - protein, 185 aa, Artificial Sequence
  Synthetic sequence.
DEVEEVRKRVEEVIRRNEERIEDVRKKVEDVIRRNEKLVDDVRREVKEVLDKLRELLERRKERVKDVVTEVEKRIRKLLDELRRSSEEVKRLIDELLRRAEKSSREVKETIDRLIEDLKRKLKDDKETVDEVAERLKKLLEESERRVKRVLDEARKLVKRSEDRSKKVLDELEELLRRVRKEADK

SEQ ID NO: 21626 - protein, 185 aa, Artificial Sequence; identical to SEQ ID NO: 21625
  Synthetic sequence.

SEQ ID NO: 21627 - protein, 188 aa, Artificial Sequence
  Synthetic sequence.
RELEELLEEARRSSEEVKKILKKLKKEVDESSERLERIIEKLLRDAKRVADEVRDILEKKREDRDVVRKVIDELRKVIEEIVKRLRDAVRENEKSIRDVIRKAEKVVEENERVIEEIVKKAKRDLKDDEERVKRVIDELRELLRRSREEVKRVVEELKKELERSKREVERVIDELRRLLETVEKEIRD

SEQ ID NO: 21628 - protein, 188 aa, Artificial Sequence; identical to SEQ ID NO: 21627
  Synthetic sequence.

SEQ ID NO: 21629 - protein, 188 aa, Artificial Sequence
  Synthetic sequence.
SELEDLKRRIRKSSEDSKKSLEDSDRTIEESSRDSSRTARESERKLEKVLREVDDILKKVKDDKDVVRRVLERLRRIIKRLVDENKRSVEENKRSIDELVERNKRSVEENERVIKEIVDRAKRDASSNEEDVERIVRELEELVRKSREDHKRVIDALREKLKKSREEHRRVIDKLRRELKRVEDEIRR

SEQ ID NO: 21630 - protein, 188 aa, Artificial Sequence; identical to SEQ ID NO: 21629
  Synthetic sequence.

SEQ ID NO: 21631 - protein, 188 aa, Artificial Sequence
  Synthetic sequence.
SILEKLEREVRKSSRESRESAKKSLREIEESSRRVEEELERLLREVRRVAEEVLDILRRKKEERETVKKVLEDLKRIIDKVVEDAKRVVEENRRVIEEAVRKNEESVRENEEVIDRVVKKARRDLDKRREEVKRIIERLRKLLEDSKRDHEEVIKELRKLVEDSRRRVEEVIRRLRELLKRVADELRR

SEQ ID NO: 21632 - protein, 188 aa, Artificial Sequence; identical to SEQ ID NO: 21631
  Synthetic sequence.

SEQ ID NO: 21633 - protein, 189 aa, Artificial Sequence
  Synthetic sequence.
DELEEALRRLKKIVEDLARRNEELLKELRRDSKRLKDEIKRVVDELRDIVRRLKEELDRVKEREEVARRILERLERVIRRLVEILKALVDHNKKSIERVVEEAERSNEEVERVVREVVDEARKRTRDERLERRVREIIRRAEELLERSRKRSEEIAREAEKSNRELEDAVRRIIRELEELLEKLERDAR

SEQ ID NO: 21634 - protein, 189 aa, Artificial Sequence; identical to SEQ ID NO: 21633
  Synthetic sequence.

SEQ ID NO: 21635 - protein, 189 aa, Artificial Sequence
  Synthetic sequence.
DEVDKVTRELREIMRKLKEDDKEVLDRLREDSERVERTNREVEKRLEAIIRDLEEKLRRKREDKDLVKRLLDELRRVVEEVRREVEELNEHNERSIRDAVRKSRELVERIRDVVREVDERLKRLTRDERLKEKVDRIREEAKRLLEELEKHVRDSEREAEDSNRRSRETSEEIIRRLRKKVKELEDKVR

SEQ ID NO: 21636 - protein, 189 aa, Artificial Sequence; identical to SEQ ID NO: 21635
  Synthetic sequence.

SEQ ID NO: 21637 - protein, 189 aa, Artificial Sequence
  Synthetic sequence.
SEVDKVEEELERIVKELKDRDREVLKRLRDDSERLVRELKKVAEELRKIAKDIDERLKEKKEDKDFVEKLVEELKRVIEEVVRRLEELVKHNNRSIEEVVRISERLVEDLERVVRRVEDTLRKLTRDERLKDRVDKIREKARKLLEELKKHVDDSIEEAKRSNEELRKTVEKIIREAEKLLRDLKEAVK

SEQ ID NO: 21638 - protein, 189 aa, Artificial Sequence; identical to SEQ ID NO: 21637
  Synthetic sequence.

SEQ ID NO: 21639 - protein, 189 aa, Artificial Sequence
  Synthetic sequence.
SEAEKVERELDKIIRELKETDKKVLEDNRRVVEKIEREMERVLRELERIMKELKEELDRKREDKEVLRRLVETIRKVVEEVEETLRRLLEESKRSSEAVERISKKLLEELREVVERVVRRLEELRRDERLKEKVDEIRKRAEELVKELARHVEKSIRESRELDKRLEEKVKEIIRRARELLEDLRRKAE

SEQ ID NO: 21640 - protein, 189 aa, Artificial Sequence; identical to SEQ ID NO: 21639
  Synthetic sequence.

SEQ ID NO: 21641 - protein, 179 aa, Artificial Sequence
  Synthetic sequence.
SEAEKVRREVEDLIRTLEEVVRKSSEEIKELLRRLREVVERIRDTTRRLIEEIEKKVKSRKADEIRRLVKKAVDEDEEVIRRVEELVRRVLEKNKEVVRRVEELLRRVVEKIEDVRRRGGREDLERVLKEVREIVKRLLKRLEESLRDVRRIAEELREMLKRSLKRSEEIIRKLLEDVR

SEQ ID NO: 21642 - protein, 179 aa, Artificial Sequence; identical to SEQ ID NO: 21641
  Synthetic sequence.

SEQ ID NO: 21643 - protein, 180 aa, Artificial Sequence
  Synthetic sequence.
DEVDTVDEKVKRLAEELRKRVRESKERTKKLARDLREAVKESLKDSERLAEDLRRKVRDEELKRRVEEVVRESRRLNEEIRRIIEKVVEDMKDSNRRIEEIIEKVVREVKELLKRVRDDDTREKLERVEREIEKLVREVEKILRDIHRDNERVVREVERRLEEITRRSRELAKRVEDETR

SEQ ID NO: 21644 - protein, 180 aa, Artificial Sequence; identical to SEQ ID NO: 21643
  Synthetic sequence.

SEQ ID NO: 21645 - protein, 180 aa, Artificial Sequence
  Synthetic sequence.
DEVDEVARKVERDAERLEDLNRRSEETSRRLAEELRRLNERSERETERLAEELRREVREERLRKLVEDVVREVRDTNRRSKEISEDVVRKSERLNRESKRITKEVRREVKKLLDEVRKDDDKKKLEDILREIEKLIRRVEEISRRILEESKRLADEVRKITKKLHDDNKRLADRVKEETR

SEQ ID NO: 21646 - protein, 180 aa, Artificial Sequence; identical to SEQ ID NO: 21645
  Synthetic sequence.

SEQ ID NO: 21647 - protein, 180 aa, Artificial Sequence
  Synthetic sequence.
REIDEIKERVDRLAEKLRRDMERSTRESRKLVEELKERAKRSKEETTKLAEELRRRVRDEEVRRIVEEVVEKVRTTNEEVRRIIEEVVKRLKETNDRVREIIEDVVRRVDRLLKEVRKRDEKEELERILREIKRLMDEVKRILEELLKTNKKLIDEVRKRLEELHKRNRELVEEVARRAN

SEQ ID NO: 21648 - protein, 180 aa, Artificial Sequence; identical to SEQ ID NO: 21647
  Synthetic sequence.

SEQ ID NO: 21649 - protein, 183 aa, Artificial Sequence
  Synthetic sequence.
SEVEAVEKEARELVREDERRDDEIEEDLRRLLEENRRKDDKVEKEVRELLKRLRDKVDDRADERLRELVEDVARKVKRLLDESRRSSEEVAERLKRLLDESRKTSKEVMEILKELLERLRRVSDKRDVKRVRDTVRDISRKNNRTTEELLKRVRDISRRNKEITEELLRRIREIAEDLARKLD

SEQ ID NO: 21650 - protein, 183 aa, Artificial Sequence; identical to SEQ ID NO: 21649
  Synthetic sequence.

SEQ ID NO: 21651 - protein, 183 aa, Artificial Sequence
  Synthetic sequence.
SEVEKVEEEVKRLVEENERRVRESSREVEKLLREDAERDERASRELKKLLEKLKRAVDKRADERAEETVRDVARKLEDLVRRSKRSSDEVAKALEKLVRDSDKSSKEVAKRLEDLLRELRKVSDKRAVEKVLRTARKISEDNKRKNDEISERLRRISERNNRESEKLLRDLEKIIEDVERKLE

SEQ ID NO: 21652 - protein, 183 aa, Artificial Sequence; identical to SEQ ID NO: 21651
  Synthetic sequence.

SEQ ID NO: 21653 - protein, 183 aa, Artificial Sequence
  Synthetic sequence.
REVEEVEKKARELVERDERTDERIRKELEDLVRENKKEVKRVRETIERLLRDLKKAVDERGDEDVRRTVDKVAREVEELIKEVDRTSKEVEELLRRLLKRSEETSREVMEILRRLLEELRRVSREEDVKRVEKTVEDISRKNNEITKRLRDTVRRLSEKNRRDLEKALEDLKRIVDDVRRKIT

SEQ ID NO: 21654 - protein, 183 aa, Artificial Sequence; identical to SEQ ID NO: 21653
  Synthetic sequence.

SEQ ID NO: 21655 - protein, 183 aa, Artificial Sequence
  Synthetic sequence.
SEVEEVEKEARELVKRDEDRDKEIEDKLRELVERNRRLVRKSSEELKKEIKRLKDEVDRRADERVEDTVRKVMEELKRLVEESRKTSEDIARKLDELVKRSKKTSKEVMKTLRDLLERLRRVTEKEKVEKVLKEVRDISRENNKTTDTLEKEVRRLSEENKRRNEEVTRRVRKILEDVERKAR

SEQ ID NO: 21656 - protein, 183 aa, Artificial Sequence; identical to SEQ ID NO: 21655
  Synthetic sequence.

SEQ ID NO: 21657 - protein, 183 aa, Artificial Sequence
  Synthetic sequence.
KEVEDVEEEVKKLVEENKKAVDDSREEVRKLLEENKKAVDDSRKEVEKLAKKLKEAVDRRADEDARREVEEVVRRARELLETSRETSDRVAKELKKLVDESEESSKRVADELRRLLRELRDVEGKEKVKRVLDEAKKISDDNKRKNEEVSKELEKISRDNLKLNEDITREIREIVERVDERLE

SEQ ID NO: 21658 - protein, 183 aa, Artificial Sequence; identical to SEQ ID NO: 21657
  Synthetic sequence.

SEQ ID NO: 21659 - protein, 183 aa, Artificial Sequence
  Synthetic sequence.
SEVEKVEKDLRKLIKDNRDSVRRVKEEAEKLVEENRRSVEEVRRTIKELLERLEKLVRDRGTEEVKKTVEDVMRRVEELLRRVRETSEEVARRLEKLVEDVRRTSEDVMRRLKKLLEELRRVSDKRLVDKVRRELEKILRDDNRIIKEVLDTVRRLSEDNLKKVKDVLEELTRIAEEVRERAR

SEQ ID NO: 21660 - protein, 183 aa, Artificial Sequence; identical to SEQ ID NO: 21659
  Synthetic sequence.

SEQ ID NO: 21661 - protein, 178 aa, Artificial Sequence
  Synthetic sequence.
SKVEDLLEKLERELEKNRKRTKELLKRAEESSEDIREKVRELRERLERLIEELERRGVPGEVVEEVERVVRRIDRELREVVRKNNEVVRKIVELLKRSDEKVKEVVKRIADLLEEKRDDDKLLEDLERLVRRVLDEARKINEELDKRVKDSVREVEKRLRELEEEVKRIIEEVEKKAQ

SEQ ID NO: 21662 - protein, 178 aa, Artificial Sequence; identical to SEQ ID NO: 21661
  Synthetic sequence.

SEQ ID NO: 21663 - protein, 173 aa, Artificial Sequence
  Synthetic sequence.
EELERLARIVDEAHKRSRDLLETSKREVEDAIDEIRARLEDSRRLVEEVTDEIRRIDKREDVRRLLEELKDHNRRVVEDVERLLRELERRNEEVVRRSKELLDDLERIIDSLDDSERLKELKKRLRDLIEENDRRAKESTKKIRDLAKELRERARRTEEEIKTLMKELEDRMK

SEQ ID NO: 21664 - protein, 173 aa, Artificial Sequence; identical to SEQ ID NO: 21663
  Synthetic sequence.

SEQ ID NO: 21665 - protein, 173 aa, Artificial Sequence
  Synthetic sequence.
KELEDLRREVEEIHKTSERLLRESDKLVEEAIRRIEELLERSKDTVTKAADEVRKADKREDAERLAKELLEINEKVVRDAERLVTEVRRHNTEVVERSKELVETIERRIDSLRDDERLKKLKEDVKRLIEENRKRAEDTKRKIEEEIRRLKEEADRTSEEIKKRADDLRRRAD

SEQ ID NO: 21666 - protein, 173 aa, Artificial Sequence; identical to SEQ ID NO: 21665
  Synthetic sequence.

SEQ ID NO: 21667 - protein, 177 aa, Artificial Sequence
  Synthetic sequence.
DELEEVDKLVKKVHEDSRKLIEDVDRKVREVVERSDRIIETVEELVERVITEVEDMLRKGESDEKVRKLAEELKRILEESMKTSEDLVRKLREIVRKSVEDSKRLVDELRDLIRRLRKDDRLRKVEKRIEDLARENEKRNRDLERKIEKLADESRKKNEDLKKRIEDLAKRLKDEAD

SEQ ID NO: 21668 - protein, 177 aa, Artificial Sequence; identical to SEQ ID NO: 21667
  Synthetic sequence.

SEQ ID NO: 21669 - protein, 177 aa, Artificial Sequence
  Synthetic sequence.
SSLETVREEVRRVKEESDRIIKEVRDRVEEVHKTSKRIIEEVEERVERVIREVREMLRRGETEEKVEKLVREVEKILEDSRRESERLAEEVRRILKESMDRSDELVRRLEELLRRLEKDERLDRVVEDIRRLAEESRRKNEELRKEVEELVKRNKELNEKLKKKVKELAKELRDEAK

SEQ ID NO: 21670 - protein, 177 aa, Artificial Sequence; identical to SEQ ID NO: 21669
  Synthetic sequence.

SEQ ID NO: 21671 - protein, 177 aa, Artificial Sequence
  Synthetic sequence.
DDLETVKRLVDEVIRTSEELIDTVRRLVEEVHRESERILKEVKKEVERVIREVEKLRRKGEDETKVRRLVEELEKILEEVVRRSRELVERLERIVRKSLEDSKRLVDDLRRLIAEMRKDKDLERVRKRIEDLAKELERRNRELEEDIKRLAKENEELARELKKEIETLAKRLEDEDR

SEQ ID NO: 21672 - protein, 177 aa, Artificial Sequence; identical to SEQ ID NO: 21671
  Synthetic sequence.

SEQ ID NO: 21673 - protein, 177 aa, Artificial Sequence
  Synthetic sequence.
SSLEEVDRRVKEVHKESDKIIREVDKRNKEVNRRSEEIIEEVEKTVEEVAKTVDDMLRRGEDERKVEKLVEELERIVEDSVRKSEELARRLKEIHKRSVEESERLAKELRDLIRRLEKSRELKRVKEEIDRLVEEDKEKNERSDKRAKETVDKNKKLNDDLEEKIRRLAEELRRRKK

SEQ ID NO: 21674 - protein, 177 aa, Artificial Sequence; identical to SEQ ID NO: 21673
  Synthetic sequence.

SEQ ID NO: 21675 - protein, 184 aa, Artificial Sequence
  Synthetic sequence.
SSLKEVERLAKELHEKSERIIREVEKLSRELHKTSEKIIRDVARRVKKLIDDVREVITRSGDEEVVRDVRRLVEEVVKEARDILDESLRVSEDLAEKSRRINRRSLEESKKIAEDMREILRRVEPDEELEKLRKRVEDLVRRNEEENKRTLRESEELVKENRKRNKELRDRVEKLVEELRRELK

SEQ ID NO: 21676 - protein, 184 aa, Artificial Sequence; identical to SEQ ID NO: 21675
  Synthetic sequence.

SEQ ID NO: 21677 - protein, 184 aa, Artificial Sequence
  Synthetic sequence.
KKLEDVKELVERLHRESEEIIRDVERRSRELAETVKKILEEVRRLSKKLVDEVREVIKRSGTDEVRDDVRRLVEEVADRSRKINKRVEEVVERVVKRSKEINDTSLKRSEEIARELKELLKRVDKDKDVDRVDREVEELVKENRERNKDTKRESERLAEKLRRDVEKSLRDSERLVKELRDRLR

SEQ ID NO: 21678 - protein, 184 aa, Artificial Sequence; identical to SEQ ID NO: 21677
  Synthetic sequence.

SEQ ID NO: 21679 - protein, 184 aa, Artificial Sequence
  Synthetic sequence.
KKLEDVKRLVDKLVTESEDIIRRVTEESRRLVEESRRVIEEVKKLSEELVRRVEKVIREKGEERVAKDVREEVERVVKTSRDINRETTELSKDIVRRARKINEDSLRVSEEIARELEKLLEDVDKDERVKKVKRDVEKLVRDSRELNKRTREESERLVEESERLNEESRKESERLVRELREKLR

SEQ ID NO: 21680 - protein, 184 aa, Artificial Sequence; identical to SEQ ID NO: 21679
  Synthetic sequence.

SEQ ID NO: 21681 - protein, 184 aa, Artificial Sequence
  Synthetic sequence.
SKLEDVERKVRELVRRSKRVIKEVERLVRELHKRSEDVLRKVKKDSRDLAREVKDVIRRKGTEEVAKEVRDLVEDVVRKSRKINDDVRKISEEIVKTLEKILKESLDLSEDIADKLRRLVDSVDKDKDVDKVRRDVEDLVRESRELNKRLKREVEELAKENRRRVEESRRESEELAKELRERLK

SEQ ID NO: 21682 - protein, 184 aa, Artificial Sequence; identical to SEQ ID NO: 21681
  Synthetic sequence.

SEQ ID NO: 21683 - protein, 187 aa, Artificial Sequence
  Synthetic sequence.
SSIEKVLRELEDIVRKIEERNKKSHDEVRRVVEEIKRRVKKSHEDVRRVVEKIDEDIKRKKDDKRVLKELLDTVKRVVERSKETSERLLREAEKAVRESKERSERSLRELEEMVRRATKRLVDERGKDDDEIRRVKERLDELIRRLEELIRRNVTELKRLIDDLRRLVEENVRRLKELIDKLREDVK

SEQ ID NO: 21684 - protein, 187 aa, Artificial Sequence; identical to SEQ ID NO: 21683
  Synthetic sequence.

SEQ ID NO: 21685 - protein, 187 aa, Artificial Sequence
  Synthetic sequence.
SEIERVLEELKKIVRRIKEKLKESHERVREVVERLKRRNEKSHRDVRRVAERIRREIEKKKSDKDVLDKLLDTIRRVVEESKKDSKKSLDELRRVVKESKETSDTLLEELERAVDKVRKILVRERGKDDKDIREVKKEADRLIKELRDLIETNEREMKKLIDELEELIRDNARRLEELIKRLEEEVR

SEQ ID NO: 21686 - protein, 187 aa, Artificial Sequence; identical to SEQ ID NO: 21685
  Synthetic sequence.

SEQ ID NO: 21687 - protein, 187 aa, Artificial Sequence
  Synthetic sequence.
SELEKVLEEAKRVVDEIKKKLEESHKDNRRTVEEIKRRNKESHERLKEAVDKLKAEIEKKRSEEEVLRELLKELERVVRTSEELSRRSLDELRKSVERSKRTSKRLLDELRRVVDEVKKILVKKRGKDDDRIREIAEELDKLIRELEKLVKRNADESDKLLDELRKLVEDNEREAERLIKELEDEAR

SEQ ID NO: 21688 - protein, 187 aa, Artificial Sequence; identical to SEQ ID NO: 21687
  Synthetic sequence.

SEQ ID NO: 21689 - protein, 187 aa, Artificial Sequence
  Synthetic sequence.
SEIERVLRELEKIVEELKRENEDVHRRVREVVKKLKDENRKSHEEVKRMVDKIREEIKRIRKDKEMLRRLLETLKRVVERSERESEESLKELRRVVEESKKRSEESLERLRRVAKRVKERLVEERGKDDDDIRRAAEKVDKLIKELEDLIRRNAEELRKLIEELEELIRRNRERLKRLIEDLKRAVE

SEQ ID NO: 21690 - protein, 187 aa, Artificial Sequence; identical to SEQ ID NO: 21689
  Synthetic sequence.

SEQ ID NO: 21691 - protein, 177 aa, Artificial Sequence
  Synthetic sequence.
SEMERVEEEIRRLLKELDKKARDVHEADKELVKENRKLADEVERDLRRLLEELRRDVNVEEVLKKVEEVIDKVRKVVEEIEKLSKDSNEKTKRVIEKVKEDLERVLRRVEEIARNNVDKKAIEDVLRKIKKLVEDLKRRIEEVLRESEALNEDTKRLIEEVLRDVRRTIDRLKKEAK

SEQ ID NO: 21692 - protein, 177 aa, Artificial Sequence; identical to SEQ ID NO: 21691
  Synthetic sequence.

SEQ ID NO: 21693 - protein, 177 aa, Artificial Sequence
  Synthetic sequence.
SDMDRVEKELEELLRENEELAKDIHRRDKELLEENRELVRRAEEELRRLLEELARDVNKEEIKETVERVIRDLKRVAREIEEESRRSNEETKELVKRVLEKTRKVIEEVRKVAKDNVGKEVIKDVLRKVRKINKETKELLRTVLEKSEKLNRDTKKRIKDVLEKIKRLIDELRERAR

SEQ ID NO: 21694 - protein, 177 aa, Artificial Sequence; identical to SEQ ID NO: 21693
  Synthetic sequence.

SEQ ID NO: 21695 - protein, 172 aa, Artificial Sequence
  Synthetic sequence.
KEREDIEDRVRKLIEELEESVRRSNETVKKLLRELEKLLEDSNRSVEELARDLRRKVKSELMEKVERLVKDLLRLSDTVAKKIRDVVKRLLEKSNESVKEIKKLLEKLEKEIRDDGDEKVLRKVEKVVEDLKRHNRKVNEEIKRVAEKLKRELEEVNKDIRRMARKLEEEVR

SEQ ID NO: 21696 - protein, 172 aa, Artificial Sequence; identical to SEQ ID NO: 21695
  Synthetic sequence.

SEQ ID NO: 21697 - protein, 172 aa, Artificial Sequence
  Synthetic sequence.
SEAEKIAEDVERLARDLERLLKESNDTVRTLIEDLRRSVEETAKEVRDLIEDLRRRVKSDKARKVEEVVRDLLRIVEESAEEIRRVLERLLEISNTVAKEIRRVVKELKEIVERRGTEEVLKELKKVADELRRILEDVNRRIRKVVDDAREHNKKVVEDVRRVAKEARDRVR

SEQ ID NO: 21698 - protein, 172 aa, Artificial Sequence; identical to SEQ ID NO: 21697
  Synthetic sequence.

SEQ ID NO: 21699 - protein, 181 aa, Artificial Sequence
  Synthetic sequence.
DEVEELERRIEKLAREVKKEIKDALRRNKRLIDEVKKIIEDVNRENRRLMEEVKRLIDAGVPKEEITEIVERVVEEVRRSDEKVARIVEDVADKIRRTNEDLERIVRKVVDEVRKMLERLPRGDELRRIAKRVEDLAEELKRLLDKSRETSERLVDELRKLLRESNETSKELVKRLDDRRK

SEQ ID NO: 21700 - protein, 181 aa, Artificial Sequence; identical to SEQ ID NO: 21699
  Synthetic sequence.

SEQ ID NO: 21701 - protein, 181 aa, Artificial Sequence
  Synthetic sequence.
SEAEKLLKEAKRLADEAKKIIKRAHEENKRAADEAKKIIEEANRENEKLAREAKKLIDAGVPKKEAADIAKKAADEARRSDEEADRIAEEAARRAKETDERAEKIARRAAEEAKEAAKKASRSDEAREIEKRVRELAEELKKLARESNEASKELAKELKELAERSNKTSEDLAKELEDRAR

SEQ ID NO: 21702 - protein, 181 aa, Artificial Sequence; identical to SEQ ID NO: 21701
  Synthetic sequence.

SEQ ID NO: 21703 - protein, 181 aa, Artificial Sequence
  Synthetic sequence.
SEVERLLEEIKELAKRVKDIIKEVNKENKRLVDEVKDRIRKINEDNNRLVETVKELIRKGVPKEEIADIVRRVVKTAEDSNRKILRIAEEVVRTARESDERVREIVRRVVEEVRELLKRLPPGKELERIEREVERLADELRKLLEESNESTERLAEELERLVRESERDSRRLAEELKRRLD

SEQ ID NO: 21704 - protein, 181 aa, Artificial Sequence; identical to SEQ ID NO: 21703
  Synthetic sequence.

SEQ ID NO: 21705 - protein, 181 aa, Artificial Sequence
  Synthetic sequence.
SELEKLKEEIKKLADDVKRIIKKVLDENRKLVDDVKKIIKKVTEENRKLVREVAELIKAGVPKKDIERIVREVVKKMEKSDKEVAEIVEEVVRRMRTSDREVKRIVEEVVRRVKEILKEAKPGKELEEIDKDVDRLIEELKRLLEDSNRDTERLAKELKDLLDESNKDSRRLAEELKRRTD

SEQ ID NO: 21706 - protein, 181 aa, Artificial Sequence; identical to SEQ ID NO: 21705
  Synthetic sequence.

SEQ ID NO: 21707 - protein, 181 aa, Artificial Sequence
  Synthetic sequence.
REVDELRKEIRRLAKEVKDIIKKATERNEELVRRVKEIIKEVNRRNRKAAEEVKELIRAGVPKEDIRRIVERVVREVRRTNDDVRRTVEEVVKDAERTDEELKRIVDDVVRRVRELLKELPRGEDLERIRKEVEELARELEKLLEESNRETKRLARELEKLLEDSRRSTEELAKELEEAER

SEQ ID NO: 21708 - protein, 181 aa, Artificial Sequence; identical to SEQ ID NO: 21707
  Synthetic sequence.

SEQ ID NO: 21709 - protein, 173 aa, Artificial Sequence
  Synthetic sequence.
REAEEVDKEIKKIVRDVRERIRKLNEDNRRIAEKVKREIEELNKRNRDTAKEIEKRGDKDLVDKVVKDVKKSNEDVKEIVKEVAKRAKESNDEAEKIVRDVVRRAKELLRRLPPGDELREIERDVDRLVEELRKLVEDSRRTTKRLVEELDELVETSDRETEKLVRKLRERER

SEQ ID NO: 21710 - protein, 173 aa, Artificial Sequence; identical to SEQ ID NO: 21709
  Synthetic sequence.

SEQ ID NO: 21711 - protein, 173 aa, Artificial Sequence
  Synthetic sequence.
SDLERVLREIKKEVDDVKRLIRELNERNRTIVEEVKKLIEKLNRDNERIVREVKKRGDEKLVEEVVRTMKKSNDELRKIVEEVARRAKRSNEELEKIVREVVRRVKELLKEVREGEEVKRIEDEVRKLVRELEELLKRSDDDTERLVEELKELLKRSEKKTRELAKELRDRRR

SEQ ID NO: 21712 - protein, 173 aa, Artificial Sequence; identical to SEQ ID NO: 21711
  Synthetic sequence.

SEQ ID NO: 21713 - protein, 173 aa, Artificial Sequence
  Synthetic sequence.
SEVDEVLKRIKEEVDRVKEEIKRLNKENNDIVRKVKKEDRDIVETIRKIAEDVKRRGDRDFVREVVKEVRRLLRESREIVKEVVKRMEDSNRRARDIVRRVMERAKKLLEDLPEGDELREIDERVEKLVKELEETLRESEKDTKRLVEELEKSLKETEDDVRRLVKELKDRDD

SEQ ID NO: 21714 - protein, 173 aa, Artificial Sequence; identical to SEQ ID NO: 21713
  Synthetic sequence.

SEQ ID NO: 21715 - protein, 173 aa, Artificial Sequence
  Synthetic sequence.
SKLEEVLRDIRRIVEEVKDEDRRIVEEIRKIAKDVKEKIKELNRENNRIVREVKERGDEDMVRKVAEDAKKSNEDVKRIVDKVVEDVKRLLERSRKIVDDVVKRAKELLERLDPGDELRRIDEEVEKLVKELEKSVEDTKREVDRLAKELEDLVRDSKRDTDRLVKELKDRTD

SEQ ID NO: 21716 - protein, 173 aa, Artificial Sequence; identical to SEQ ID NO: 21715
  Synthetic sequence.

SEQ ID NO: 21717 - protein, 174 aa, Artificial Sequence
  Synthetic sequence.
REVEEAADDLRRLIEENERSVRESKRTLEELIKENEDSVRRSEKSLRDLIRELEEEGVRERVVEELKRIVEKIVRDSRKSVDELRRIVEEVVKESKKSVEELERIVREVIRLLEEGAPVEELLKRVRDVSEESKRLDRKLNEDVKEVSKDSKRRDRELNERVRKVAEDVKETER

SEQ ID NO: 21718 - protein, 174 aa, Artificial Sequence; identical to SEQ ID NO: 21717
  Synthetic sequence.

SEQ ID NO: 21719 - protein, 174 aa, Artificial Sequence
  Synthetic sequence.
SEVEEAAERAKRLIDKLKESADRSEKTARDLIRDLNRSTEEIAREARKLIEELKKAGADSKAVKEAAEIAKRAIDAARKSDEDAARIAKRAAEASREAVKRAAEIAERAIRAAEKGADVKKALEEVRRAAEEAEKADRKLNKEVKEAADRARELNKKLADEVRKAAKEAKEKAD

SEQ ID NO: 21720 - protein, 174 aa, Artificial Sequence; identical to SEQ ID NO: 21719
  Synthetic sequence.

SEQ ID NO: 21721 - protein, 174 aa, Artificial Sequence
  Synthetic sequence.
SEVEEAAKEAKRLIEELNRSTEKIARDAKKLIEELRKSAKESADSARKLIEELKKRGAEEEAVKRAADIAKEAIDRSRKLVKEAEEIAREAIKKAERTDEEAARIAKRAIEAAEEGADVKKALEDVKRAADKAKEDNKKLLKEVEDAAREAKRADRELNKRVKEAADKAKEEAN

SEQ ID NO: 21722 - protein, 174 aa, Artificial Sequence; identical to SEQ ID NO: 21721
  Synthetic sequence.

SEQ ID NO: 21723 - protein, 185 aa, Artificial Sequence
  Synthetic sequence.
DELEEVRERIERLIRRSEELNKKVEKENKELVDRSREINRRVLDEIRRLIREVERILEEEGGETERVDRMVKEVVKRIEKLLKESKDVTEKIARDMRDTDRKSKEATDRVVTEIKRLLEEISRTVREEEVRKLEEEVRELIKKLERSNRELNKETEKLVEDLKRSNKELEEDVERLARKLEEELR

SEQ ID NO: 21724 - protein, 185 aa, Artificial Sequence; identical to SEQ ID NO: 21723
  Synthetic sequence.

SEQ ID NO: 21725 - protein, 185 aa, Artificial Sequence
  Synthetic sequence.
KELEEVEKRIEELARRVEERIKKVIEDNRRLVEESEKINEEVRREVKRLIDEVKEIIRRKGGETEEVRRVVEKVVKEIRDLLKRSRDVTREIVERMRRTDERLREEVERVVEDMRRLLEEIRRTVEEREVRRLEERVEELARRLEELLKESNTRSEKLARDLEKSNEDLEREVEELAKRLEEELK

SEQ ID NO: 21726 - protein, 185 aa, Artificial Sequence; identical to SEQ ID NO: 21725
  Synthetic sequence.

SEQ ID NO: 21727 - protein, 185 aa, Artificial Sequence
  Synthetic sequence.
DSVREVAERIDRLVKESERINREVIETNRRLFKESEKINDKVRKEIEDLIRRVKEIIDRDGGETEEVRKLVEDVVKRLEELVRESKRVTDEIVRRMEKTDEESKRVTDEVVKTAKDLLEELRKTVREEDLRRLKKKVDDLARKLEESNRRSNEDSKRLARELEESNKDLKRRVDELARELEERLK

SEQ ID NO: 21728 - protein, 185 aa, Artificial Sequence; identical to SEQ ID NO: 21727
  Synthetic sequence.

SEQ ID NO: 21729 - protein, 185 aa, Artificial Sequence
  Synthetic sequence.
DELKEVEERIERLIRESKRVNEEVKETNRRLVRESKEINKRVHDTVRRLVEEVRRIIDERGGETEDVKRVVEEVVRRARELSRRSDEVTKDIARKMRDTDRESEEITRRVVEELRRLVEEIRKRVDEKEVRRLREEVEKLAKELKRSNDESNKESERLVEDLKRSNTENSKAVEDLARELKERLK

SEQ ID NO: 21730 - protein, 185 aa, Artificial Sequence; identical to SEQ ID NO: 21729
  Synthetic sequence.

SEQ ID NO: 21731 - protein, 183 aa, Artificial Sequence
  Synthetic sequence.
RSVEELKKKVEDLVRKLEELVKDSKRESKELVDDSERLVKELEDDVRRLVRELRERVRRRRGEELEKIVDEVVRRAERLLEEVKKSSKKVADELERTNREVEEIVRKVVEDARKLLEELKRVDDERIIKRIEEEIEELIRRVEEIIRKVIKENRELVERDREIIKTVLERIRELIKEVTDRIE

SEQ ID NO: 21732 - protein, 183 aa, Artificial Sequence; identical to SEQ ID NO: 21731
  Synthetic sequence.

SEQ ID NO: 21733 - protein, 183 aa, Artificial Sequence
  Synthetic sequence.
SEVEKLEEEVERLVRDSERLNKRLEDRVKKLVEDSERLVRELEKTVRDLVKKLKDDVRRRPGEDLDKIVRKVVREAEELLKEVKKSSEDVADTLRRLLEESKKSSKRVAEEARRLLEELKRVDDERIIRRIRKEIKDLFDDDKRISEEVERRIERLFKEDKKIIEDVEREIRRLIKEVEDRIR

SEQ ID NO: 21734 - protein, 183 aa, Artificial Sequence; identical to SEQ ID NO: 21733
  Synthetic sequence.

SEQ ID NO: 21735 - protein, 183 aa, Artificial Sequence
  Synthetic sequence.
DDVERLERRVRELIKESEKLVDDLRKDVERLVKKSRDLNERLREDVERLVKELEDRVRKRRGEELEKIVKDVVDRARELLERSRRSSKEVAERLKELLERLKKSSEDVAREMERLLEELKRVDRKEIIDKVRKEIEDLVRKDKEIIDEIRKEIRRLVEEDEEISRRVEETIRRLIREVAERIR

SEQ ID NO: 21736 - protein, 183 aa, Artificial Sequence; identical to SEQ ID NO: 21735
  Synthetic sequence.

SEQ ID NO: 21737 - protein, 182 aa, Artificial Sequence
  Synthetic sequence.
SEVDELRKRVEELVRRSRKLVEEHRRKVRELVEESRRLVEELRRDVERLVKKLRDELREVREVVKRVEEELEKLVREVKRSVEESKRRLEDLDRRLRETTKEAEDLLRELLKRVEDLKDDERARDLIEEVRERADRVAKKDEDVIRKSEEDTERVVREDKKIIDRVRKDVEEVIRRVEEETR

SEQ ID NO: 21738 - protein, 182 aa, Artificial Sequence; identical to SEQ ID NO: 21737
  Synthetic sequence.

SEQ ID NO: 21739 - protein, 184 aa, Artificial Sequence
  Synthetic sequence.
STLERLTEDVKRVIREVEEVIKKLKEEVDKSLEDVRRKIEESRKETKRVIDEVKRRIKDKRKDKEVLKELVDRVVRVLEEANRTLEKVVKEHEDSLERVDRTLKKVVDDARKKLERVIERLRDENVSRVEELAKRLEELIRRLEELVDRLRKELKESIEEIRKRVRDHKEESKRLIRELDEEVK

SEQ ID NO: 21740 - protein, 184 aa, Artificial Sequence; identical to SEQ ID NO: 21739
  Synthetic sequence.

SEQ ID NO: 21741 - protein, 184 aa, Artificial Sequence
  Synthetic sequence.
STLERLDEDVKRVAREDTELIKESEERTKKSADDVRKKIEDSRRTTDKVVTDVEDIIEKKREDKRVLKEVVDELRRRLEELNRRLREVVEEHKDSLRKANRDLEESSRRSEERLRRVIETLRRNNVSRVEELAEKLKELLKDSERRVDEHRRKSEESTREIEELVKRHEDRSRELIKRLDEEVR

SEQ ID NO: 21742 - protein, 184 aa, Artificial Sequence; identical to SEQ ID NO: 21741
  Synthetic sequence.

SEQ ID NO: 21743 - protein, 184 aa, Artificial Sequence
  Synthetic sequence.
SLLEKLRRRVDEVIKRDDELIEESKRRTDEALKRVEERIRKSLEETKEAVDRVRDIIRRVRDQKEVLAKVVKELERIARELNRRLKEVVEELRRILEKLNRDLKKSSEDSKRELDRVIEALERGNVSRVDELRERLRKLLEDSEEKVKRHKDESDKLIKDIEDKVKRHEDESRRLIRELREELK

SEQ ID NO: 21744 - protein, 184 aa, Artificial Sequence; identical to SEQ ID NO: 21743
  Synthetic sequence.

SEQ ID NO: 21745 - protein, 176 aa, Artificial Sequence
  Synthetic sequence.
SEADELRKKLEETNKDIKRRVEELKRRLEESNERIEELVRRNEKKSKDLLDDVRRRGVDEKVLKKIEEVVDRNRKLLKEALDVNKKVVDEIEDRLRRVLDKNRKVVEEVERELRDSSEEVLKRLDKKLEDSRRDVERVEKEVEELLRESEERVKRVVETVDKTDEEVKKDVDDKRR

SEQ ID NO: 21746 - protein, 176 aa, Artificial Sequence; identical to SEQ ID NO: 21745
  Synthetic sequence.

SEQ ID NO: 21747 - protein, 176 aa, Artificial Sequence
  Synthetic sequence.
SEAEDLEKKAEDTNREIKKIAEELKKHAEDTNREIEKKVEDLRREAERILREVARKGVDEDVLRAIEEVIKTIEDLARKVLEDNRKVVEDVERLVEEVLKRNAKVVDEVREKARDSSEEVLERLERKLRESKREVDRLAEKIKKLNDDSRKRVDEVVERVRRLLEDVKRKVDEARR

SEQ ID NO: 21748 - protein, 176 aa, Artificial Sequence; identical to SEQ ID NO: 21747
  Synthetic sequence.

SEQ ID NO: 21749 - protein, 178 aa, Artificial Sequence
  Synthetic sequence.
DEVERLEEDVERSIRDSEKVVRDSERRVRESNEEIRRLIEESDKDVKRLIDEATKKSGESADLLRELREVVERVKRLNEKLLKENREASEEVRKINEDLVREDRRVVKEVKETVRRVDKREVIRELKERLKEISDRLKKRSEKSVRDLDDISRKIVRRSEDTVRKLREIARRLDERTK

SEQ ID NO: 21750 - protein, 178 aa, Artificial Sequence; identical to SEQ ID NO: 21749
  Synthetic sequence.

SEQ ID NO: 21751 - protein, 178 aa, Artificial Sequence
  Synthetic sequence.
REKDELEEAVRRSNKRLKDILEKSRKDVEESIKRSEELLKRSDDEARKLIEEMTRKSGEEADVLRTLREVARRAKELNKKLLEDDREVIRRVEEINRELLERNTRVSDRVREIVERTTDRKVIEDVLRELKKITDEIEKESRRSLDELRRISKELEDDSRRTLEELKKIVKELKDRET

SEQ ID NO: 21752 - protein, 178 aa, Artificial Sequence; identical to SEQ ID NO: 21751
  Synthetic sequence.

SEQ ID NO: 21753 - protein, 178 aa, Artificial Sequence
  Synthetic sequence.
DEDRRLEEEVRKSIEESERVIERSEEEVRRLIEEARTLLEDSRRKVEDLLREMTRRAGDKADLLKELKRVIEEVKRLNEKLLKELEDVIERVIRINKRLLDEDRRVVERVIRIVRRTTDREVIEKVLRELREISERLKRESERSLRELEEIARDLLRRSRRTVEELRRIAEELVKRAK

SEQ ID NO: 21754 - protein, 178 aa, Artificial Sequence; identical to SEQ ID NO: 21753
  Synthetic sequence.

SEQ ID NO: 21755 - protein, 187 aa, Artificial Sequence
  Synthetic sequence.
DELEEVLERIEREIRRVSERSEELSRRNEKIIREVEEESRRILEEIKREIDEVKKRAERVDKDTLRRIVETVVRRAKELVDRSKKITTKVVEELKRSMEESRKISEEVARRAKKLVDELRDRLRSEEAKKLVREVEETVRKLVEELREMNKRHEDKNRELSDRLREIDKRLEDEVRKLVEELRKKVE

SEQ ID NO: 21756 - protein, 187 aa, Artificial Sequence; identical to SEQ ID NO: 21755
  Synthetic sequence.

SEQ ID NO: 21757 - protein, 187 aa, Artificial Sequence
  Synthetic sequence.
DELEEVEKEMERIIREVERKLREVNERIKEIIERVIRESKEILDELKRIIDEVKKRAERVRKDELKRDAERVVKRLKDLVDRSRRITEKVVREAEKLNEDLHRDLERVVRTLKKLLDDLRRRLDSEDAERLVRELRKKVEELKRRLEELNRDDKRTIDELVKTLDKIDRELRKTVEDLVRDLERDVK

SEQ ID NO: 21758 - protein, 187 aa, Artificial Sequence; identical to SEQ ID NO: 21757
  Synthetic sequence.

SEQ ID NO: 21759 - protein, 173 aa, Artificial Sequence
  Synthetic sequence.
SKVDEVLKDVRRISEESERRIRELNDRSRKISKESEDRIRELLRRLEEIVERLKRTNDRDAVRKVVEVLRRVLEEVRRSVDEVRRLLEESLKEIERSVREVEKRAKTVLEEVKDDEKAEELRKEVERLIRENEELVERHRKTVEELRRRNEELVKRLEDTVRKLEKELKEEAD

SEQ ID NO: 21760 - protein, 173 aa, Artificial Sequence; identical to SEQ ID NO: 21759
  Synthetic sequence.

SEQ ID NO: 21761 - protein, 173 aa, Artificial Sequence
  Synthetic sequence.
SELDRAADRLRKISKRSEEEIRKLNEEVKKISKESEEKIRRLNEEVKRIVEEVKRRNDERVVKEVERRLERSLEEVEKSVREVKEVLERSLRKVEDSVRKVEDVLRKVLEEVKSDEKAKELAEIVEKLIRDNRRLVEEHEESVRRLEDRNRKLVEDHERTVRKLIKELRETRR

SEQ ID NO: 21762 - protein, 173 aa, Artificial Sequence; identical to SEQ ID NO: 21761
  Synthetic sequence.

SEQ ID NO: 21763 - protein, 173 aa, Artificial Sequence
  Synthetic sequence.
SELEKLLRDLEEIARKVEEEIRTLNEDVKRISKESKERIDRLKEELKKIVDDLKKRRIKEAVDEVKKRLEEVLREVEESVERVEREAKRSLEEIERIVRRLEKDVKKVLEEVKSDERAEDLRREVERLIRELRKLVREHERSVRKLIEENRRIVRELEELVKKLRKELEDTLR

SEQ ID NO: 21764 - protein, 173 aa, Artificial Sequence; identical to SEQ ID NO: 21763
  Synthetic sequence.

SEQ ID NO: 21765 - protein, 173 aa, Artificial Sequence
  Synthetic sequence.
SELEEAERRLREIVRKVEEDSRKLNEELKREVDEVRRRSEELNKRVRDEAERVRKENKRELVRKLEDEVRRSVEESKKISEDLKRRLEESVKESERISEELRKRLREVLEEVKKDEKAEDLARIVKKLVEDLKRLNKRHKESVDELVRRLEELDREHERTIRRMIEELRETER

SEQ ID NO: 21766 - protein, 173 aa, Artificial Sequence; identical to SEQ ID NO: 21765
  Synthetic sequence.

SEQ ID NO: 21767 - protein, 179 aa, Artificial Sequence
  Synthetic sequence.
KEVEKLLEDLKEVARRVSEEIKRLLKELKEVSKRSEDRIRTSLERVKKVVEDVLREADEFRSDKERLREVVERLEEILDRANKEVRDSVKDLEKILRDVVKEVEKLVKDLEEIVRKIIEDVKDVRELKEEIEKLLRRLRKLVKELKEEIKKIVDRNRKLVREHEARSEELKEEIRREVE

SEQ ID NO: 21768 - protein, 179 aa, Artificial Sequence; identical to SEQ ID NO: 21767
  Synthetic sequence.

SEQ ID NO: 21769 - protein, 179 aa, Artificial Sequence
  Synthetic sequence.
SEKEELLKRVAEVSKKSKDRARELNERLKKVVDEVLETIRKLNEDLKRVVERVKEKIKDKKDDKRVVKELVDKLERILERSIEETERLLRELKKILEESNRELEKSVEELKRIADRIIEAVDKVKELRKEAKRNVDENREVVKENKRTTEKLLRDLDRILKENKRTVEKLVRELREEVR

SEQ ID NO: 21770 - protein, 179 aa, Artificial Sequence; identical to SEQ ID NO: 21769
  Synthetic sequence.

SEQ ID NO: 21771 - protein, 179 aa, Artificial Sequence
  Synthetic sequence.
DEKERLLEDVKRASEDSERRIRELNDRVRRVSEESERRIRKLNKELRDEVEKVLREIDRIRKDKDVLRDLVRRLEEKLRRSNEEVRKSVEELERILRESNERVRKSVKELKERAERVIEAVDKVDELREEIEKNLRRNEELVKKNKKDSEDNKRDNDRLVKENEKTTEDLLRRAKEEVD

SEQ ID NO: 21772 - protein, 179 aa, Artificial Sequence; identical to SEQ ID NO: 21771
  Synthetic sequence.

SEQ ID NO: 21773 - protein, 178 aa, Artificial Sequence
  Synthetic sequence.
DETETVEKKLRDVLERVKKDSEDSREELKRVHKRSEELSRRSNKELDDVLDEVRRIIERSTDKREVEKVVRELREVAKRIKDKNRKSLKESEDVVRRVTERNAKAVKELEDVLRRAIEEVKDVEELKKRLDEMRKTIEKLLEDTKEELRELIERNKKLLDDTARRAEEIIKEIEDRSK

SEQ ID NO: 21774 - protein, 178 aa, Artificial Sequence; identical to SEQ ID NO: 21773
  Synthetic sequence.

SEQ ID NO: 21775 - protein, 178 aa, Artificial Sequence
  Synthetic sequence.
SREEKVLEDLDRVLKRVTDLSKESLDEVERVHEESERLIRDSNRVLRDVLEKVREIITKSTDKSTVKKVVEDLKRVLDEVKKKNEESLRRSEEVVRRVIEKNRKAVEELRKVVEEAIRRVKDVKELKDRAREVIRRIEKLVEDTERALRDLIRKNEELLKRTEEELKRAEEDIRRKSK

SEQ ID NO: 21776 - protein, 178 aa, Artificial Sequence; identical to SEQ ID NO: 21775
  Synthetic sequence.

SEQ ID NO: 21777 - protein, 186 aa, Artificial Sequence
  Synthetic sequence.
SDAERVLREIERLLEELKELVERVVRKSEELLRRAKRVNEEVNREIKKLADELEEVIRRKGGESEEVERTLREVTKEIRRLVRESEKLAEDIVRTSDKLVEDLREMLERVVREARKLVEDVERRGVPKEVVDTLRRVVEEITRELEELLERLRRVSEEIRRTLEELLERTRRLVEEIERKLREALK

SEQ ID NO: 21778 - protein, 186 aa, Artificial Sequence; identical to SEQ ID NO: 21777
  Synthetic sequence.

SEQ ID NO: 21779 - protein, 186 aa, Artificial Sequence
  Synthetic sequence.
SELDDVRRKIKRLIDELKRVNEKVNKDSEDLVREVERVNRDVNRRVKELLEELKRVIDERGGETEEVRRILKKVVEEARRLVEKSEDLARKVVKRSNELVKESKDLAKEVVERIRRLVEKVERDGVPEEMVERLRREVEKLERELRELLRRTEENSRRAKERLEDLLRRTRELVKRIEERLREELR

SEQ ID NO: 21780 - protein, 186 aa, Artificial Sequence; identical to SEQ ID NO: 21779
  Synthetic sequence.

SEQ ID NO: 21781 - protein, 183 aa, Artificial Sequence
  Synthetic sequence.
SDVERLKKRVDELAERLKRLDEELKKEVDRIETELRELLKRHEDRNRDISRRLAELLKDARERELEEIVREVVERSERTLREVEEIVRRVVEDARRLVRDSERISKEVEERMKRLVEEVKDVDKKEIVERILEELDRLMEKVERVSREILKTIEKLARDIKKRIEEVTRESERLAREVEEALR

SEQ ID NO: 21782 - protein, 183 aa, Artificial Sequence; identical to SEQ ID NO: 21781
  Synthetic sequence.

SEQ ID NO: 21783 - protein, 183 aa, Artificial Sequence
  Synthetic sequence.
DEVETLEKRVRELERRLEELNKELREEVRKIVERAKELDKRHKDDNERIEKELRELLRDVRDERLKEIVRKVSDESRKTLEDSRRISDRVKKELDKLVRTSEEISKRVADRMRELVDRIRRVDKDEIAKRILDEIDRLMEEAEKVTRDILRKVEELLRRVEDASRRVTKKSRELLKKVKEDLR

SEQ ID NO: 21784 - protein, 183 aa, Artificial Sequence; identical to SEQ ID NO: 21783
  Synthetic sequence.

SEQ ID NO: 21785 - protein, 183 aa, Artificial Sequence
  Synthetic sequence.
SEVETLEKAVRDIVERLKDLNRRLEKEVRDAVKRLRDLLREHEKRNREIAKDLTDKLRKATREELKRIVERVVEASKETLEEVDEIVRRVVREAKRLVDESERISREVVKRLEDLVREAKDVDRKEAATDILRKAEELADEVRRATEEIAKEIRRLVKEVEEVIKDVTRKSDELLKRVADAAK

SEQ ID NO: 21786 - protein, 183 aa, Artificial Sequence; identical to SEQ ID NO: 21785
  Synthetic sequence.

SEQ ID NO: 21787 - protein, 187 aa, Artificial Sequence
  Synthetic sequence.
DELETLADVVRKLIERSRDLLRRHEKRNDEIKKRLDELDRELKERAEEIKKRLEELLRRRDEDEIREVIRELEERLEKLLEDSRRVSKEVAERLDRTVKDVRKTIEESEKLLRELLEEVERKKDDERAEDVVRDVLRKAEKVVEEDERLIRRVTEESDRVLDRVEKETKKIVDEAKRMLREVEERIR

SEQ ID NO: 21788 - protein, 187 aa, Artificial Sequence; identical to SEQ ID NO: 21787
  Synthetic sequence.

SEQ ID NO: 21789 - protein, 187 aa, Artificial Sequence
  Synthetic sequence.
SLIDELRERVKEIKKRSEELLKRHEDENRRIVKRSRELLKKLRDVVRDIIRELRKELEDDKKEEIERVIRELKKRLEELVKEVERSSKELEKTLKRTLEEVRKTSKEVEETLKRLLKEVDDKKKDERAEEVVRRVLKEAEDLLRKDEKILRDVTRRSEKALREDEELAKRVLDEMRKVLEDVKRKSK

SEQ ID NO: 21790 - protein, 187 aa, Artificial Sequence; identical to SEQ ID NO: 21789
  Synthetic sequence.

SEQ ID NO: 21791 - protein, 187 aa, Artificial Sequence
  Synthetic sequence.
EELERLAESVRRIKERLKKLDREHEERNKRIVETSRKLLEELEREVRKIEEDLKRLLDERKDDEIRRVVEEVVRRARELVERIDRSSREVEKKLRETVKESRRVTEEVARRADKLLEDLERKKDDERAEEVVRDILRRLEELMRRAEEVTKKLTDDSRRLLKEDEDLVREIEERLRRLLKEVKERVD

SEQ ID NO: 21792 - protein, 187 aa, Artificial Sequence; identical to SEQ ID NO: 21791
  Synthetic sequence.

SEQ ID NO: 21793 - protein, 179 aa, Artificial Sequence
  Synthetic sequence.
DEDRDVKREVKKVHEDSARTVEKLDREVEKVHEESERTVRKSEKEAKEVLDRVKDIVKKKKDDKKVLKEVVEKLKRDLEELNKELRRSVKELKERLDKVKKDIRDSVRRLDEALKRVVKDNDKVEELKEDLKRILKENEDLVRELEKKLDDIMRENEELVREHEEKSKRIVRELEEEVR

SEQ ID NO: 21794 - protein, 179 aa, Artificial Sequence; identical to SEQ ID NO: 21793
  Synthetic sequence.

SEQ ID NO: 21795 - protein, 179 aa, Artificial Sequence
  Synthetic sequence.
EEKERADRKLEEVHKESKKTVEDSDEALERVHRESKRTVEESRKTLEDVVREVKRIVEEKREDKDVLRKVLEDLKEIVERLNRELEKSVEKLERVLEKLNRELEESVRRLKELLERVIRENSDVKELRRKVEEILKRNEEEVRKHKEKSKKIVEDNRRLVKRHKEESEEVVRDAAREVK

SEQ ID NO: 21796 - protein, 179 aa, Artificial Sequence; identical to SEQ ID NO: 21795
  Synthetic sequence.

SEQ ID NO: 21797 - protein, 179 aa, Artificial Sequence
  Synthetic sequence.
DEDREALKEVEDVHRRSEEKVRESRRRAEEVHKESKKIVDELRRRSEESLKRVEDEVRKKRSDKDTLRDLVRRHRDSNRKIIETIRRSVKEVKKLLKELDEELEKSVRELEKTLKRVVDDNDKVEELKDELRKIVETNRELVRRHHETVKKIMEENERLVRELEKRLEEADRKLEEEVR

SEQ ID NO: 21798 - protein, 179 aa, Artificial Sequence; identical to SEQ ID NO: 21797
  Synthetic sequence.

SEQ ID NO: 21799 - protein, 184 aa, Artificial Sequence
  Synthetic sequence.
SLEEEVRRIVDDIRRTNKELLDRSARRAEEIERRLEELLRRSRERADRIREEMRRMLEKAGDSERVRKLVEDVEKVLKEDIRTNEELLRRVRKVLEEDIKINEDLLRESEEVLKKVIEDVARTTDKKTVDDVLKRLKEENDRSREEIKRSNEESDRVLDEVRKRSEDSNRRLDKIVDEAKKELK

SEQ ID NO: 21800 - protein, 184 aa, Artificial Sequence; identical to SEQ ID NO: 21799
  Synthetic sequence.

SEQ ID NO: 21801 - protein, 177 aa, Artificial Sequence
  Synthetic sequence.
DELEEVLERLREIAERVIKESKEINDELKRSSERSKRESDKVNKRMREIMKELKDRGDKEVVDRVIKELEELVRRTEEILDRDNKELERLVRRSEEIARRVIEELKKLVEDVERGGIDEEDVRRIRKLVEDIARRLKEIIERNRESVRKSREENKKSIEENRRSVKKIADEAREDAR

SEQ ID NO: 21802 - protein, 177 aa, Artificial Sequence; identical to SEQ ID NO: 21801
  Synthetic sequence.

SEQ ID NO: 21803 - protein, 169 aa, Artificial Sequence
  Synthetic sequence.
EETERLIEAVKRIAEEVRKTIERLMERVEKTTRESEELNRRLNRELDREVEEVERANKEEAVKRLKEILERVLEESKRIVEEDNEEAKRVVEEVERIVRELKKFAKKVVDDRRSEELEKVVREVAERLDRLLKALRDLVEESARRNKRLIEETDRRIKEIAERLKRTSD

SEQ ID NO: 21804 - protein, 169 aa, Artificial Sequence; identical to SEQ ID NO: 21803
  Synthetic sequence.

SEQ ID NO: 21805 - protein, 184 aa, Artificial Sequence
  Synthetic sequence.
SEAERLLEELERSTRESAKRIRDLADKLRRSSEESVKDIERLTKELEEAVRRVLDKIRKKKSDKDEVRRLVKELTDILRESHKRVKESIDRDREILEEVIRRVKESIKEDKRRLDDVLAKLRKAPEEVVRRLAKVVEESRRTNEKLLRDLEKLVEDSKRRNDELLEKNARRIKEVEDELKRETK

SEQ ID NO: 21806 - protein, 184 aa, Artificial Sequence; identical to SEQ ID NO: 21805
  Synthetic sequence.

SEQ ID NO: 21807 - protein, 184 aa, Artificial Sequence
  Synthetic sequence.
KDAEDLLRRLRESTKRSEDLVRKLLEELERSSRESEKLIRELTDRLDKVVKDVERRIREKREDKEAVERLVRTLREILERSHRDVERSIREDRKIVEKVIEDAERLVREDKEELRRVLEEIRRVPEEVVKRLEKAVKESEDRNKELLDRLRKRVEDSKRRNDKLLKENRKRIEEIKRRLDELLR

SEQ ID NO: 21808 - protein, 184 aa, Artificial Sequence; identical to SEQ ID NO: 21807
  Synthetic sequence.

SEQ ID NO: 21809 - protein, 184 aa, Artificial Sequence
  Synthetic sequence.
SKAEKLLRDLEKSTEDSERRIRELLERLRESSRTSEELAKRLEEEVERATREVADKIRKKREDEKTVRELVEELRKILEEVIKDAKRLVEEDKRILEEVIRAVERSIKEDRDILEKVLEDIREVPKEVVDRLREIVERSREKNRKLLEDLRRAVEESKKRNEEVLRKLKKKVEEIEEELKERLR

SEQ ID NO: 21810 - protein, 184 aa, Artificial Sequence; identical to SEQ ID NO: 21809
  Synthetic sequence.

SEQ ID NO: 21811 - protein, 184 aa, Artificial Sequence
  Synthetic sequence.
SEIEELLKTLKRSTEKSEEDARRLLEELTRSSEESVKRLRDLTERLKEVAKEVIERIRRRKEEKETVEELIKELEKRLRDSHEEVRRLIEEDRKELDRVIEAVDRSVKRDKRILEEVLKEVRRADKKVVDRLKRMVDESRKRNEELLKRLEKRVRESRKRNDELLEENKRVIDKIREELERLRK

SEQ ID NO: 21812 - protein, 184 aa, Artificial Sequence; identical to SEQ ID NO: 21811
  Synthetic sequence.

SEQ ID NO: 21813 - protein, 188 aa, Artificial Sequence
  Synthetic sequence.
SLLEEIEELVRRAIDTVRRSSEELKRLVDRVNETNKRSTEELRELAERVDRRLDKLLKEIKEGKMVDKLRKLIETIRRVAEEVIRLSEEADRRDSELAKRVLDESRKLLREIERVAEEVRRVVTENDKSRELVEKLKRELRRILEEVRRLNEELMKEIRDTNRKSEKLNRDLKEEIKKILEDVEREVR

SEQ ID NO: 21814 - protein, 188 aa, Artificial Sequence; identical to SEQ ID NO: 21813
  Synthetic sequence.

SEQ ID NO: 21815 - protein, 183 aa, Artificial Sequence
  Synthetic sequence.
DEAEKLKERLKRVLRRVREINRKLLDELRKSNEKVRRINKRLKEELKRVLDEVEKRVREDKNKSRVKEVLKELEEVLRTVDEMSKRSLKENERSLKEVIKRSEKSLKELEDVLRKVEKDVESIDEKLVREIEEMVRRLKEEAEKLSEEIRKIVRESRETLKKLSDEVRRLVERAEEKARKDTK

SEQ ID NO: 21816 - protein, 183 aa, Artificial Sequence; identical to SEQ ID NO: 21815
  Synthetic sequence.

SEQ ID NO: 21817 - protein, 178 aa, Artificial Sequence
  Synthetic sequence.
KEDDDLRREIERLLRELEKMNRKVLEDARRLLEELRRVNKEVAERIKDLERRLKDVVEKKGGKTEEVERILRTVLKEIRDLVRRVAEENKRAVKEIEDLVRRVEELNKEVVRRIEDLVRKRLDERVKEEVDEIRDRLRKSNETLREIVRRIEEDLRKSDRELEELVERIEKRLRELVR

SEQ ID NO: 21818 - protein, 178 aa, Artificial Sequence; identical to SEQ ID NO: 21817
  Synthetic sequence.

SEQ ID NO: 21819 - protein, 188 aa, Artificial Sequence
  Synthetic sequence.
KLVEEVKRLIEESARKNEELIKEVEKEIRRSRKRDKELIEEIERLIREVKKRLEELLTEKKDDDRVREVVRRLEERLKRLLEEVEEVARRNNEILERLLKEVEDVVRTNRERMKELLEEVKTKKDREEAEELVRRVKEEIKRSTTESEKLVKEVKDRARKSHEDSERLAREVLKEIRRLLEEVEKDVR

SEQ ID NO: 21820 - protein, 188 aa, Artificial Sequence; identical to SEQ ID NO: 21819
  Synthetic sequence.

SEQ ID NO: 21821 - protein, 178 aa, Artificial Sequence
  Synthetic sequence.
KEVEDVKELIKKVNEEIKKIHERSNEEIKRVNEELRKIIKKVKDDLRRVLEEIERLSREGTDEKEARKLLERVERIVRKVKDELKKLNDELDETVKDVARKSKELNDRLREIVKKLVKGEDLLREAEKLVEDSRRSSEELVRRDKKLVKESRETSERLVRDLERLLREIEKRVREEAT

SEQ ID NO: 21822 - protein, 178 aa, Artificial Sequence; identical to SEQ ID NO: 21821
  Synthetic sequence.

SEQ ID NO: 21823 - protein, 178 aa, Artificial Sequence
  Synthetic sequence.
SEVETVAELIKDVNRRIREEVEEVKRRIEELNDRNRKIAEEVKERIRRVEDEIREARKRGESEERAKRLLEELRKIVKEVMRRVTESNRRLEETVRRVVERLKRLNDTLRDIVRRLVKGDELLTRIDRLVKDSERSSRKLVRELEELVRRSEEETEKLVRELERLVTEVARKVDEEAT

SEQ ID NO: 21824 - protein, 178 aa, Artificial Sequence; identical to SEQ ID NO: 21823
  Synthetic sequence.

SEQ ID NO: 21825 - protein, 184 aa, Artificial Sequence
  Synthetic sequence.
KDVEEALETLKRILDRVAKDNEDLIRELRDINRKITKENEDLIRDLERILREVEEEVKRRRDEEVLRELVKEVRRVLREILERSKESVKRSEDALREVLKRSRDSVKEVERVLEEIKRILDKSGGDELRRRLEALVEDVRRTLKELIEKTEKVVKEVEDNLRRLLKRTEEVVREVEKKLEEDRR

SEQ ID NO: 21826 - protein, 184 aa, Artificial Sequence; identical to SEQ ID NO: 21825
  Synthetic sequence.

SEQ ID NO: 21827 - protein, 184 aa, Artificial Sequence
  Synthetic sequence.
SEVEKVLEDLKRILEEIARRNEELNERLERINEEITRRNEKSNEETKRVLDKLADDVRKRKDKEVLEELVKDAERVLREDEKRSRESVERSEEALEEVKKRSEDSVREAKKALDEIRKIVKKRGGEELERTLEKLVDEVRKRLKELLDRSRELVKRVRENLERLEEDTRRLVERVRRELEKLRK

SEQ ID NO: 21828 - protein, 184 aa, Artificial Sequence; identical to SEQ ID NO: 21827
  Synthetic sequence.

SEQ ID NO: 21829 - protein, 185 aa, Artificial Sequence
  Synthetic sequence.
DEAEKVKRDIEEILKRVAEELKRVLEEIRRSSEEVERRNKEVLETLKRILEEVKERLKRIDKRRAAEELKRVLEEVERLVEELHRINRESIKRTKELLERVKRKLEAVIEEVRRLVEEVVKRRGEEAELVRELRELVRRIEEELRKLTEEARKLLEDNRRRLEELDRELKELVDRIREELERARK

SEQ ID NO: 21830 - protein, 185 aa, Artificial Sequence; identical to SEQ ID NO: 21829
  Synthetic sequence.

SEQ ID NO: 21831 - protein, 185 aa, Artificial Sequence
  Synthetic sequence.
DEAEKVLEDIKRSSEEVTRRNEKVARDSRKLSEDVEKKNRDVAERIKEIVDKVRRDLSRIDKKEAEKKLREVLKKVEELVKRLHEENRRSLEKSRELVERLHEINRKSEEDIRELVKDVVRKRGREAELVERARELVETNKKRLEDLDRELEELVKENEERLKRLDERLKELVDDIRRRAEEARK

SEQ ID NO: 21832 - protein, 185 aa, Artificial Sequence; identical to SEQ ID NO: 21831
  Synthetic sequence.

SEQ ID NO: 21833 - protein, 184 aa, Artificial Sequence
  Synthetic sequence.
REAEELLKDLERSSEEVDRRVKESNKESEKVSRDVEKKVKDSNKELREITREVAERAKRTDKDMVREIVERLRRTVEDVLRRNREIVDRSRKRSEDLLRRNRKIARENERLLETVLKKVTDDGIDEKMIKRAAELLKTSEDRLRKLIKESEDSIRENEKKLRELIRESEETLREIRKRLEDLER

SEQ ID NO: 21834 - protein, 184 aa, Artificial Sequence; identical to SEQ ID NO: 21833
  Synthetic sequence.

SEQ ID NO: 21835 - protein, 184 aa, Artificial Sequence
  Synthetic sequence.
KEAEDLMEELKKSSEDVERRVRESNKRSKEVSDRVAEEVKKLLERLKKILEEAARKRDRVDKEVLTKIAEDVVREVERVLREVEKILRESVRLSEKLMKENEEIVRKNKELLDRVLEEIKRRGVDEKVIRTIERLVRTSEKKLRKLLDDSRKSVEENRKRVTDLKKEARDLVEDIKRRLEEERR

SEQ ID NO: 21836 - protein, 184 aa, Artificial Sequence; identical to SEQ ID NO: 21835
  Synthetic sequence.

SEQ ID NO: 21837 - protein, 178 aa, Artificial Sequence
  Synthetic sequence.
REEEKVLKDLDDVLKEVTERVREDLRTNEDVVRRAEEEVTRLHEELKRSNDRAKEEVDRKKEDKDVLKKVVEENRRSLERILRRTEEVVERIKKVSEENRRSVEEIVKRLEEVLKEAIRRNDTEEVRKLVRELKEMLKRLEEDARRLVETTKKRLEDLKRTTDKLVKELEKTLEELRR

SEQ ID NO: 21838 - protein, 178 aa, Artificial Sequence; identical to SEQ ID NO: 21837
  Synthetic sequence.

SEQ ID NO: 21839 - protein, 178 aa, Artificial Sequence
  Synthetic sequence.
SDRERVAKKLRDVLKEVDEEAKKDHDTNKTVVKKVREDIERILRRLKEVLRKVKEEAERKKKDKEVLDRVLKELEKVLRDARRDVRRIIEEAKDVSRKNLDSSRKVVEKLKKVLDEVLEENDVEELRKLVKELRDRLRELEESSRKLVEDTRRDLERLREEIDRLVEELERRLEELRR

SEQ ID NO: 21840 - protein, 178 aa, Artificial Sequence; identical to SEQ ID NO: 21839
  Synthetic sequence.

SEQ ID NO: 21841 - protein, 187 aa, Artificial Sequence
  Synthetic sequence.
SDAETVLREIRKLNKEVNDASRETLERIEELNRRVERIVREVLKDIERLAREVEEVVRREGGKSDRVVKIAKDVLREVKELVERVVRVLRKVNKDVRRLVEELKRLAKEVNERVRRLVEEVARRLKGKEELIRRLEEIVKESEDNSKENVDRNDRIVRESERSSKELEDELRRIVKKLAREVDELIR

SEQ ID NO: 21842 - protein, 187 aa, Artificial Sequence; identical to SEQ ID NO: 21841
  Synthetic sequence.

SEQ ID NO: 21843 - protein, 187 aa, Artificial Sequence
  Synthetic sequence.
DDVERVLERIKELNRRVEEIVRRVLKTSRDLNKELNDISREVLKRIKDLMREVEEVVRRDGGESKDVEDILRRVLEEVKRLVDEVERLAREINEESRRLSERVKRTAEEVNKEVKRLVERVVEKLKGKEELIRELERIVEESKRTSDKLAKELDKLNEDSERNSRKNIEDLRRLVEELARKAEELIK

SEQ ID NO: 21844 - protein, 187 aa, Artificial Sequence; identical to SEQ ID NO: 21843
  Synthetic sequence.

SEQ ID NO: 21845 - protein, 188 aa, Artificial Sequence
  Synthetic sequence.
SLVEELEKLVEENERNMRELDKENRDIVEKNRENVERNERELRKLVERLERRIREVVRTKSDSEELKRIAEEVIRRVRELVKEVKRIAEKSIRDTDRLVKEVSEVNKKSIEDVKRLVDTVRRVTSDERLEEIVREVKERIKRSNDEANKENKRTLDEIRDSNRDVNRVSKEVLDEIRRLLKELEDAAK

SEQ ID NO: 21846 - protein, 188 aa, Artificial Sequence; identical to SEQ ID NO: 21845
  Synthetic sequence.

SEQ ID NO: 21847 - protein, 188 aa, Artificial Sequence
  Synthetic sequence.
SLIETLEELVDRNRRNLEKLDEENKDMLRKNEEDVEKNERDLRKLVKELRDEIRKLIEEKDKVEDLKRIAEEVIKEVDELVKRVTDILRESIKETERLIREVSKVNEDSIRTVEDLVRRVAEVKDDERLEDIVREVIKRIEESNRRVNKRNRETLERSKKSNKDVNEASERVLRRIKELLDELRERAK

SEQ ID NO: 21848 - protein, 188 aa, Artificial Sequence; identical to SEQ ID NO: 21847
  Synthetic sequence.

SEQ ID NO: 21849 - protein, 188 aa, Artificial Sequence
  Synthetic sequence.
SLEEELRRLVEELEKRLRELDKRNKDLLRENERNVEKLARDLEELVKKVRRVVEDVVTKKPDSEELKRIAEDVERRVEKLVRDVRRILEESIRDTKRLIDEVSDVNRKVIKEVEELVREVSKVTSDERLEDIVREVLKRVKDLLERAEEENKKTLDDSRKSNEEVNREVEKVIRRIEELVKRLEEAAK

SEQ ID NO: 21850 - protein, 188 aa, Artificial Sequence; identical to SEQ ID NO: 21849
  Synthetic sequence.

SEQ ID NO: 21851 - protein, 188 aa, Artificial Sequence
  Synthetic sequence.
DLVERLEELLKKIKRELEENIKRNRELLKKLEENLRRNEEKNRKLLEEIRKRLEDLLREKSDVEEVRKVAKEVEDKVRKVLEDSKRVVDTLRELAREHLKHSEDVVRELEERLKELLDEVRRKKDREEAEELVRRVEERMKEMVKRVHEVSEKNLRDIKKWLEDVNRISKETLDRLRELLKEAERRVR

SEQ ID NO: 21852 - protein, 188 aa, Artificial Sequence; identical to SEQ ID NO: 21851
  Synthetic sequence.

SEQ ID NO: 21853 - protein, 188 aa, Artificial Sequence
  Synthetic sequence.
SLREELEELLKRIKERLKRLIEENRRLLEDLRRNLEENIRRNERTVEELKRDVKRLLDEKSDVDKVREVIKELEKRLEEILRRSREVVEELRRRVEEHLRHSERVVKELEKRVTELLREVERKKDEERAEELVRRVKEEMERAVEEVKKTSEENLKAIKTWLEEVNRISEETLRRMREVLKELREDAK

SEQ ID NO: 21854 - protein, 188 aa, Artificial Sequence; identical to SEQ ID NO: 21853
  Synthetic sequence.

SEQ ID NO: 21855 - protein, 188 aa, Artificial Sequence
  Synthetic sequence.
RLVEELEKLLKDSHDKDRKLIRENEELLKELKRNLDENIKTNEELVDRIRKRVEDLLREKSDVDEVRKVIEDVERTVRRLVEESKRVVETLRELARRHLEHSRKVARENNERLKRLLEEVRRKKDEERAEDLVRRVEKEARDSSDESRRISEENLKEIKKWLDEVNEISKRTLEDAKRLLEDLERKAT

SEQ ID NO: 21856 - protein, 188 aa, Artificial Sequence; identical to SEQ ID NO: 21855
  Synthetic sequence.

SEQ ID NO: 21857 - protein, 184 aa, Artificial Sequence
  Synthetic sequence.
DLEEELKTVLDRARKDVKRLKEELERILEEVKRMVEELDKRLEDLDEEVREKVKRLIDEKKDVEEARKKLKEVLEDSRRLSEEAHRINRKVLKDVEKLIRDVERILEEVIRRVEKLIEEVKRITDERDVKRVLREAEELLKRVRDLVEKVLREIKRILEEVEELNRRIIRTSREILKRVEEEVK

SEQ ID NO: 21858 - protein, 184 aa, Artificial Sequence; identical to SEQ ID NO: 21857
  Synthetic sequence.

SEQ ID NO: 21859 - protein, 184 aa, Artificial Sequence
  Synthetic sequence.
SLEERLDKVRRRVEEEIKRLEDRLEELDRRVAETVKRLDDEARKLDEELRERVKDIIRKKDKVDDARRMLEEVIKRSEELSKKAHDINKRVLDESKRLSDEVRKILEEVRERVRELIERVKRITEEEKVKRVIEEMEEIVKEVRKRVDEVIKTSEEILRRVRELNKEILKESEDLAEEVRKKAT

SEQ ID NO: 21860 - protein, 184 aa, Artificial Sequence; identical to SEQ ID NO: 21859
  Synthetic sequence.

SEQ ID NO: 21861 - protein, 184 aa, Artificial Sequence
  Synthetic sequence.
KLEDELRKILEENRRIVKELEERMKRLDEAVRKAVEDLARSNEESNKRVKEVVDDLIRKKPDDEDAKRMLERVLRESKRLSDDSKRILERVLEESKRLSERVKRILERSIREAERLVEEVKRIDKEEDVKKVLDDIKESSDRVRREIEEVLKESEERLRRVEKKNEDIDRRSEEILDDVRRKAK

SEQ ID NO: 21862 - protein, 184 aa, Artificial Sequence; identical to SEQ ID NO: 21861
  Synthetic sequence.

SEQ ID NO: 21863 - protein, 183 aa, Artificial Sequence
  Synthetic sequence.
SLEEKARDVLRRSKELNDENRERAERMLDTNRRIADKLREEVERILREVEETVRRLIDEKKDSKRVRDLLRKLEEDVRKVLEDIERILKKSIEVSRRILEDSDKILKENLDLAREVLERVRRVSEDVVERLLKEVEDSSRRVHKRSEELLRESREISERVRETVKKLLEDVERLLRKVTKEVK

SEQ ID NO: 21864 - protein, 183 aa, Artificial Sequence; identical to SEQ ID NO: 21863
  Synthetic sequence.

SEQ ID NO: 21865 - protein, 183 aa, Artificial Sequence
  Synthetic sequence.
SLEDELREVLERSREKNERLRREAKKLLDTDRERVREILREAEKVLEEVKRTVEDLVREKDKVDEVRELLKRLEEAVRDVLRRLAELLERSLRVSEEVLRDVERILKENLELVKRVLERVRRVEEKVVEELLKRVEDSSKKVEDDVRRLLKEVEKISTELEELAKELVEEVRRIVKEVADRVK

SEQ ID NO: 21866 - protein, 183 aa, Artificial Sequence; identical to SEQ ID NO: 21865
  Synthetic sequence.

SEQ ID NO: 21867 - protein, 183 aa, Artificial Sequence
  Synthetic sequence.
SLEERAEKILRDSKRTNEKNEEDVRRLLERNERRVRKIEEEAKKVLEDVRREVERLIREKKDDKRVRDILARVIEEVERVLDEVRKLLEESLEMSERVLRESKKILKENLDLVKKALDDLRRVEEDVVRKLLDEVRESSERVHRKSEELLRRVEEISRTVEREVKKLLDRVRRVLEEAEKEVR

SEQ ID NO: 21868 - protein, 183 aa, Artificial Sequence; identical to SEQ ID NO: 21867
  Synthetic sequence.

SEQ ID NO: 21869 - protein, 179 aa, Artificial Sequence
  Synthetic sequence.
DESRELVERVERVVRKVEKDHERLDRANKESTDRVREAVRRLDEENREVVRKVEDEVKKVQDKKEVVKELVRDLERLSREVLRRVEELLRRNDEISRRLLEESRRLVKELEKILEDVLRAVPDSKEAERLLDDVRRKLEELVRNAERSLEESRKTNEELEKRVRESLKEVERVLRELEK

SEQ ID NO: 21870 - protein, 179 aa, Artificial Sequence; identical to SEQ ID NO: 21869
  Synthetic sequence.

SEQ ID NO: 21871 - protein, 179 aa, Artificial Sequence
  Synthetic sequence.
RETEEVIKTLEEVVKEVEERVRRLDEENKESTERVKKTVDDLDEENKRVVREVERRVKEVQDKKEVVTDLVRRLEEISRRVLREVEKLLKRNDEISKEVLERVKELVRRLKKIVKEVLDRAPDSKRMEEVLKRVDERLKELERKVTDSLRRSREVNKRLRDKVEKSLREVEKVLEDLKR

SEQ ID NO: 21872 - protein, 179 aa, Artificial Sequence; identical to SEQ ID NO: 21871
  Synthetic sequence.

SEQ ID NO: 21873 - protein, 184 aa, Artificial Sequence
  Synthetic sequence.
SLEERLREILKRNKEDVEDIRRRLEEILKRNKEEIDRLREELRRILEEVKREVKELIKRKSTDERLIRIAEDVIRRVKKLVDEVDDIARKSHERVRRLVEEVKRILKESHDTLRRLVRKVREDNDEKTAEEVIERIKKLTEDVRRDVERVIREIEKSSDDLRKVVKDVIDDIKRLLKELREEIN

SEQ ID NO: 21874 - protein, 184 aa, Artificial Sequence; identical to SEQ ID NO: 21873
  Synthetic sequence.

SEQ ID NO: 21875 - protein, 184 aa, Artificial Sequence
  Synthetic sequence.
SLEERLRKILTENERVIRKLERDLEENLERNKKTVKEIEDRLRKLDEDVERLVRELLRRKSTSKDLKKEVEDVLRKSRKLTREVEEILRRSIKRSAELVKRVRDIVRESHKELRRLVEEVRKDNDKDTAEEVIKEIEELTRRLEEEVRRVNERSDKSNEDVRRRVKEVEDESRDLARRLAERVN

SEQ ID NO: 21876 - protein, 184 aa, Artificial Sequence; identical to SEQ ID NO: 21875
  Synthetic sequence.

SEQ ID NO: 21877 - protein, 188 aa, Artificial Sequence
  Synthetic sequence.
SLEERLRKILEKVKRTVDESRKRSKRLLEENRETMDRLREEAEEILERVKEKIKELVDRKKDSERVKEVVRRVLEEVERLLEEVERVLRESIKTSEDLLRENEEMLKKLEDRAKKLVDEVRTKKDREEAEKLVEEVIRDLDRVADELRELSKRLSDRSRESNERVRRTVKEVIKEIKRVLKELEEKVK

SEQ ID NO: 21878 - protein, 188 aa, Artificial Sequence; identical to SEQ ID NO: 21877
  Synthetic sequence.

SEQ ID NO: 21879 - protein, 188 aa, Artificial Sequence
  Synthetic sequence.
DLRERMEKLLKEVKDEIDKSEKKSEDNLRTNKKDVDEIRKRLKRILDEVKEELRKLIDEKRDSERVKEVLKRVIETVADLLRRVDEVLRRSIKISKELLEENKKVLEEAKEEVDRLLKEVEDKESDERAEELVDRVAKRIRRVVEDVKRKSEDLNRKSNESNKRVRDLVERVKEEIDKVRDELRKSVK

SEQ ID NO: 21880 - protein, 188 aa, Artificial Sequence; identical to SEQ ID NO: 21879
  Synthetic sequence.

SEQ ID NO: 21881 - protein, 181 aa, Artificial Sequence
  Synthetic sequence.
SEEERIRELLERVRRRLEESKKKSKDVADEVKETNDESRERSEKLLREVEERLRELLRELDEERVKKLLKELKDRVKELLERDDKVLRENEKSVRDVLRTDEDVVRKLEEKLERVLDVVRKGEKDVEELRKEVEEVVERVRRISERLTEELRRSSERVKRISERLLEDLERVVRDVARRVK

SEQ ID NO: 21882 - protein, 181 aa, Artificial Sequence; identical to SEQ ID NO: 21881
  Synthetic sequence.

SEQ ID NO: 21883 - protein, 181 aa, Artificial Sequence
  Synthetic sequence.
SEEERIRELLERVDRRLKESEKRSTDVARRVREENKELEKAARKILEDARRELEKLLREIDDEEVRRVLRELEKIVREVLRRVEELLKRNEESVERVLREDKKVADDLRRELKKVLDVVRRGEKDVEELIKRVEDMVREVEKTSRKLIEELKRSSDEVRKMVEELLRRLERVLEEVKKRVK

SEQ ID NO: 21884 - protein, 181 aa, Artificial Sequence; identical to SEQ ID NO: 21883
  Synthetic sequence.

SEQ ID NO: 21885 - protein, 181 aa, Artificial Sequence
  Synthetic sequence.
KDEETVTKLLEDVERKNRESEKDSRKIVEDVKDENRKLEDEARKSLEDSERKLERLERDVDEERVRTVVRDLERISEEILRKIKEVVERNRKSLEDVLKKDKEVADRNRKTLKDVVELLKRGEVDVRELAKRLRESTERVEEISRRLIKELEDSSDKVRKVVEDLLRENKEAVRRVAEEAT

SEQ ID NO: 21886 - protein, 181 aa, Artificial Sequence; identical to SEQ ID NO: 21885
  Synthetic sequence.

SEQ ID NO: 21887 - protein, 186 aa, Artificial Sequence
  Synthetic sequence.
SELEKVEEDIRRLVERVKKIAEDVERLTRELVKEVRKSTEDSVRDIERLMKELREIARDVSDKEELIRRLEEVVKRVEESVRRDVDLLKRVVERSEDISRELRKEAEEVVKTVRRIVEELIRRRDKDKDAKKRLEDLLDTLRKIVEDVSRRLKELNDRLRKLVEDSKRRNEELLRRLREIVKEIAK

SEQ ID NO: 21888 - protein, 186 aa, Artificial Sequence; identical to SEQ ID NO: 21887
  Synthetic sequence.

SEQ ID NO: 21889 - protein, 186 aa, Artificial Sequence
  Synthetic sequence.
DSDKEVEKRIRELMKEVKDSTKESEDKIRESNERVKESSKRSEDEIRKLMEELDEIAKRVKDKKDLEELLRRVEETVKKLVDDDKETLRKVLEENRKSVEDDDRRLREVVERVERIVRELIRERDKDEDATRRLKKLLDDLKKEVDDSRRRNDELIKETERLIRESAKRNDKLLEDLKKRVDEIRK

SEQ ID NO: 21890 - protein, 186 aa, Artificial Sequence; identical to SEQ ID NO: 21889
  Synthetic sequence.

SEQ ID NO: 21891 - protein, 186 aa, Artificial Sequence
  Synthetic sequence.
DEREEVEKRIRDLAEEVRRIVKRVEDETRRLVEEVKKSSDDSRRTIEKLARELKEITRRVKDKRTLIEILRRVVEEVEELVRDDVDKLRRVVEESERISRRLEEKLEEVVKRVEEIVRRLIKRRKDDKEAKDRLEDLLRRLREEVKRVKEKLKKLNDDLRREVEKSKEDNERLLKKLRDEVRKSAT

SEQ ID NO: 21892 - protein, 186 aa, Artificial Sequence; identical to SEQ ID NO: 21891
  Synthetic sequence.

SEQ ID NO: 21893 - protein, 171 aa, Artificial Sequence
  Synthetic sequence.
DEVEKVLREIEKLIKEIREINKRINDRIEELIRRLRERVKKVSRESEELIRDLRRDGKEELVKEVLKRSEDLARRVKEEVKRVLEEVRELVERSVRIAEEVLREVRELVRKKLKDERKAREIIKRVEKVLEEVRRSLETSEKRVRDALREIEERLKENKRRVREVLEEIRK

SEQ ID NO: 21894 - protein, 171 aa, Artificial Sequence; identical to SEQ ID NO: 21893
  Synthetic sequence.

SEQ ID NO: 21895 - protein, 179 aa, Artificial Sequence
  Synthetic sequence.
DEKEKLIKEVEDSTETVKRLVEELSRRSKKITEDVERLVKKLSDESKKILDEVRDLVRKRGGRAKDVEEILKRVTRISEELVKRVEEILRKSNKVSRDIVKEVREILKEDEDLVRDVVRKLRNSEEADKLRKRSEDMVRRIEEHLKKNLKENKDALDKIRKELRENIETTKKTVDDIRK

SEQ ID NO: 21896 - protein, 179 aa, Artificial Sequence; identical to SEQ ID NO: 21895
  Synthetic sequence.

SEQ ID NO: 21897 - protein, 179 aa, Artificial Sequence
  Synthetic sequence.
DEKDKLIEELDKILEDVRRRVEELSRRSKEITETVKELVKRLSDESERILREVDDVVRKRGGRAEDVDRILKEVLRFSKRIVEEIERILRESNKVSKEIVDEVRKILEKLERDVEDVVRKLRDSEKAREVRRKVKETVERIEEELRRNIEENREMVERVEREARKNIKDTRKRVEEIRK

SEQ ID NO: 21898 - protein, 179 aa, Artificial Sequence; identical to SEQ ID NO: 21897
  Synthetic sequence.

SEQ ID NO: 21899 - protein, 187 aa, Artificial Sequence
  Synthetic sequence.
RVEEKLEKIKRDIEKLVEDMKESNTRSKRKLEKLVEEMRRNNEELTRRVEELVKKIEDDVRGKKLEEVKRLAKELREIAERSRKLSEELARELEKSVKDSLDESRRLARELEEVVRDVLRKIRKERENEDLVRRLLEEIRRILEEVRRTDKELLDENERILREVEKLNRDLVKEIEEILKKVEDDVR

SEQ ID NO: 21900 - protein, 187 aa, Artificial Sequence; identical to SEQ ID NO: 21899
  Synthetic sequence.

SEQ ID NO: 21901 - protein, 182 aa, Artificial Sequence
  Synthetic sequence.
SEVEKAIEEIEKVIKEVRDKNRRVLEESKKLIRTVEETNKRNIEEIEKWIKTLDELTDRNSDKKVIEKVLKELEDEVRRHVEHSERVLREAIKISEELVRRSEEVLKEVTERVERIVRKVVRTEDAAKKAKEIIDKLRTLVEEVKRTNDKSLRDTREVVRRVEETLRRVEEKVKKRVDEIRK

SEQ ID NO: 21902 - protein, 182 aa, Artificial Sequence; identical to SEQ ID NO: 21901
  Synthetic sequence.

SEQ ID NO: 21903 - protein, 182 aa, Artificial Sequence
  Synthetic sequence.
SEVEEVIRRIEEVLKELRRKNEEVLRESERANDEVRRVNEKNIRDIKKWLEDVKREVDNNRDKREIEKVLRELEKRVREHVEHSKRVLDELRETSRRLVERSEELLRRVRKEVKELVDKVVRSEDARRRAEELERRVDKVVREVEKTNKESEEESKKLVDDVRRTLREITERVKDAVEKTLR

SEQ ID NO: 21904 - protein, 182 aa, Artificial Sequence; identical to SEQ ID NO: 21903
  Synthetic sequence.

SEQ ID NO: 21905 - protein, 186 aa, Artificial Sequence
  Synthetic sequence.
SRDEEVARRVERVLEESEKLSKEVAEENEKVLREAREILEDVRKKVEDVARTLRELAKKVEDKDDLVRKVKKLVDEVEEILKDVIRRVRKLVKDLHDKNRRSLEESRRLVEEVEEILKDVIREEDKNEEAKRRLEDLRRKLEELVKRNEKKLRDLDERLKELVERIERAAEKLLRDLRDLVRKITK

SEQ ID NO: 21906 - protein, 186 aa, Artificial Sequence; identical to SEQ ID NO: 21905
  Synthetic sequence.

SEQ ID NO: 21907 - protein, 186 aa, Artificial Sequence
  Synthetic sequence.
RELEKVEKEVEDVLRDIERSSDEVRRENKRVAREMEESSRKVAEDVERVLRTLEELAKKVSDKDDLLRRVKKLVDEVRRRLEESIKRSEDLVRELHEINKRSIEETEKLLRDVEEILKDVIRKKDKNEEAKKRAEELVRRLEELLERNRETLERLDKELKDLVEKNKRTAEKLVKELEELVERIRK

SEQ ID NO: 21908 - protein, 186 aa, Artificial Sequence; identical to SEQ ID NO: 21907
  Synthetic sequence.

SEQ ID NO: 21909 - protein, 189 aa, Artificial Sequence
  Synthetic sequence.
DELERVRREVKRLADESEKVSREVEERVRDTNRKSEEISRRVEKLARELLKKVEEVERRSGTEEALRDVIRELKKVLETVKKIVEDSVRTSEKLLKENERIVEESRKTSEDIVRRIREIVEELVRRRDKDEDLKRTLDELRKTIEKLVKDNRETLERLIRESEETIKRNREKLEELKRRLETLLRRVRK

SEQ ID NO: 21910 - protein, 189 aa, Artificial Sequence; identical to SEQ ID NO: 21909
  Synthetic sequence.

SEQ ID NO: 21911 - protein, 189 aa, Artificial Sequence
  Synthetic sequence.
DELEDVRRRVDELVEELERVSRRVAELVKRIIDESRDISRRVARRVEELLRRLREVTKRSGTEEAREEVERTVERVLEEVERILRESVEISRRLVERIREIVRESLERSREVVKTIREIVKRLLEKRKDDDELRKRLEDLKRKIERLLEDNRRKLEELIRRAEKVVEENERTMRKLKEDAKRLLEEIRK

SEQ ID NO: 21912 - protein, 189 aa, Artificial Sequence; identical to SEQ ID NO: 21911
  Synthetic sequence.

SEQ ID NO: 21913 - protein, 177 aa, Artificial Sequence
  Synthetic sequence.
SVEDLVREVEERVRKVEKDLRELLDRLRRENEDAVRRSRESLRRNEEENKRVVDELRKDGVPESLVRELEESVKRVKEISDELLKRSKRSLEEVEEIIRRLEEDLKRVLDEIRKVATDGDGREEVVKKVREVLERVKETVKRVVDRNREVVKRLEDENRKVSEENKRVVEKVKEDAR

SEQ ID NO: 21914 - protein, 177 aa, Artificial Sequence; identical to SEQ ID NO: 21913
  Synthetic sequence.

SEQ ID NO: 21915 - protein, 177 aa, Artificial Sequence
  Synthetic sequence.
SVEELVRRIAEKLRKVLDEIERLVDELRKENEEVVRDIERLVEDNEREVRDVLRKLEKDGAPRSLLKTLEESSREVRKRIKKLVEDSRRSVKEVEERIRKLKEELKRVLEKIKKLAEDGDGSEDLVRDAERVLKRVTDEVRRVVKENKDVVRKVREEVERVSEENKRVLEKVTRDTK

SEQ ID NO: 21916 - protein, 177 aa, Artificial Sequence; identical to SEQ ID NO: 21915
  Synthetic sequence.

SEQ ID NO: 21917 - protein, 185 aa, Artificial Sequence
  Synthetic sequence.
DEVETLKREVERLNKEVLDRVRKVIKEIKELDDRVRRENERVIREVERLIEEVRDRVRKNSDVKELVKRLADELRRVVKESKRLTEELVRLSEEVNKRLEEEVRRLVEESKRVLREAKRVLDEDRDRRAEKIVKELREHSDEVVREMRELVERSKRHSTKVVEELKKSNKELEEKVRKVVRELEK

SEQ ID NO: 21918 - protein, 185 aa, Artificial Sequence; identical to SEQ ID NO: 21917
  Synthetic sequence.

SEQ ID NO: 21919 - protein, 185 aa, Artificial Sequence
  Synthetic sequence.
SEVEELRERIKELNKRVLDTVRRVLERVKELNEEVDRRNKEVIKEVERLLEEVKREVTREKDSKKLIDDLAKRLEDIVRKSKKDTRELVKRSKRINDEAEKLVRKLVEESRKVLEDAAEVLKKDRDRRAEKIVDDIRRHSEDVVRRMRKLVEDSRRHSKRVVEEMERSNRELEERVKRVVEELKR

SEQ ID NO: 21920 - protein, 185 aa, Artificial Sequence; identical to SEQ ID NO: 21919
  Synthetic sequence.

SEQ ID NO: 21921 - protein, 185 aa, Artificial Sequence
  Synthetic sequence.
SEVEELIKEIRRLNEEVRRRNKKVIEEVKKLNEDVKRKNDKVIEDVERLLREVKKRVEDESDSKELIKKLAKELEDVVRESEKETRRLADESRKINKESRDRTKKLVEESKEVVDRAARVIEKDRDRRVEEIVRTIEKHSRDVVREMERSNDESEKHSRKVVREMEKSNKELKKKVEKIVRDLEK

SEQ ID NO: 21922 - protein, 185 aa, Artificial Sequence; identical to SEQ ID NO: 21921
  Synthetic sequence.

SEQ ID NO: 21923 - protein, 185 aa, Artificial Sequence
  Synthetic sequence.
SEVEKLKREVERLNEEVLRRVRKVIEDSKRLNEEVRKRNEDVLKELKDLIREVKRRVEEEDKVKELVKKLARRLEEVVKDSKRRTKKLVEDSKKVNDEIRKLVRELAEESKTVLEEVRKVLKKDPDDRMRKIVEDLRRHSEEVVREAEDLVRRSEEDSRRVAREMEKSNEEIEKEARDVVRELER

SEQ ID NO: 21924 - protein, 185 aa, Artificial Sequence; identical to SEQ ID NO: 21923
  Synthetic sequence.

SEQ ID NO: 21925 - protein, 185 aa, Artificial Sequence
  Synthetic sequence.
SEVERVVKEAEDLSRENNKRVKEVVRRAEDTNRRVEDENRKLLKEIKDLLREVKETVKRIPKREAVKIAEKVLREVRELVKRSREIAKKVLEDNADLVRRVKESSEKVLKDVEDLVRELLDRKRDVERVRRLLEEVLRRVAEDVRRSEEELDKVLRDSAESLKRSDKSLRDIVREVEKVLDEIRK

SEQ ID NO: 21926 - protein, 185 aa, Artificial Sequence; identical to SEQ ID NO: 21925
  Synthetic sequence.

SEQ ID NO: 21927 - protein, 176 aa, Artificial Sequence
  Synthetic sequence.
SAEDLLRKLREDVERVMRELRKSNEESRKRVEEVVEEAERILKESRERSEELVRRLNVDRLAEELRDVDRRIDKDVKKAVEDLRRSVDRSLKDTEDLVRELREVLKRVADVVRKTRVEEVLRKLAEDVKRVLDKVKEENKRLLEENDRMLEEVRRLLKKLLEESEKVLEEVERKAR

SEQ ID NO: 21928 - protein, 176 aa, Artificial Sequence; identical to SEQ ID NO: 21927
  Synthetic sequence.

SEQ ID NO: 21929 - protein, 183 aa, Artificial Sequence
  Synthetic sequence.
DLREEIRKLREDAKRVIDESRKSVKENEKRNKKLLDESEKSVRENEERNKELIKRVKDRGVPEDIVREVKELLDRSIKKLREVTEEIERTLKDSIKKLKDVTREIERLAREVIKRLEEVERANVREVLRKVKEELRRVLEKLRRLNEEASRENERILRELRKKNRDMNEDNRRILEELDEKAR

SEQ ID NO: 21930 - protein, 183 aa, Artificial Sequence; identical to SEQ ID NO: 21929
  Synthetic sequence.

SEQ ID NO: 21931 - protein, 183 aa, Artificial Sequence
  Synthetic sequence.
DMEREVEKLERELRELIKRIRKIVDENRRRNEELLERSRESVRRNEEENRKLLEEVKKSGVPEEIVERIRKLLEDSIRKLRKVTKEIEEELRRSIEKAERVVEEVERLAEEAIRRLRDVLKANVEKVLREVKEEVRKLLEEIEKTVRDVSRENKRILDELRKKNKRADEENREILKKLREDVR

SEQ ID NO: 21932 - protein, 183 aa, Artificial Sequence; identical to SEQ ID NO: 21931
  Synthetic sequence.

SEQ ID NO: 21933 - protein, 183 aa, Artificial Sequence
  Synthetic sequence.
SMEEEIRRLEEDVRRLVDKSRKSVKENEERNRKLLEESKESVRDNARRNEKLIRDVRRKGVPEDIVREVEELLRDSIRDLKRVTDEIRKKLEESIKKLREVTERIERLLRKLITEAREVLRANVREMLEEVLRRLEDALRRLEEENKRVSEDNERILEELRRKNEEADKRNRDILDDLRRRAD

SEQ ID NO: 21934 - protein, 183 aa, Artificial Sequence; identical to SEQ ID NO: 21933
  Synthetic sequence.

SEQ ID NO: 21935 - protein, 183 aa, Artificial Sequence
  Synthetic sequence.
DMEDKVRKLERDVRELIKEVEKIVRDNADENRRVVEESEKSVRELADRARRLIDEIRKGGVPDEIVRRVEKALREVIKRLRDVTDEIRKLAKDSIDRLKKVVEDIRRELERAVKLLREVLSANSEDVLREVKERVEEVLDRVRKKVEKVSRENKEIVKEVRKKNEDAVREAEELLKKIREEVR

SEQ ID NO: 21936 - protein, 183 aa, Artificial Sequence; identical to SEQ ID NO: 21935
  Synthetic sequence.

SEQ ID NO: 21937 - protein, 186 aa, Artificial Sequence
  Synthetic sequence.
DEVEEVVRRIEELIKEVEDVDRDIERRVKELDEELRRVDDEIRRRAKKLLDDLEKRVREISDKETVVRIAREVLKEVKRLVEESRKIATDVLRENERLAKESTDIVREVKRRVEDLVKKLTDTKKDSERVRRILTELRKRVEKVVRDSEKTLRESVERSARLLKESKESLEELERRAREVVERIKK

SEQ ID NO: 21938 - protein, 186 aa, Artificial Sequence; identical to SEQ ID NO: 21937
  Synthetic sequence.

SEQ ID NO: 21939 - protein, 186 aa, Artificial Sequence
  Synthetic sequence.
DELEEAEKKVRDLIRRLREMNERALRESERLIRRLREVDEEIVRRIEDLLKKLREEVEREKDKETVKRIVEKVREDVRRLVKTSEEIVRRVLEEDKRLIKESKDIADRMLEEVRRLLREVLETKKDSREVRKTLKDLEDTVKRVLEESEESARESEKRSRDVLRESERSLRELEKKVRKLLEEVKK

SEQ ID NO: 21940 - protein, 186 aa, Artificial Sequence; identical to SEQ ID NO: 21939
  Synthetic sequence.

SEQ ID NO: 21941 - protein, 181 aa, Artificial Sequence
  Synthetic sequence.
SDVDKVAKEIDDALKDVRRKVDKVRKDNERVNREVEERVRRVTERNRDVIEEVKRRVEEVKEDKDRLDELLKEVKRSTDRVEETVKRLLERSEESVKEVVEILRKLLKDLERVVKEVRDRIGEKVSELVREIERRLEELVKELRKILDELRKRNEDTRRRLEEALKRNREEAERLEREIRK

SEQ ID NO: 21942 - protein, 181 aa, Artificial Sequence; identical to SEQ ID NO: 21941
  Synthetic sequence.

SEQ ID NO: 21943 - protein, 181 aa, Artificial Sequence
  Synthetic sequence.
KDVDEIATELDEVIDRIRKKVKEVVERDEKVNRDVNDEVDKLTERNRRVLDKVLKDVTRRKEEREVVEELLERLKKSTDDVRKTVKKLLRESEESVERVRETLERLLEEVDRVLKEVEERIGRKVDRLVDELRKRVEDAKREIREILEKLKRDNDESKKRLERLLKENEDALREILERLRK

SEQ ID NO: 21944 - protein, 181 aa, Artificial Sequence; identical to SEQ ID NO: 21943
  Synthetic sequence.

SEQ ID NO: 21945 - protein, 181 aa, Artificial Sequence
  Synthetic sequence.
DDVEKAVREVEEMLKRVDKEVERVSRENKRVSDEVRKKVKEVERKIKEVLDRIKDEVDRVKDDKEVLRELVERARDVVRKVREELRKLLKEDRESSEDVDRIVTELLRRLEEVLDDVRRRIGEKVDELVKRLEDKMRRVKEKLKRLLEKNREDSERSERELREILKKITREVEELAKELEK

SEQ ID NO: 21946 - protein, 181 aa, Artificial Sequence; identical to SEQ ID NO: 21945
  Synthetic sequence.

SEQ ID NO: 21947 - protein, 172 aa, Artificial Sequence
  Synthetic sequence.
EEVKKLLEEVRDLLRRVLEEVERSSDEDRKLNERVNEAIEKSIREVEELLRRIDREVDGGEEAVRRLRKVVKESRDLSEELVRRLEESLRDSRRRSKELVERLEKIVEDAERAGVREELVEELKRRVDEVKRRAEEINRENDERNKESKRRLEELNERLEERVRRLEEKLKK

SEQ ID NO: 21948 - protein, 172 aa, Artificial Sequence; identical to SEQ ID NO: 21947
  Synthetic sequence.

SEQ ID NO: 21949 - protein, 172 aa, Artificial Sequence
  Synthetic sequence.
DEVEDLRRRVEKILEDVKRTVETASKRDRELNEEVNRLLRESVERVDRLLDRIRREADGGEEVVRDAERIVKESEKLSTDLVRRLRDSLRRLEELVERLVRELERVVKEAEEAGVRKEIVDRLRKAVEEVSREARKILDENRRRNEESEKRMREINKRLEDKVREVKKELEK

SEQ ID NO: 21950 - protein, 172 aa, Artificial Sequence; identical to SEQ ID NO: 21949
  Synthetic sequence.

SEQ ID NO: 21951 - protein, 172 aa, Artificial Sequence
  Synthetic sequence.
REVDKLREDVRRLLEELLRALRESSKEDEKLNRKVNREVDRVLKEVDDLLEDIKKRVDGGKEAVEELERVVRKVEDLVRRLVEELEKSLRDSERLSREVVKKLEKIVEDAERAGVREEIVKRLEEEVREIVKEIKEINDKNRKKNEDSARKADEKVKELEERVRRVVKELRD

SEQ ID NO: 21952 - protein, 172 aa, Artificial Sequence; identical to SEQ ID NO: 21951
  Synthetic sequence.

SEQ ID NO: 21953 - protein, 172 aa, Artificial Sequence
  Synthetic sequence.
KEVEDLVRRVEKLLRDIDRELKRSSDEDRELNERVNREVDRVLREVDRLLKEIRETVRGGKEAKETLERVVEKVERLARKLVEELRRSVEKSRKLSEKVMRDLEKVVDDARKAGVEERIVRTLEKRIRDLVRKAEEIDRENEKRNKESSDRMERLVRELRKRVKRLVEELER

SEQ ID NO: 21954 - protein, 172 aa, Artificial Sequence; identical to SEQ ID NO: 21953
  Synthetic sequence.

SEQ ID NO: 21955 - protein, 172 aa, Artificial Sequence
  Synthetic sequence.
DEMRRLLREVERILEEVERVLEKSVRDDERVNREVNRRLDEVLRRVEDLLRRIEKEVRGGREAVELLKEVVDRVRRLVEELVKLMEDTLRRSRELSERLVREARRVVEELRAGGVEERLLERVRREVEKVRERADRIDKRLEDTNRRSKDRAEELVRELEKRVEDLKEKAEK

SEQ ID NO: 21956 - protein, 172 aa, Artificial Sequence; identical to SEQ ID NO: 21955
  Synthetic sequence.

SEQ ID NO: 21957 - protein, 172 aa, Artificial Sequence
  Synthetic sequence.
DEVRKLEEEVDRILREVKEMVEDSIRRHKEVNDEIRRRVERVLEEVKTLLDLIREKDRGGKEAVDRLRKVVTDVERTARELVRRSEKTVRESEELSRRLVERLEKVVEDAERAGVRKEIVDELRKRVEDVSREAKKLDDDLRENVKRLSEEMKKLVDDLRREVDRLEKERRK

SEQ ID NO: 21958 - protein, 172 aa, Artificial Sequence; identical to SEQ ID NO: 21957
  Synthetic sequence.

SEQ ID NO: 21959 - protein, 172 aa, Artificial Sequence
  Synthetic sequence.
DEVEELRRKVEEILRRIREDVRKSIEDHRDVNRRVLEAVRRSTKRNKDVVDRLRDEDRGGEEAARTLERTLKRSEELSRELVERSRKTVEESRRRSKRLVDELKRVVKEVKDGGVEERIVKRLEDEVRKLVDEMRKLDEELTRNVDEVRREAERLDKENRDENRKLKEELKK

SEQ ID NO: 21960 - protein, 172 aa, Artificial Sequence; identical to SEQ ID NO: 21959
  Synthetic sequence.

SEQ ID NO: 21961 - protein, 179 aa, Artificial Sequence
  Synthetic sequence.
SEMEKVVTDAKELLERLDRELERVIRESDKILDELRRKIEEVIKRSDELLEELDRRIKENKESKDLVEEIVRAAEESDKDVERVVDEIRKEVEKVNDEVRRLIKEIVDRLKDMLKKVRDAGVREELIERVRRLVEELIEKAKKLLEESERKSARLIEDLERLLEESRRKSDKLIKKARK

SEQ ID NO: 21962 - protein, 179 aa, Artificial Sequence; identical to SEQ ID NO: 21961
  Synthetic sequence.

SEQ ID NO: 21963 - protein, 179 aa, Artificial Sequence
  Synthetic sequence.
DEVEEIRKEIEDILRRLRDLLRRVIEDSRRLLDELRERNERVIKESEDLLRDLEDKIRKRKESEDLVREIVKRARESDDKSRRVSKESADRARRSDEKVERVIREVVERLRRVVKKAEDAGVDKEIVDRLRDEVRKLEEEAKELLRESNELTRELIDRLEKLNRDSNRKSRELIERLRK

SEQ ID NO: 21964 - protein, 179 aa, Artificial Sequence; identical to SEQ ID NO: 21963
  Synthetic sequence.

SEQ ID NO: 21965 - protein, 185 aa, Artificial Sequence
  Synthetic sequence.
SELEEVEERIKKELDRLEKKMEESIKRDKEINRELNEMLKKSIKDSDDILRELRKEIEDDKDSKDVVERVKRRLEELIKRDREVIEEVERRLDELIRHNEEVVREVKEELDRLIEEARDVLRKEQDKRAEEIVKKLEKEVEDLVRKAKKLVDELRKENEESKKRARELLRRSEEKVKKLVREAEK

SEQ ID NO: 21966 - protein, 185 aa, Artificial Sequence; identical to SEQ ID NO: 21965
  Synthetic sequence.

SEQ ID NO: 21967 - protein, 169 aa, Artificial Sequence
  Synthetic sequence.
DSEELVRTVKKELEDIIRESRKLVEDVARALEKIEKEIEEIVRTTDKELRKLIEEAKDVEELKKLVDDLRRENERVLRELKKTLTDLKRKLEESTRRSEDVVRKLIKELEDRGTEEVVKKVKDLLRELEKHNRTVLEEVKKALDELRRRLEEVHRRSKETLDRIRRDAT

SEQ ID NO: 21968 - protein, 169 aa, Artificial Sequence; identical to SEQ ID NO: 21967
  Synthetic sequence.

SEQ ID NO: 21969 - protein, 169 aa, Artificial Sequence
  Synthetic sequence.
REDELVDTVRKRLKELIEESERLLEEVKKKLEEIKRRVEKILRETEKELRDIIRKNKDVDELRRVLTELEKRNREVLERLEKLVRELLKEAERSLEKSRRAVTRLLEELRRDGDDKVLEKVRKVLEDLKRENKEVVERVDRVLEDAKRKLEKVHKDSRDALKKLDEDAK

SEQ ID NO: 21970 - protein, 169 aa, Artificial Sequence; identical to SEQ ID NO: 21969
  Synthetic sequence.

SEQ ID NO: 21971 - protein, 169 aa, Artificial Sequence
  Synthetic sequence.
SEKELLDRVKEKLKKIIDDVEEILRRSKKELEKIIRESEKLVEEVKRDLRRLIEENREVDELERLVRDLERILKESTEKSRRAVEELERINREVLERLRDALRKLEERARREGSEKVVEEVERVLEKLLRDVERVHRRTKEVLDELRKENKKVVEDVRDVLEKARERAR

SEQ ID NO: 21972 - protein, 169 aa, Artificial Sequence; identical to SEQ ID NO: 21971
  Synthetic sequence.

SEQ ID NO: 21973 - protein, 179 aa, Artificial Sequence
  Synthetic sequence.
EEVEDVARKIEKLLEDVRRIDKEISDRNRELLKEVRKIDEKILREIEKLLEELRDTATKDSDKRAVTEIVTRVVERVEKLLKESEDIVREVEERVRRSLKESRRILEEVVRRVKELLERKLGNTEEAERIKRELDRIRKESEETVKENEERLRRIKEESRRSVERARTELKRIEDEVRK

SEQ ID NO: 21974 - protein, 179 aa, Artificial Sequence; identical to SEQ ID NO: 21973
  Synthetic sequence.

SEQ ID NO: 21975 - protein, 182 aa, Artificial Sequence
  Synthetic sequence.
KVEDELRKLREEVRRSKEEVEKKVKELDEEVKRSKRESEKKLRDLREEVKRLEDDAERSNDDEVRKIVKEVKDRVEKLLKEVEESSKEVEERVKKLLDEVRKSSDRVREEVERLLKEVADENREKFLEEVRERVRKLLDENHKILKEAERRVEELLRRNHKILKEALDRVRKLLKELRDRTR

SEQ ID NO: 21976 - protein, 182 aa, Artificial Sequence; identical to SEQ ID NO: 21975
  Synthetic sequence.

SEQ ID NO: 21977 - protein, 186 aa, Artificial Sequence
  Synthetic sequence.
SIEEILRELREHVKENMERSEEIVRDLTRKVDESTRDSERILEKLKKDVDKLEEDAKRANSERVKKVIKEAKKRVKELLEELKKSSDDVRRTVEELVKEAKESSKRVKDEVERLLEDLERKKDREEAEELLREVRERVERVSRRNEELLKRVERDVERVLRENHELLKRVAEEVERVLKEVRERTK

SEQ ID NO: 21978 - protein, 186 aa, Artificial Sequence; identical to SEQ ID NO: 21977
  Synthetic sequence.

SEQ ID NO: 21979 - protein, 186 aa, Artificial Sequence
  Synthetic sequence.
SIEEILEKLRREVEESEKDSRRSAEELRKHVRENEKRSEDIVRKLTEDVERLERKARSRNDRRVEDLVRRVKRLVTELVKKAKESSDKLREDVERHIRHSEDSSRRVKETVERLLKRLEEKKDREEAKELVREVAERVEDVLRKNHEINKTNAEAVKKWSEDNRKLLEDVRREVERVLKELEKEMT

SEQ ID NO: 21980 - protein, 186 aa, Artificial Sequence; identical to SEQ ID NO: 21979
  Synthetic sequence.

SEQ ID NO: 21981 - protein, 177 aa, Artificial Sequence
  Synthetic sequence.
DEVRKLVEELRKINEDDKRRSDKNFDDNRKLAEDVKRVLERNVEENRKMAKRLEEVLRNNSPSKDLAELIKRWEELIKKSEDDLRRLLKEWEELIRRSAEDSKRSLDDLRRLLERIRRDGLDEKLLKEAEERIRRNAEENRKLLERSKKALEEVERRARKLLEESRRALEELKKRAD

SEQ ID NO: 21982 - protein, 177 aa, Artificial Sequence; identical to SEQ ID NO: 21981
  Synthetic sequence.

SEQ ID NO: 21983 - protein, 177 aa, Artificial Sequence
  Synthetic sequence.
DEVRELVKELRELNKRDKKRSKELRDKLEEANREDEEKTRKNKEDNERMAREVERVLRDDSPSEVVRKLLEDWKKLIKDSEDDSRKSLEELKKLLRELAEDSKRSLEELRDLLRKIAEAGLEERLLKEAEELIRRNEEENRRILREVEERIKKNEDDNRRVLKRSREELERVEREAR

SEQ ID NO: 21984 - protein, 177 aa, Artificial Sequence; identical to SEQ ID NO: 21983
  Synthetic sequence.

SEQ ID NO: 21985 - protein, 177 aa, Artificial Sequence
  Synthetic sequence.
DEVDKLRKELEDANARDREKSKENKDENDKALKELEEVLEKLKRELEEIVRRVKEVLDKNSPSEVVKRLLDDARRVLKKLADDLRRLLDEWRKLLRKSAEDSRRSLEELERLVKRIAEAGLEEEILKKIEKEIRTNREENERLLKESEDELKRLEDEMREILERIKRLIEEVEERAR

SEQ ID NO: 21986 - protein, 177 aa, Artificial Sequence; identical to SEQ ID NO: 21985
  Synthetic sequence.

SEQ ID NO: 21987 - protein, 177 aa, Artificial Sequence
  Synthetic sequence.
DEVRELVKELERINKEDRDKSRENFKRNADIAKEVEDNLERNEEENRKVEEEVRKVLRDNSPSKVIRELEEDWKRLIKESEDDLRRMLKRWEELIEESRKDSEDSLRALERLLEEIARAGLEEDLLRDAKRKIDENKEENERLLKESRKLLERVRKRAEELLRKSRKALEDLKEEAK

SEQ ID NO: 21988 - protein, 177 aa, Artificial Sequence; identical to SEQ ID NO: 21987
  Synthetic sequence.

SEQ ID NO: 21989 - protein, 177 aa, Artificial Sequence
  Synthetic sequence.
SEVDKLEKEVRDANERDRRNSERNRKENEEMLRRVERVLRELKKKLEEAIRRARKVLDDDSPSEVIKELLKELKRLLEEIARTLKRLLDEWKKLLDDSAEDSKRSLDELRRLLEKIRRDGLDERILERIEELIRDNAKRNEDLLRRSKEMLDELRKKAKEILDRIRKLIKEVEDKAR

SEQ ID NO: 21990 - protein, 177 aa, Artificial Sequence; identical to SEQ ID NO: 21989
  Synthetic sequence.

SEQ ID NO: 21991 - protein, 178 aa, Artificial Sequence
  Synthetic sequence.
DEVERVVEKLKTLIEEWKRLTEEIEKKNEELIRRIEKVLEDLFRENEKLARDIKREIDELRTDKKMVDDLRRRLEESLRRSEEAIRKLDEDLERSLRETEELSRRMLERLKRILDEARERNVDEELLRRIEEDIERLERTDREVLKRSEKKIRELRERAKELLKRSEEIIKKLEDEAR

SEQ ID NO: 21992 - protein, 178 aa, Artificial Sequence; identical to SEQ ID NO: 21991
  Synthetic sequence.

SEQ ID NO: 21993 - protein, 178 aa, Artificial Sequence
  Synthetic sequence.
SKDDELKRKIDELIDRWRRLTEEIKKKNDELVKKWEKLTKEVTDHSRDLNRKIREELERLRTSREVLKKLLEDLRDDLRRAEELSEKMTRELERSLEETRKLSEEARKRADEILDEIRKNRLDERLLEEIEERIEKLERDDKKVLDDSRKKIDDLRKRDEEVIRRNRESIDRLRREAD

SEQ ID NO: 21994 - protein, 178 aa, Artificial Sequence; identical to SEQ ID NO: 21993
  Synthetic sequence.

SEQ ID NO: 21995 - protein, 179 aa, Artificial Sequence
  Synthetic sequence.
DEVETVDDRVKKVIRKLEELLRELAKLNKDIVDDIRRRLKEVEERNRKLAEDIERLLEEGGEDTKRLLREVEEIARRLHEENERVLREIEKLARELHKLNEKVLRDIDRLLRELEEELRRTGVDEDVIKKVRDEAERIRREVRRLDEESRKTVKRLLDEVRELNRRSEEELRELRRRIE

SEQ ID NO: 21996 - protein, 179 aa, Artificial Sequence; identical to SEQ ID NO: 21995
  Synthetic sequence.

SEQ ID NO: 21997 - protein, 178 aa, Artificial Sequence
  Synthetic sequence.
SELEEVRERLRKLIEDLKRLNEESLKENREIIKALRELNERSLRENKELIKRLEDSNLTSEDAKRLVKRVEDESRKSAKRNEDVVRESRERSKRSAERNKRVVREVEERVKKLAEDIDEGDEARTIIEEIKRRVDELRKHIEESIKEVKKLNDEVEKHIRESIKESEEDLKRLKDRID

SEQ ID NO: 21998 - protein, 178 aa, Artificial Sequence; identical to SEQ ID NO: 21997
  Synthetic sequence.

SEQ ID NO: 21999 - protein, 177 aa, Artificial Sequence
  Synthetic sequence.
KDDEDVDEKIRRAIKKNEELSREIEDKIRRILKKHEDLTRDLAREIREVVRKLRELSKRGGGKEMADKVLKEAKEVIEKIERTSRKSLKEVKDLIDRLAERSKKSLDELREVIERLRERGVSEELLRKVEELLRRLEEENRKILKEVDERLKDLEKKDRDLLEEAKKLLEDVERELR

SEQ ID NO: 22000 - protein, 177 aa, Artificial Sequence; identical to SEQ ID NO: 21999
  Synthetic sequence.

SEQ ID NO: 22001 - protein, 182 aa, Artificial Sequence
  Synthetic sequence.
SELEKLIKELRDLVRESEERLRELVRKVKELIKRSEDEVERLLDRSRELAKELEEEIRRKGLEERLLREIEKELRELLKRNRDSLRRLKELYRELLRRIRKLLEDIRRKYEEVLRRLEEAPDRREVLDKLKKDAKRVNDDSERIIKRADEEVKRVNEESKRMLEENEKMNRDLVRRIRERIK

SEQ ID NO: 22002 - protein, 182 aa, Artificial Sequence; identical to SEQ ID NO: 22001
  Synthetic sequence.

SEQ ID NO: 22003 - protein, 177 aa, Artificial Sequence
  Synthetic sequence.
DLEEMLTEVERLARELEEESKKIRKEVERLARELEEESKEINKRIKDKADDLKEKLKDVREVDKLLKEIEEELRRVTEESRKVLDDVRRDLDRVHEETRRKLEELKKRAEEVRRSNVDREIIKRLVDEVKKVIDELMKKNRKLLEDVERILTELSERNRDLARKVDKLIRDLEKRAR

SEQ ID NO: 22004 - protein, 177 aa, Artificial Sequence; identical to SEQ ID NO: 22003
  Synthetic sequence.

SEQ ID NO: 22005 - protein, 182 aa, Artificial Sequence
  Synthetic sequence.
SKLEEVKERVKKLSKRNLDVAKRVLDEIDKLIKEDLKKTEDALRRIKELLDRLREMKRRGEIREEEVKRVIDDVRRLLEDIERHNREVRKRVEELLKRLKEHTEEVARRVERLLEELKKDDDDERIRRIVKEVRELVRRNDEEVDKIVEEVKRLLERSSRENEKVVREVEELLKRLEEEARK

SEQ ID NO: 22006 - protein, 182 aa, Artificial Sequence; identical to SEQ ID NO: 22005
  Synthetic sequence.

SEQ ID NO: 22007 - protein, 182 aa, Artificial Sequence
  Synthetic sequence.
DDVERLLKRVKELIDDDLRKTEKALREIEKLSRDNKKRTEDVLREIEERLRRLEEATRRGEIREEEVEKVIREVRELLKDSTRHTEELVRRVRRLLEEIKRHNTELRKEVRELLDDVRRKEDSERVRKIIRDVERLLEESTRRNEEAVKRVERLLEENKKRNEDVVREVEKELRRLREEARK

SEQ ID NO: 22008 - protein, 182 aa, Artificial Sequence; identical to SEQ ID NO: 22007
  Synthetic sequence.

SEQ ID NO: 22009 - protein, 182 aa, Artificial Sequence
  Synthetic sequence.
SDIEKVLEDIRRLSKKNVDDSKRVLDEIRELSKRNLELVKEVLERIRRLLKKLEEARRRGEVRKEAVRTVEEDIRRLLEELKRHTEEVDKRVRELLERSTRHTEEVAEEVRRLLEKLKERTDTERIRKIVEDVKELLDRNREENERIVREVEKLLDENRKEVEKILREVERLLEELEKRERD

SEQ ID NO: 22010 - protein, 182 aa, Artificial Sequence; identical to SEQ ID NO: 22009
  Synthetic sequence.

SEQ ID NO: 22011 - protein, 182 aa, Artificial Sequence
  Synthetic sequence.
KEVEDLLKRIRDLLKRVEETSREVLEEIKRLIDRDRKHSKEVLDEIKELLKRLIEAAKRGEIREEDVKRVARKVEKLLERNKKHNRDVEERVKELLKDSTRVLKEVEKRIRELLEDVRRREDSERVRTIIREVEKLLKELEDKNDEIVRRVEELLRKSHEDNRRIAEEVREMLKRLEDEMRR

SEQ ID NO: 22012 - protein, 182 aa, Artificial Sequence; identical to SEQ ID NO: 22011
  Synthetic sequence.

SEQ ID NO: 22013 - protein, 185 aa, Artificial Sequence
  Synthetic sequence.
SSLEKVEKDIRKLNDDSKKEAKRVTEENRKSNEDVERELRKIVEEVRRLIKDVEDKIRKDGTDEDVKRLVDEVKKRVEDLERKAKELIDRDDKKSEDLARKLRELLKDDARKVDKLIRDMDRETRTERVKRIVDELRKSLRKLEEDVKELIKENKESNDRLRERVERILKELRELLRELEEKVKT

SEQ ID NO: 22014 - protein, 185 aa, Artificial Sequence; identical to SEQ ID NO: 22013
  Synthetic sequence.

SEQ ID NO: 22015 - protein, 185 aa, Artificial Sequence
  Synthetic sequence.
SEVERLVEEVRKSNKKWEEESRELTERNKKLNRETTKRAEDLLERVRELVRTVTEIIKREGTDEKVEELVRRVKKALRELIETLKDLVRRDDEKSRKLIEDDRKILKEDEERVEELIKDLDRKRRDERLKRIVEEIRDSVRRLKEKSEELVRRNEESNDRLRRRVEEIAKEARDLVRRLEEEVRR

SEQ ID NO: 22016 - protein, 185 aa, Artificial Sequence; identical to SEQ ID NO: 22015
  Synthetic sequence.

SEQ ID NO: 22017 - protein, 185 aa, Artificial Sequence
  Synthetic sequence.
SEAERVLEEVRRLNDKSKKTAEKLTEENKRLNKRTTDFLKEVLERIEELVRRVEDRIRKEGTSREVKELVDRLKDRVRELIKEARKMVKEDDRRSEELVERLKEIIERDRRTVEKLIEDLKRKSDDKRVKDIVREIRDSVRKLEEEVRKLIRENEKSNKDLRRRVRKIEEDIKRIIRELEERVRK

SEQ ID NO: 22018 - protein, 185 aa, Artificial Sequence; identical to SEQ ID NO: 22017
  Synthetic sequence.

SEQ ID NO: 22019 - protein, 185 aa, Artificial Sequence
  Synthetic sequence.
SELEKILKDIEDLVRKWLEESKDLLRKLKKLNEDTTERLRRLLDELRKLIKDLLDKIRKDGTDDRVRKLVEDITRKLEELIKEARELVREDKRRVDELIRRDEEIAKEVEKEVRRLIRDMKEKRDDKRVKDIVKKIEELVKKAKEESKKIVEEVRRSVKRLEEEVRKIEKDIKDLIDELRKKVTT

SEQ ID NO: 22020 - protein, 185 aa, Artificial Sequence; identical to SEQ ID NO: 22019
  Synthetic sequence.

SEQ ID NO: 22021 - protein, 175 aa, Artificial Sequence
  Synthetic sequence.
SEVEDLRRELEEINKEWNKRTKDLVKEVEEVNRDINKKIRDLLREARRLVDEIRRLIEKGEPKEELIKTLRRVVEEIEKDIRRLEERLAAIHKKVKDDDKKLADELREMHKRVEDRVKNEEVIKELRKLLEESERRAREMNKRLDRLLEESKKDVDRVREEIKRLVDEIEDRARK

SEQ ID NO: 22022 - protein, 175 aa, Artificial Sequence; identical to SEQ ID NO: 22021
  Synthetic sequence.

SEQ ID NO: 22023 - protein, 175 aa, Artificial Sequence
  Synthetic sequence.
DEIEEVLKRLEEIVKTWDERTKRLTERVRTVNREVNERHKKLTRDLRELAREVLDLVRQGKDKDRLIKRLEDMIRDIVRRAREINKRLAEIHKRVEDEDRKLAEELRDVLDKVRRKLRSREMLRELEERIRTVEDKVRRVNEELRELLKTSNRRSEEIEKELEKILREIRERARK

SEQ ID NO: 22024 - protein, 175 aa, Artificial Sequence; identical to SEQ ID NO: 22023
  Synthetic sequence.

SEQ ID NO: 22025 - protein, 175 aa, Artificial Sequence
  Synthetic sequence.
DEVRKVLEDLRKIVREWEERTERLLRDLKRINEEINRRVEKLTEELRRLVKEIKKLTDDGKDKKKLITELEEVARRIVETLKDLLRRLAEVHKKVVREDEKLLEDLKRFLEDLKRKMKNEDVLREADKIIEDVEREARRVNKELKDLLDESAERIERIIREIERLVEKIKRDADR

SEQ ID NO: 22026 - protein, 175 aa, Artificial Sequence; identical to SEQ ID NO: 22025
  Synthetic sequence.

SEQ ID NO: 22027 - protein, 175 aa, Artificial Sequence
  Synthetic sequence.
SEIEKVLDELREINRRINETAKEILRRLKEINERTKKEIDRLLDELRKLLRRVEELRKEGRDTEELIKRLRERVDEIRRDIKRLIDEDRKRVEDVERELERLAEELRRMHEDAKRKMKSEEALKDLERLLRESEKRIREIIKRIRESVEKLERDVRRVIDEIRRRLEEIERRLRK

SEQ ID NO: 22028 - protein, 175 aa, Artificial Sequence; identical to SEQ ID NO: 22027
  Synthetic sequence.

SEQ ID NO: 22029 - protein, 171 aa, Artificial Sequence
  Synthetic sequence.
KEVEEALEELRRILREWEEVTKRLEERVEEINRRSLEELRRLKEEVEEIAKRIRDTDKADTLLKELRRLLEEIRKRSEDSLRRDEELFERIHRTDERAARELKKVLEDIARKIDRKEVLEELDKLVKDIKRKVDEVNEKWKESSKRLEDEHRKVIKELEELVKRVEEELRR

SEQ ID NO: 22030 - protein, 171 aa, Artificial Sequence; identical to SEQ ID NO: 22029
  Synthetic sequence.

SEQ ID NO: 22031 - protein, 171 aa, Artificial Sequence
  Synthetic sequence.
KEVEDALKKAEDILRRWEEVTKKLKDEARKINEDSRRKLKRLKEESREIVERIKKTDPSDELLKRLRDLNRRIAEESKKSLRRDEEVFRRIHEIDKEMADRLAELLKEIADKIDREEVLRRLEKLVEDIKRKVAKVNDEWRKSSEDLEREHRKVHRESEKLIRDVEDRLRK

SEQ ID NO: 22032 - protein, 171 aa, Artificial Sequence; identical to SEQ ID NO: 22031
  Synthetic sequence.

SEQ ID NO: 22033 - protein, 171 aa, Artificial Sequence
  Synthetic sequence.
SEVEEVRREVKRVVDDWRRVTKKLLDDIRRISEESKKIIRDLKEAAKTMIREVERTRPDETLLDRLRRLLERIAREAKRSIEDIRRLLEELHKTDKKIAEELKRLLDRIAEEIDREEVLKELEKLLEDLRREVEEVNERLKRLLDENEKRIREVLRELKKLLRDLDEKLRR

SEQ ID NO: 22034 - protein, 171 aa, Artificial Sequence; identical to SEQ ID NO: 22033
  Synthetic sequence.

SEQ ID NO: 22035 - protein, 184 aa, Artificial Sequence
  Synthetic sequence.
DELERVREEVKKLSDTSREKLERALKKARDLLEENERRLRELKKEVEELIRRIEEKLKDRKDEDLIRKIERDLDRVLRKVEKLVEEVRRRHEKVLRELAKLVKESKEELDKVLRDVEKLIRDRESEELRKVLTDIERLLRENKKELDEVLKEVEKLSREADDKNRKVLKEIKELLDELKKRAKD

SEQ ID NO: 22036 - protein, 184 aa, Artificial Sequence; identical to SEQ ID NO: 22035
  Synthetic sequence.

SEQ ID NO: 22037 - protein, 178 aa, Artificial Sequence
  Synthetic sequence.
SEVERMLEEVERISEESKRKLEEVLRRVEEIIKAIERTLEKVLKDDEEIIRRIEDTLRRRNTEEVSKRIEELSERSRRKIAKVLRDIDELLKEAERELDKLKKESRKLAEDVRRALKEINVRREVVKTIDDLLRENERRVDEALEEIEKRARDLREKVKELEERLDRTNRKLKKKVED

SEQ ID NO: 22038 - protein, 178 aa, Artificial Sequence; identical to SEQ ID NO: 22037
  Synthetic sequence.

SEQ ID NO: 22039 - protein, 182 aa, Artificial Sequence
  Synthetic sequence.
KEVEDIIEESRKLDKELEDEIRRIIEESRRLNEELEEIARRIDEEIKELLERLKRRDKDARELLRELEEVVKEVRKRMEELLKRSRDVSREHEKTLRKLLEESRRMTEKHRDDLRKLEERNGVKEDVERLVRSNREVARDVREKLKRLLEHNKEVVDRVREELKRLLDEARRVIEEVRKKAD

SEQ ID NO: 22040 - protein, 182 aa, Artificial Sequence; identical to SEQ ID NO: 22039
  Synthetic sequence.

SEQ ID NO: 22041 - protein, 184 aa, Artificial Sequence
  Synthetic sequence.
DELERIDEKIKRDVEEHKRETKRILDESERLNREVKKRLEEIRERIRRLAEEIRKEIERDKGKERLEKKVRDLEKTVRDLIRELEELVREVHERDRRLIKELREHLRRLEEDLRRLIDELRREVEERKLEKVMEDVKRLIDEARKENEDVARRMERSNKELKRKLDEIRREVEELIKELRERTK

SEQ ID NO: 22042 - protein, 184 aa, Artificial Sequence; identical to SEQ ID NO: 22041
  Synthetic sequence.

SEQ ID NO: 22043 - protein, 184 aa, Artificial Sequence
  Synthetic sequence.
DDLERAREEVADLIRKHEEKTRRILEESRRLNERHRELSKRILDEIRKLAERIEELIKRERGKDELRRKVEDLERRVEDLIRRLEEHLRRVHDKDRRLIEDLRRHLKRVVEELKRLIDELRRKVPKEELDRIEEELKRLIDTLREKNREVEKRARDSNRDLKRTNDEIAKEVRELIKKLREDLK

SEQ ID NO: 22044 - protein, 184 aa, Artificial Sequence; identical to SEQ ID NO: 22043
  Synthetic sequence.

SEQ ID NO: 22045 - protein, 184 aa, Artificial Sequence
  Synthetic sequence.
RELETIADRIRKLSRENSEVLKEIARRIERLVEEHRKESERILKEIKELADDITRLIREDKGKERLKRKVEELEKRLRELIERLKEHLKEVVKELERLIKEMRDHSERVVEEAKELIDRLRSKVPKEELDKVEEEVRRLIRTNREILRTIEKRVRDLIEELKRRNDEIARRVEELIKRLRRETD

SEQ ID NO: 22046 - protein, 184 aa, Artificial Sequence; identical to SEQ ID NO: 22045
  Synthetic sequence.

SEQ ID NO: 22047 - protein, 184 aa, Artificial Sequence
  Synthetic sequence.
SELEKVADELRKLIKDDNDLLDEILDRIRKLSKENEKRLREILKEIRKLMDEISKLIKKDRGKERLKKKVDELRETVERLIKEARDHSREVAKEIKELIREAEEHTKDIARKLRKLIEELRRRVPKEELDKIREELERLIKRNKEKLDEIRREVDELIKKNEETLKRIEEEVRKLIEDLKEELR

SEQ ID NO: 22048 - protein, 184 aa, Artificial Sequence; identical to SEQ ID NO: 22047
  Synthetic sequence.

SEQ ID NO: 22049 - protein, 184 aa, Artificial Sequence
  Synthetic sequence.
SDLEKIEKEIEDLVKRDNEVDKKVMREIRELSKENKERLRKILEDLRREAKKIKDDIERETGKEELEKKVREIEKRARELIKEAKRHSEELAKTAKDLIRRTTKHTKDVEEELRRLIEELDRTVDKEKLKRVEKKVRELIKRNRDHNERTREDVEKLIRDNEDTLRRIEEEIERLIEKLKRDTK

SEQ ID NO: 22050 - protein, 184 aa, Artificial Sequence; identical to SEQ ID NO: 22049
  Synthetic sequence.

SEQ ID NO: 22051 - protein, 174 aa, Artificial Sequence
  Synthetic sequence.
KEVEDAVKELEDLLRKNEDKTRKIVEDMRRSNKDLEDHSRKSEEEVRKLLDDLRRAGVPRDSLKRLAEDVERVTRESRELLERVHRADRELIERLKESNERLRRAIEEIRKAIKAGKDIKTLLDRVRKLAEEDNERLDRLRRESEELNERVRRVDKKLLEEIRRKAKKVEDDTR

SEQ ID NO: 22052 - protein, 174 aa, Artificial Sequence; identical to SEQ ID NO: 22051
  Synthetic sequence.

SEQ ID NO: 22053 - protein, 174 aa, Artificial Sequence
  Synthetic sequence.
DEVREVDRRLKELLRRLKETIDEIRRRMEESNRRLEDHSRKSEEEARKLLEELERKGVPRDTLERLREEIERVIEESRRLLEEVHRRDRKLIRDLEKLLEDVRRTVEEVRKKIDDGSDLEELLRRLEELAERAERKLEKALRDSEDLNRKVTEVDRRLLKEIRDLVEKVERERR

SEQ ID NO: 22054 - protein, 174 aa, Artificial Sequence; identical to SEQ ID NO: 22053
  Synthetic sequence.

SEQ ID NO: 22055 - protein, 174 aa, Artificial Sequence
  Synthetic sequence.
SEDEKVRKEAEDLLRELEKHSRDTERRARKSNRDNNEHSKESVKDLRRLLERLRKAGVPRDTLKTLEDMIRRIIEESERSNERLHREDKKLVEESRKLVKDVLKRLEDIERAIKAGSDIRKLLEEVRKLVDDLRKRDEEIMKTSERLNEEDNRKDRRLVEDVKRLADEVEKKTR

SEQ ID NO: 22056 - protein, 174 aa, Artificial Sequence; identical to SEQ ID NO: 22055
  Synthetic sequence.

SEQ ID NO: 22057 - protein, 174 aa, Artificial Sequence
  Synthetic sequence.
SKVDDVKRRIRKLLEDSKKRSRESIERVERSNRRLEKHSRDSARRAKELLDKLREEGADERVIKELEEIVREIKKRSEELLEKDKKDSEEIVRRSRKLNDELREVIRKVEEMLRGGSDIDELLERLKELAKRIKELDDRLLRELEEINKTTEKLDRDLLKEIKERIDELRKREK

SEQ ID NO: 22058 - protein, 174 aa, Artificial Sequence; identical to SEQ ID NO: 22057
  Synthetic sequence.

SEQ ID NO: 22059 - protein, 174 aa, Artificial Sequence
  Synthetic sequence.
DKVERVKKEVRDLLRRLEKHSEDSVREIDTSNKRLEEHSRRSKEELKRLLRKLKEAGLRREVIEEVEKRIRDVERESEKLLEDDKRKSERIKEESKRILKEVRDRIREIEKLLDSGADIDRVLEEVRKIIRRIEEEDRRLLKEIRDINETTERLDRKLLDELRKVVKDIEDRER

SEQ ID NO: 22060 - protein, 174 aa, Artificial Sequence; identical to SEQ ID NO: 22059
  Synthetic sequence.

SEQ ID NO: 22061 - protein, 188 aa, Artificial Sequence
  Synthetic sequence.
SELEEVKKKVEKLIRDVEKVSEDTRREVERLIREVEEATKEHLDRVRRLIEELREVRKAGSRKEELRELLKRVADKVKRLIETNREVLKEIEDRVRKLIEENRRVIEEVAKTLKKIIDDLRRRLREDRLRERLERLAKEIEDLLRRLREISRTIEERARRLLEELKKRSEDLRKTAEELLKEIDEELK

SEQ ID NO: 22062 - protein, 188 aa, Artificial Sequence; identical to SEQ ID NO: 22061
  Synthetic sequence.

SEQ ID NO: 22063 - protein, 175 aa, Artificial Sequence
  Synthetic sequence.
DEVETIKKKAEDLLRDSKRKTDELTKRMEELLERSKEDSERLIRRLRELLERLRRRGLPEEVLTRIEKTIRDIERELEKVDRDLKREIERLKKELEEVNRRLEEEIRKLVELLRRGDVREEDVDREVKRLVDESKKIIERVEEDVKRLIRESEKKSRDVERRVEELERKAREDER

SEQ ID NO: 22064 - protein, 175 aa, Artificial Sequence; identical to SEQ ID NO: 22063
  Synthetic sequence.

SEQ ID NO: 22065 - protein, 181 aa, Artificial Sequence
  Synthetic sequence.
SEVEKIKREMEKLLEEHKKLVDDIRREAERLHEEHRRLSDKIREDLKRLLEELRRSGIDKKLLDEIEEVVKEVDERSKKLDKELREIIRKVVEDSRKLHEELERIIRTVERRMEELEKRGGDRKELDRLRREVEKVVRELKERNKELLKRLEEAVEELKRRNRKLLEDARRVVEEIKERAR

SEQ ID NO: 22066 - protein, 181 aa, Artificial Sequence; identical to SEQ ID NO: 22065
  Synthetic sequence.

SEQ ID NO: 22067 - protein, 181 aa, Artificial Sequence
  Synthetic sequence.
STVERIDEELKRLHTEHKKLSDDIKREAERLHEEHRRLSEEIRERLERLLEELRRRGIDERLLREIERVVEEVERTSEKLDRDLEEVIKRVEDTSRDLNRRLKEVIDEVRERLKRLEDKNGVEEDLDKILRDLERTAKELKDRNRRLLEEVERVVRELKRRNKELLKTVERVAREIERRAE

SEQ ID NO: 22068 - protein, 181 aa, Artificial Sequence; identical to SEQ ID NO: 22067
  Synthetic sequence.

SEQ ID NO: 22069 - protein, 181 aa, Artificial Sequence
  Synthetic sequence.
REVEEIDKELRRLHEEHRRLVEDIRRKLKKLHDEHRRLSEEIKRRLEELIRKLREDGASEKLLKELEDALERVKETSEKLDEDLKRIIDTIERRSRESNRELKEVLDDVRRRMEDLERKNGVREELTKLLEEVKRVVDRLKEENKRLLKEVKEVAERLKRENERLLEELRRVAEEVRERTR

SEQ ID NO: 22070 - protein, 181 aa, Artificial Sequence; identical to SEQ ID NO: 22069
  Synthetic sequence.

SEQ ID NO: 22071 - protein, 181 aa, Artificial Sequence
  Synthetic sequence.
KEVEEIREEAKRLHEEHRRLSKRIDDELKRLHDEHKRLSDEIRKELERLIEELKKGGVSEELLDRLRRELEKVDRESKKLNEDLKRILDDVRRRSERLDRELRKVIETVSRLLEDLERKGGDRDKARKLLEEVRRMVKRLKEENKRLLEEVRKVVEDLKRRNKELLEKLKREAERVKEEAK

SEQ ID NO: 22072 - protein, 181 aa, Artificial Sequence; identical to SEQ ID NO: 22071
  Synthetic sequence.

SEQ ID NO: 22073 - protein, 181 aa, Artificial Sequence
  Synthetic sequence.
SEVDEIRKRLEDLHREHRELSREIEERLKKLHDEHRRLVEEIIRRARELLEDLRREGIDKSLLDRIREVVEKVRKESEDSNRDLKRVIDEVRDTSRKLDEDLKKVIEEVERELKKLEDNGGDRDKVERLLREVKKVVDKLKKDNEKLLRDLKRVVDELKEKNKRLLEEVKRVVDDIRRRAK

SEQ ID NO: 22074 - protein, 181 aa, Artificial Sequence; identical to SEQ ID NO: 22073
  Synthetic sequence.

SEQ ID NO: 22075 - protein, 177 aa, Artificial Sequence
  Synthetic sequence.
DEVREVERKIDKLAKDLKDELRRLLKEYEELVERLEELLERILRESEKLAEELKEELKRRKTEDVVRKIEKELRESHEAIKELIKRIDELHERANRKIDELDKRIEEVLRRVKEEVDRKNLDDKVRKRIEELVKELKDILEEIKRRVEELDERSKRILKEIADRNRKLVDELRKTLE

SEQ ID NO: 22076 - protein, 177 aa, Artificial Sequence; identical to SEQ ID NO: 22075
  Synthetic sequence.

SEQ ID NO: 22077 - protein, 177 aa, Artificial Sequence
  Synthetic sequence.
SEVEKALEDVRRLVEELKKELKEILERYKRLVDKLKKENREDHERSKELAERLKDLLRKSRTEDVVREIEKELRKSHKHSRDLARRVEKLHKELNEELDELVRRIRRVLEEILRDLDRRNVDEKVRDTLRKLLEELDDLVRRIKTTLRKLVEESRRSLRKNEEDNRKLVEELREEAR

SEQ ID NO: 22078 - protein, 177 aa, Artificial Sequence; identical to SEQ ID NO: 22077
  Synthetic sequence.

SEQ ID NO: 22079 - protein, 177 aa, Artificial Sequence
  Synthetic sequence.
DEVREVLREAREVVKRLKDRLRRILEESRRVVDELRDKNRKDHETYRKVVEELKKRLEERKTEDVMRDIRRVHEELNRHSEELAKEAEEVARETHKKIEKLAREIRKVLKELLKKVDEANLPEEVRKDIERLFKELEDILKEIKEDNRRLVEDIKRSLEKNKRDLEKLVKESEDEER

SEQ ID NO: 22080 - protein, 177 aa, Artificial Sequence; identical to SEQ ID NO: 22079
  Synthetic sequence.

SEQ ID NO: 22081 - protein, 177 aa, Artificial Sequence
  Synthetic sequence.
DEVRKVLEDARRLVEKLERDLEKVLEDYKRLVDELKERNERSHRESRRLAEELKKELERERSREVVETIRETVERILRKNEELARRAEDLHRRVNEELERLVEEIKRRADDLRRRVEEAKLDDEVKERIDRLVKRLEDLARRIKEELDKLVKESRESLERNKTEVKKLIRELEETVR

SEQ ID NO: 22082 - protein, 177 aa, Artificial Sequence; identical to SEQ ID NO: 22081
  Synthetic sequence.

SEQ ID NO: 22083 - protein, 177 aa, Artificial Sequence
  Synthetic sequence.
SEVEDVLTKIEDVVRKLEEENKRSHDESRKLADELKKENKEDHDRYRKEVERLKKELEERRTKDVVTRIREVHKKLNKHSEELVRRIEDVLRRMLEKNRELVERIKETLKRLKEEVDKANLDDKVRKRVEELVKEIEKSARDNEEAVKRLAEELRDSARRNKEELEKLVKESDDELK

SEQ ID NO: 22084 - protein, 177 aa, Artificial Sequence; identical to SEQ ID NO: 22083
  Synthetic sequence.

SEQ ID NO: 22085 - protein, 177 aa, Artificial Sequence
  Synthetic sequence.
RETEEIEKEIRRLVKELRELNDEVEDRVRKLIKELKELNDRSERTLRELADELRRSGAPEEDVRRVIDRARKLHRRNKEHSKRVMTEIDKLIKTNRRHTERVERELEDLLRKLRRSTDDDVVRKVLERAERLVREDKKHTKEVLERIKELVDRDKKHTRDVNEEVKRLVEEIKKKTK

SEQ ID NO: 22086 - protein, 177 aa, Artificial Sequence; identical to SEQ ID NO: 22085
  Synthetic sequence.

SEQ ID NO: 22087 - protein, 177 aa, Artificial Sequence
  Synthetic sequence.
SEIEEIEKRIEDLARELKELNKEVEERVKKLIEDLRRLNEESRESTDRLMDELRKAGAPREELEEMIKRLKRLNDENTRHSEEVMDTARRLIERNKEHTERVIRRIEELLEKLRRSDKDEVVRRVLEEIERLVRRDKEHTERVLRTIEKLVREDEEHTKRVNEEIRKLAKEIEERAR

SEQ ID NO: 22088 - protein, 177 aa, Artificial Sequence; identical to SEQ ID NO: 22087
  Synthetic sequence.

SEQ ID NO: 22089 - protein, 177 aa, Artificial Sequence
  Synthetic sequence.
REIEELRKEIETLIRENEELNRRSKETSEELIRRLKKLNRDVEEEVRRLVKDLRDRGAPEEDVRRAEERVKKLIEDNKRHSDEVAKTDKKLNEDSERHTRRVEERLRELLDRLSRSDKDEVVRRVAEEARRLSKRNKDAIREVNETSRRLATRDAKHTRDVLREIKRLADEIRERTR

SEQ ID NO: 22090 - protein, 177 aa, Artificial Sequence; identical to SEQ ID NO: 22089
  Synthetic sequence.

SEQ ID NO: 22091 - protein, 177 aa, Artificial Sequence
  Synthetic sequence.
SEIEKAEEDVKRLIKENEELNRRSEETSRKLVEENERLNKEVEDRVRKLIKELEDNGAPEEKLRRAMERIKKLVEDSKEHSRKVAKEDRDLNEESKRHTDRVAEEIKRLIDDLRRSTDDDVVRRILKRIEDLSRKNKRDIEEVNKESERLSRENKKKIKDVLEEIRRLVERIEREVR

SEQ ID NO: 22092 - protein, 177 aa, Artificial Sequence; identical to SEQ ID NO: 22091
  Synthetic sequence.

SEQ ID NO: 22093 - protein, 181 aa, Artificial Sequence
  Synthetic sequence.
SEIEKVLEDLRRLADRHRKRVEEILREAEDSNRKTKKKHREVEKEVKELADKLKDEIRRDRNKEELTKKVKELMDRLRELNDETRRVLEEVARRNRELLERSRRHLDEVRKTVDDILRKLEKDRRLDEVEKDLRRLIRELKRLNEEVEKRVRDLIKENEELNKRIHDDLRRLIKELEDETR

SEQ ID NO: 22094 - protein, 181 aa, Artificial Sequence; identical to SEQ ID NO: 22093
  Synthetic sequence.

SEQ ID NO: 22095 - protein, 181 aa, Artificial Sequence
  Synthetic sequence.
SDIEKVLDDLRKLAEEIERAHEEVAREVRELSKRNKEVIKDILRRAKELAERIKELIDRSDRKEELRKKIEELARELEKLLKELEDHSRDVVRRLRELNDETRKMVEDLERRVRDILRKLRPDDDLRKVEETLRELIRKIRKKNEEIRRDLRRLIEENKELLERVRREVERLIEDIKRKLK

SEQ ID NO: 22096 - protein, 181 aa, Artificial Sequence; identical to SEQ ID NO: 22095
  Synthetic sequence.

SEQ ID NO: 22097 - protein, 181 aa, Artificial Sequence
  Synthetic sequence.
SEIEKMLEELRRLSERNKRTTEEIEKRLRDSNRDTKRKHEEALRTIKELIDRIKRAIREEKDKEKLRKKVEDIERKARRINEETRRTLARAERTNEKLNKDNSDHSRKVEREMEEILRKLRPDDKLRKAADDVRRLIEENRRLDERLHEEVKKLIEENRKLNEDINERVRRLIEELRRETK

SEQ ID NO: 22098 - protein, 181 aa, Artificial Sequence; identical to SEQ ID NO: 22097
  Synthetic sequence.

SEQ ID NO: 22099 - protein, 181 aa, Artificial Sequence
  Synthetic sequence.
EEIERALREMRELSRTHKELVEKILRDIAELAKTHERINEDILRKIKKLIDEIADEIRKEDKKEELKRKIDELRRRAEELLKESKEHLKRLEDTVRELIERLKETLKKVEEDLKRILEKLEKSRELDEIAKDVKRLIDENRELLKRVEDEVRRLIRKLEELNRRTEEEVKKLIKKLEDDLK

SEQ ID NO: 22100 - protein, 181 aa, Artificial Sequence; identical to SEQ ID NO: 22099
  Synthetic sequence.

SEQ ID NO: 22101 - protein, 174 aa, Artificial Sequence
  Synthetic sequence.
RELEELEKELRELLRELRRLSEESRKELKKLLDELEELSRRSAKKLKDLLDDLRRRGVPEDELRRVAKRVEDLIRTSKRLNDETRRKVEEVERESKKLNEDTEETLRRVTELLKAGKDIDEVRERLRELIERDKKLNKKLTDDLRRLAERDKRENEKLSKELEDLARKLREDAR

SEQ ID NO: 22102 - protein, 174 aa, Artificial Sequence; identical to SEQ ID NO: 22101
  Synthetic sequence.

SEQ ID NO: 22103 - protein, 174 aa, Artificial Sequence
  Synthetic sequence.
SEIEELEKRIDELLKELRDLSRRIAEEVKRLLEELKKLSKDSEDKLRELLERLKRKGVPEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 22104 - protein, 174 aa, Artificial Sequence; identical to SEQ ID NO: 22103
  Synthetic sequence.

SEQ ID NO: 22105 - protein, 174 aa, Artificial Sequence
  Synthetic sequence.
SEIEDLERRIRKLLEENRKLVDDVAKKLRELLRELRKLSEESRKRLEDLLRKLRKDGVPEEILRRVAEEVRRLEEESKRLNDETEKELRRLLEELKRSTEDLEKKADDVRKLLRAGKDVEEVLRRLEKLSRENKDLIRRIDERIEKLIRDDKRRNREISERARELARKLEDEAR

SEQ ID NO: 22106 - protein, 174 aa, Artificial Sequence; identical to SEQ ID NO: 22105
  Synthetic sequence.

SEQ ID NO: 22107 - protein, 174 aa, Artificial Sequence
  Synthetic sequence.
KESEELEKEIRRLLRELREISRKIEEDARRLIEELRRLTEESERELEELLEKLKRDGVPEEELREVLKDLKRLIEESRRSNEEVERRVREVLKRARDSNKKVEDRAREVKKLLEDGKDVREVLERLKKLVEEDKRRLKELLDRIRELMERDKRKNKEISERVRKLIKELEDKAR

SEQ ID NO: 22108 - protein, 174 aa, Artificial Sequence; identical to SEQ ID NO: 22107
  Synthetic sequence.

SEQ ID NO: 22109 - protein, 174 aa, Artificial Sequence
  Synthetic sequence.
DEEDRLREELRRLLEELRELSERSRDEVKKLLEDLERLTRESEEKVRRLLEKLKRDGVPDEELKKVIDKLRKLIKESRDSNRRVKEELKKLIDDSKRSNDRVEEAVREIDKLLRAGKDVKRVLEELRRLVEEDKKLNEEITEDARRLIEEDRRLNKKISDEAEKLARELRERAR

SEQ ID NO: 22110 - protein, 174 aa, Artificial Sequence; identical to SEQ ID NO: 22109
  Synthetic sequence.

SEQ ID NO: 22111 - protein, 174 aa, Artificial Sequence
  Synthetic sequence.
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRGGKDVETVLRRVRELSRDNKRRMRRVLEEAKRLAKEDKERIDKIRKEIEELIKRLKDKAT

SEQ ID NO: 22112 - protein, 174 aa, Artificial Sequence; identical to SEQ ID NO: 22111
  Synthetic sequence.

SEQ ID NO: 22113 - protein, 174 aa, Artificial Sequence
  Synthetic sequence.
DEEEDLERRIKKLLDENRELLKRIAEELRRLLEELRRLTEESADRLRRLLKELKDRGVPEKDLRDVAEKVKKVLKESEDSNRDVKRKLEKLLRDLERSTERLEREARKVRKLLRDGKDIETLLRELEKLSRDNKELLKKIEKEIRDLIKEDKERNRELSERLRKLVEELKKKAT

SEQ ID NO: 22114 - protein, 174 aa, Artificial Sequence; identical to SEQ ID NO: 22113
  Synthetic sequence.

SEQ ID NO: 22115 - protein, 174 aa, Artificial Sequence
  Synthetic sequence.
REIEEAAKDLDRLLEENKKLVKEVEEELRRLLKENRDLVKESEDRIRKLLEELRRRGVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 22116 - protein, 174 aa, Artificial Sequence; identical to SEQ ID NO: 22115
  Synthetic sequence.

SEQ ID NO: 22117 - protein, 174 aa, Artificial Sequence
  Synthetic sequence.
SRIEELEKRIRELLKENRDLVKESEDRVEELLRRNEELVRRSKEKVERLLEELRRKGVPDEELRRVEERLRRLLEESKRSSDELRERAEKLVRDSRRSTEELEERAKRVLELLRAGKDVDEVLRRLKKLSDDNKELNERLTRTLEELSRRNADINKKLSDEAEKLIRDLEKRAT

SEQ ID NO: 22118 - protein, 174 aa, Artificial Sequence; identical to SEQ ID NO: 22117
  Synthetic sequence.

SEQ ID NO: 22119 - protein, 174 aa, Artificial Sequence
  Synthetic sequence.
KEIEDAERELRRLLEELKRLLDDVAREVKRLLDENKRLVEKSEEDVKRLLDELREEGVDEKILRDVAREVKRVVEDSRRSSKELEERAKRLLDELKKLVDKIREKLERVRKLLRAGKDVEEVLRRVRETVERVKKKIKDVLKEIEDLSRENKKLNRDLSERLKKLADDLREKAR

SEQ ID NO: 22120 - protein, 174 aa, Artificial Sequence; identical to SEQ ID NO: 22119
  Synthetic sequence.

SEQ ID NO: 22121 - protein, 174 aa, Artificial Sequence
  Synthetic sequence.
DELEELSREIKKLLEENRRLVRESEEDLRRLNEENRKLVEDSERRVRELLKDLRDRGVPEELLRKLEEDLRRLIEESRELLDRLTKRDEELTKRSRDSTKELEDRAKEVREKLKAGSDIEEVRERLRKLSKENKDLNRELTKRSRELNARTKERNEEISRRAEELARKIREDAR

SEQ ID NO: 22122 - protein, 174 aa, Artificial Sequence; identical to SEQ ID NO: 22121
  Synthetic sequence.

SEQ ID NO: 22123 - protein, 174 aa, Artificial Sequence
  Synthetic sequence.
DEKETLARKLDELLRELEKLVRDSAREVEKLNEENRRRLEESRDRLRKLLEKLKRDGVPEKDLREVKKEVEKVEEESKKLLKELHDEDRRLIEESRRLLKELADEVRRVRKLLEDGKDIERVDRELKRLAEEIKELNKRITDESRKLNEDTKRVNDKLSRDLEELARDLERRAT

SEQ ID NO: 22124 - protein, 174 aa, Artificial Sequence; identical to SEQ ID NO: 22123
  Synthetic sequence.

SEQ ID NO: 22125 - protein, 178 aa, Artificial Sequence
  Synthetic sequence.
SEIERIERENDRLNEENKKITEDIERELKRLLEENRELSRTIEEELERLLRELRKRNGGREEVLKEVEDRLRRIVEEIRRSDKRLEDIAREVKKRIRESDEELRRVSEEITRRLRKVRDEKTLRELLKRSEELSKENKDRLKKLLDDLREVSKKNKEDLKRLLREVREVARKVKERAN

SEQ ID NO: 22126 - protein, 178 aa, Artificial Sequence; identical to SEQ ID NO: 22125
  Synthetic sequence.

SEQ ID NO: 22127 - protein, 178 aa, Artificial Sequence
  Synthetic sequence.
DDIERILREMERLLEENKEISDEIRKELKRLLDENRKLSEDVVKALEDLLRDLERRKGVEEEVLKRVREVLERIKRELDRSDDELRKVAERILRDAERSNDELRKVIEEIEEELRKVRDKDTLRELARKIRKLSEENKERLKELLRELKKLSDENKERIKKLLKDAEKIIEDVRRRAK

SEQ ID NO: 22128 - protein, 178 aa, Artificial Sequence; identical to SEQ ID NO: 22127
  Synthetic sequence.

SEQ ID NO: 22129 - protein, 178 aa, Artificial Sequence
  Synthetic sequence.
SEIERIDEDNKRLNDENRKLSDRVRRENERLNKENRELSKRVEETLKRLLDELRRRGGGDDRVIKTVEDIAREIKKRLDDSDDRLRRESKRILEAAKESNEELRDFSRRIVDTMRKTRDKRTLTELLKESRELSKRNKDKIRELLRRSEKLSRENKKRIEDLLRELRRVVEKIKREAD

SEQ ID NO: 22130 - protein, 178 aa, Artificial Sequence; identical to SEQ ID NO: 22129
  Synthetic sequence.

SEQ ID NO: 22131 - protein, 178 aa, Artificial Sequence
  Synthetic sequence.
KEIEDLRRDLDRLLRENRELTREVKEELEKLNRELEELVRRIKRTLDELLKDLERRNGADKKLLDTIRRALEEATKEIKELLDDHKRLTDEVVKELEDSDRELEKRLREVKRELERTRDREEIERLREELRKLSEDNKDRIRRILERLRKTVEEIKKRLEDILRRLTEIAKEIEERAR

SEQ ID NO: 22132 - protein, 178 aa, Artificial Sequence; identical to SEQ ID NO: 22131
  Synthetic sequence.

SEQ ID NO: 22133 - protein, 182 aa, Artificial Sequence
  Synthetic sequence.
SELEKLLEDLRRLSERSERELRRLRKELEEIIREIKKKMEENLERNRKVIDEIDKVIKDDSKSKELEELLRRLEKLIEESKRDLERLLRELEELIRRIDDDLRKSLKELRDLIEDIRRKLGDESEEAKRLKEDAERLLRENERRIDELRKEADELIKELKKRIEDLVKESRRLLEELDRRAK

SEQ ID NO: 22134 - protein, 182 aa, Artificial Sequence; identical to SEQ ID NO: 22133
  Synthetic sequence.

SEQ ID NO: 22135 - protein, 182 aa, Artificial Sequence
  Synthetic sequence.
EELERLEERLDRLIEEAERRLKDNLKKNEDMARKWEEDTKRNEKRNRDLIRRIRKVIKDDSKSEELERLLEELRRLIEESKRDNERLLRELRELVERSDRDLRRLLREIEKLIKEITDRLGEEDRKVKELKRRARELLERLARLIDELRRRSEDLIRRLAEKSERLERESRKLLRDIAEKTT

SEQ ID NO: 22136 - protein, 182 aa, Artificial Sequence; identical to SEQ ID NO: 22135
  Synthetic sequence.

SEQ ID NO: 22137 - protein, 184 aa, Artificial Sequence
  Synthetic sequence.
RELEELKKEAEKVSKESKDLIEKVIRDNEDVSRRSEELIRELMREVKEVIDRLRELIERRNDEEVKKRVEDVLRELREKIKKIEKDSRELLERLKELNKRLEETSRDLARRLREKLKRLEEAGVPEDKVRRIKEELERLIEENEKLLEESKKRSEDNARRNEELLERLRRELERLARELEEELR

SEQ ID NO: 22138 - protein, 184 aa, Artificial Sequence; identical to SEQ ID NO: 22137
  Synthetic sequence.

SEQ ID NO: 22139 - protein, 176 aa, Artificial Sequence
  Synthetic sequence.
REKEELKKDIERMVEELKKLNKESRDRTRKLIKELEDLVKESDDDTERLARKLEKEVKDDEDLLRKVKKIIDELKKSNEDVERTVRTIAEDLKRSNDEDHRRIEEIIRRIEKLLREGGDRVEDLLREARKLIEELKRHTEEVIKRNKKLIDELKEIIEDVIRRNRKLVKELEDTAK

SEQ ID NO: 22140 - protein, 176 aa, Artificial Sequence; identical to SEQ ID NO: 22139
  Synthetic sequence.

SEQ ID NO: 22141 - protein, 176 aa, Artificial Sequence
  Synthetic sequence.
SEKEDLKRRLDKLAEDLRRLNKEVDDEVKELARRLRKLNKDSRKRTEDLIRELEKRVKDNKELLEKVKKIAEDMKRSNDEDHKLIEEIIRRIKKLLKEDHDLIEEIIKRAEDLIRKGGDRVDELREEIKELIDRLRKHTEEIIRRIRRLFEELRKHSKKVIDDNKRLFDELEKTAR

SEQ ID NO: 22142 - protein, 176 aa, Artificial Sequence; identical to SEQ ID NO: 22141
  Synthetic sequence.

SEQ ID NO: 22143 - protein, 176 aa, Artificial Sequence
  Synthetic sequence.
KEKEDLKRKVDELDKELKKLNEDSRRKTKELIKRLKDINKRLREELEKLADELRKKVKDDEDLVKKVEDIIREAEKLLEEDHELIERIAERMRRSNDRDHELIKRIREEIERLLREGGDRVEELDREITELIKELRRHTEEVIRRNEKLARELEKHSRDIMETIRELIRDLERTAK

SEQ ID NO: 22144 - protein, 176 aa, Artificial Sequence; identical to SEQ ID NO: 22143
  Synthetic sequence.

SEQ ID NO: 22145 - protein, 176 aa, Artificial Sequence
  Synthetic sequence.
SEKERLEKRLREVVRELEKLNEDLDRRLEELARDLERLNEESRRESRKLAEDLKREVKDDEELLEKVKRIIDEDRRLNDEDHKLIRDIIRRAKELLEEDHKRIREIIKRAKELIDRGGDRVEEVEERIERLIRDLKRHTEEIKKTIEELMKELREHSREIIKRSRDLFKELKDTTK

SEQ ID NO: 22146 - protein, 176 aa, Artificial Sequence; identical to SEQ ID NO: 22145
  Synthetic sequence.

SEQ ID NO: 22147 - protein, 182 aa, Artificial Sequence
  Synthetic sequence.
SELEKVIEEIREISERSLEKIKRLMEKIKELSDRTAERLRRVLEEIRKIIEEIKELRDRGELRREKVKKLVEELERKLDELRKESEKVIETIRRLIETLMKESEDLIRELEERLRDLLRKKDKKELAKKITEDLKRNEERNRRAIEELERTLRKLEEENRRLIREAEDTLRRLVEELEKKDE

SEQ ID NO: 22148 - protein, 182 aa, Artificial Sequence; identical to SEQ ID NO: 22147
  Synthetic sequence.

SEQ ID NO: 22149 - protein, 185 aa, Artificial Sequence
  Synthetic sequence.
SELEEVLKEAKRLIDEIRKHTRDVSERSKRLLEEDLKHTEEVIKEIRKLIKEILDRIRARETSEDLRRDIERATREIRKLLEDNTRESRRVIEESERLARDNKEKSKRVIDELRELVKDIARRDKSEDDLRRLKETIERLAKDLERLNREHDETNKKLAKDSEDLNRELKKRVEELEEELRRALK

SEQ ID NO: 22150 - protein, 185 aa, Artificial Sequence; identical to SEQ ID NO: 22149
  Synthetic sequence.

SEQ ID NO: 22151 - protein, 185 aa, Artificial Sequence
  Synthetic sequence.
KELEDVLKEIRDLARRIEEHSKKVLREIEELIRRLEEENREVLRRMREEIKKIKEDIRNREPDKELEKKIEDVIRRLKELVDTLHERNRRVIKEIEDLLRDNSRKTEEAIERVRRLVEDVARRDRDKRKLDELRRDVRRLERRLERLNETLKERIDRLAERLEEVDRRLDEELKRLAEELKEELR

SEQ ID NO: 22152 - protein, 185 aa, Artificial Sequence; identical to SEQ ID NO: 22151
  Synthetic sequence.

SEQ ID NO: 22153 - protein, 186 aa, Artificial Sequence
  Synthetic sequence.
DKLDEIKERIERLVETDLRVIKRILEEADELIKENEKLIEKILRDNRRLIEEVEEIIRRDRDKRRLERIVEEVERRLDESTKELKKSSDRLTERLEELLERSRRHSERIDRTAKRLTEELRDKVVQDEKKLRELKKRVDELREESKDLNDKLEKRIRDLKRELKKLNDRHEEELRKLKERLRRATK

SEQ ID NO: 22154 - protein, 186 aa, Artificial Sequence; identical to SEQ ID NO: 22153
  Synthetic sequence.

SEQ ID NO: 22155 - protein, 186 aa, Artificial Sequence
  Synthetic sequence.
DELDEILKTADKLAEDDLDTIRRLLEEVRDLVRKDKEVIKRILEEIDRLIKEVEDIIRRDRDKERLKEIVREVVERARELLRRSKKHSKEVAETLDELLKRLREHSREVVEELKRLLEELRRRVVQDEKKLKELEDRVRELKRRSEELLKKVEETLRRLKEESRRLNEELERTIRELEERLRRATK

SEQ ID NO: 22156 - protein, 186 aa, Artificial Sequence; identical to SEQ ID NO: 22155
  Synthetic sequence.

SEQ ID NO: 22157 - protein, 174 aa, Artificial Sequence
  Synthetic sequence.
SKEDRAREELKRLKEELEKLLEEHRKTLEDLNRELKRLVDEHEKSIRELRKELKDSNVEERVVREIARDAERSLKELRDLVREVHERDRKTHEDLRRLIKRVKEKLEEVEKLIRDGEDIDDVIRRVRETIDEVVRRIEELLEENRKLIEDLEEKIRRLNERLKRLVEEIKERDR

SEQ ID NO: 22158 - protein, 174 aa, Artificial Sequence; identical to SEQ ID NO: 22157
  Synthetic sequence.

SEQ ID NO: 22159 - protein, 174 aa, Artificial Sequence
  Synthetic sequence.
SERERVREEVRKLLERLRELLERHRRKLEKLNRELEKVLEDHRRTLERLKEELERSNVDEKVVREAKRRLDETHKKLRRLIEEVKERDKRSHDELRELIREVEEKLREILELLERGKDIDTVLEEARKLIEKAERDIRRLAKENEKTIEEVKERLKKLMEENKRLIEEIKERTR

SEQ ID NO: 22160 - protein, 174 aa, Artificial Sequence; identical to SEQ ID NO: 22159
  Synthetic sequence.

SEQ ID NO: 22161 - protein, 185 aa, Artificial Sequence
  Synthetic sequence.
SEIEDLLRRLKEVADEIKERLKKLSEESEELVRRVKRRIEELNKENREVMKEIKRRIDSGQPEESLERLVREADKRLRDSIKEVEDLLRELEEMLRRTNEKARRLVDEIRRRLERVLEEVKKRGAPEEDVRRLAEDIRRLLEEIEKLLKEHEEKNRKLKKELEDLVRRHRKSVEDLKREIRERSR

SEQ ID NO: 22162 - protein, 185 aa, Artificial Sequence; identical to SEQ ID NO: 22161
  Synthetic sequence.

SEQ ID NO: 22163 - protein, 177 aa, Artificial Sequence
  Synthetic sequence.
DDEERLEETLERLERELKKIADEHRRRNEELRDTLRRIAEELRKTHKDLLERLEEENIPEEARKRVEDHVRESDRLLRELKKELEELHERVDRVAKDLLKKLKDIVREVRKLLKETKEKRVVEEVERKLRRLMDRIREELKRLTDESEDLVTKILDTVRRIVESIKKLVDELREERK

SEQ ID NO: 22164 - protein, 177 aa, Artificial Sequence; identical to SEQ ID NO: 22163
  Synthetic sequence.

SEQ ID NO: 22165 - protein, 181 aa, Artificial Sequence
  Synthetic sequence.
DEAERLLERVDKAHERSEELLDRVLKENRKVLEEIRKLADDLRKLLDDIMRRIEDLVRKENSEEVVKEARRLLEELKEMIDRLVRRVEELLRDTNRKNKRVVEESKKLLDEVREEIKKLNVNDRDLREIERRLKEIEEENRKLVKRLEDENRKIAREVEKLVERLERRLREIARRVEESVR

SEQ ID NO: 22166 - protein, 181 aa, Artificial Sequence; identical to SEQ ID NO: 22165
  Synthetic sequence.

SEQ ID NO: 22167 - protein, 174 aa, Artificial Sequence
  Synthetic sequence.
REKEELKKSIERVKRELERLLEEHRKRSEELKRRLEELLKDHKRRTDEVLKEAKDKNVPEDLLRDIKRRLDELNKRLAEILKDWTDKSRKLNEDLERIIRKVAKELDKILKDLEAGKDVDTLEEEIKDIIRDVKRAVKESLEEDDRLAKEVEDMVRKSKEEVERLIEKVKRDTD

SEQ ID NO: 22168 - protein, 174 aa, Artificial Sequence; identical to SEQ ID NO: 22167
  Synthetic sequence.

SEQ ID NO: 22169 - protein, 174 aa, Artificial Sequence
  Synthetic sequence.
REKEELEKEIERIKREIKKMLDELKRHSEELKRRAERLLEEHRRETERIIREMRESNVQREILEEVEKKLRRLNEELARILEDWERKSRRLLEDLKRVVEEVERRLDEILKLLEAGSDVKTLLEEIRKILKEVEDRIREILREDKRLADELEKAVRDSLREVKRILDEVREAVR

SEQ ID NO: 22170 - protein, 174 aa, Artificial Sequence; identical to SEQ ID NO: 22169
  Synthetic sequence.

SEQ ID NO: 22171 - protein, 174 aa, Artificial Sequence
  Synthetic sequence.
DEDKRLADEIKRVLDELKKSVKEHRDHSEELLRRAKELLKRHEDETRKIEEEARRNRVPEDLLREIVKRLRKLNEELKEILKRWKKRSDELDEENRRIVDDIRRKLEEILKLLKAGKDVETLKREIEELIRRAKKVNKESKEDDRRLADEVRKVVERSEETVKRLRDEVTERVR

SEQ ID NO: 22172 - protein, 174 aa, Artificial Sequence; identical to SEQ ID NO: 22171
  Synthetic sequence.

SEQ ID NO: 22173 - protein, 174 aa, Artificial Sequence
  Synthetic sequence.
REKEELEKELRRIKRELEKILEEVRKRSKELLDRLRELLRRHEAETEKAIEEMERANVRKELLEEIKRRLEELNERLRKIIEDWERKSEELNEELKRIVDEITRRLEEILRRLEAGKDVDKLLRDVREIAREAKRVIRRILKTDEDLARELEEIVRRSLKKVEDLIRKVKEDAR

SEQ ID NO: 22174 - protein, 174 aa, Artificial Sequence; identical to SEQ ID NO: 22173
  Synthetic sequence.

SEQ ID NO: 22175 - protein, 180 aa, Artificial Sequence
  Synthetic sequence.
SEEEKLEEIIRRSRKRLKELIDRLRELVKKIDDDLKRLLDEHRRRLEESERRAEELLKKVRDERIKDLVRRHREELRKSHEELEELAREVRRRLERLLRELEKILERHAEELDEIRKMIRAGKDVEKVLKELEESSRRVVELIKKLMRELEKLLRDVEERAKDLLRKNTRSSEELEKRIE

SEQ ID NO: 22176 - protein, 180 aa, Artificial Sequence; identical to SEQ ID NO: 22175
  Synthetic sequence.

SEQ ID NO: 22177 - protein, 180 aa, Artificial Sequence
  Synthetic sequence.
SEEEKLKKLLDESEKRLREILKRHEEIVRDIKRRLEELLKRHKELLDRSLKRLEELLKENRDEELERLIREHKRKLDESHKTLARIVTTLKKKLDETHRRLEELVRRHKRLLDEIRKLVRAGADVEELLERVKKSSEDVAREIRKLARDNERLLEEVKRLIRKLLEENRESSKDVEDKIR

SEQ ID NO: 22178 - protein, 180 aa, Artificial Sequence; identical to SEQ ID NO: 22177
  Synthetic sequence.

SEQ ID NO: 22179 - protein, 180 aa, Artificial Sequence
  Synthetic sequence.
SKEEELRDKLRKIRKRLEELLERLAREIDRIRRALEDLLRRHKEELDRSRKRAEELLKEIRDEDLRRLIKKHEEDLRKSHKELEDLARRVKEEADRILRRVEELVRTLEERLREIEKLVRDGSDVDRVLEELDRLLKEVEETIRDLARKLRELLKRVEDTLRKLLKENKDSSRRLEEEIR

SEQ ID NO: 22180 - protein, 180 aa, Artificial Sequence; identical to SEQ ID NO: 22179
  Synthetic sequence.

SEQ ID NO: 22181 - protein, 180 aa, Artificial Sequence
  Synthetic sequence.
SKEEELARMIEESVKRLKKLLDDLRKVIKESKDRLKELIDDHRRILEEIRRELEELLKKKRDERLEKVIRELEKRLRDSHEELKRIVEEHVREAEKVLREVEKLLRDHRKELEDILKLVRDGADVDKLLKEIEDSSRKLAEEIKKLIDEIRESSKEVIERVRRLLERNKELVRKVKEEIR

SEQ ID NO: 22182 - protein, 180 aa, Artificial Sequence; identical to SEQ ID NO: 22181
  Synthetic sequence.

SEQ ID NO: 22183 - protein, 184 aa, Artificial Sequence
  Synthetic sequence.
SEVEKLEEEIKKINDEIRRLSDKNLEDLKRILEEIEDLSRRNLKKTKDILREIEEEAKRRRTEEVVRRVRELIRRSKEHSRRVAEEIKKLIKESKDHSREVSERAEKLNREMEERVRRVIERTRLDEFAERLKRSLEDSKRTSKELVDENRKLNEELERTVRKLIEDNKRLNDRVEKRVKELAD

SEQ ID NO: 22184 - protein, 184 aa, Artificial Sequence; identical to SEQ ID NO: 22183
  Synthetic sequence.

SEQ ID NO: 22185 - protein, 176 aa, Artificial Sequence
  Synthetic sequence.
SLEDEIRRLIEEIKRKLKELLERLKEEIDRIREELKKSNRKLDELSRRIEEEARKRVGDDKEVEKVLTESKRSLDENRELDKRSLERIEDLLRKLEKIAREVERRLERLLEALKDGDEEKIERVLREMEKLLRELERIAREVLKEIEKILRENKKHNEEVMERNKRLAKELKEKAD

SEQ ID NO: 22186 - protein, 176 aa, Artificial Sequence; identical to SEQ ID NO: 22185
  Synthetic sequence.

SEQ ID NO: 22187 - protein, 176 aa, Artificial Sequence
  Synthetic sequence.
DLEREIDELIKDIARRLEESNRELEKLVRRIEEELRRSNKELEDLSRRIKTELRKEVGDQKEVEEVERDSRRSLEENKKLDKESLDRIRELLERNRELDERSKDRLRKLLEALKDGDEEKAKRVADEIRKILRENEEHNEEVARRIEEILRRNKKHNKEVADKNRELLKKLKEEAR

SEQ ID NO: 22188 - protein, 176 aa, Artificial Sequence; identical to SEQ ID NO: 22187
  Synthetic sequence.

SEQ ID NO: 22189 - protein, 178 aa, Artificial Sequence
  Synthetic sequence.
KLVEEIRKSAEDNRRRLEKLVRESKKSLDDNERENRKLVDELRKIATKIKEDLERDNIDEEVKRRLDRLIEEIRRVLKESHDHTRELAKRIKEVHERLNEHSKRLVDRLEEVLERLKNVKEAVDKLEEENKRDHDEYKKVVDELKKENKEDHERSRKLAEDLKRLLEDIRRRIKETRR

SEQ ID NO: 22190 - protein, 178 aa, Artificial Sequence; identical to SEQ ID NO: 22189
  Synthetic sequence.

SEQ ID NO: 22191 - protein, 182 aa, Artificial Sequence
  Synthetic sequence.
DEVEKLIEDLKEVTKKHAKRVEETNRHNEDVLRKVAKEVKRILDDVKRVVDEVKKVVDAGGPIDELMKRLEEVLKEVEERLDRLVEEAERVSKEHEDDNKRLADHNEEVLREAKERLERKGVDDKAKKKLEDVLKRSREEIERLKDDSRKSVDETRERLKKLKEDLKRLLEEVRKEVEKLKR

SEQ ID NO: 22192 - protein, 182 aa, Artificial Sequence; identical to SEQ ID NO: 22191
  Synthetic sequence.

SEQ ID NO: 22193 - protein, 182 aa, Artificial Sequence
  Synthetic sequence.
SEVEKLIKELRDVLKKVAEDVEKTNRDLEEVSKRSAEKVKKLEDELEKVLREVEELVKNGEDIDRLLEKLKEDLKRVRETIEDLIRENERVLREVKERNKKLVKELEDVLKEVEDRLRERGVDRKAEEDLRKVLTEIRKRAEELRRESDESVKRSRKELERLLREIEKRVEEIEDRARKAKK

SEQ ID NO: 22194 - protein, 182 aa, Artificial Sequence; identical to SEQ ID NO: 22193
  Synthetic sequence.

SEQ ID NO: 22195 - protein, 172 aa, Artificial Sequence
  Synthetic sequence.
EEVERIIEEIRDEVKKAAEKVEKVLKESREISKRAEDEVRRVLDEIRKLDETLRDARRSDEELKRVLDRIREEIKKLAEEMDRLNEESKRLTKTLAEELEEILRRIKEKIERVNGDREKLRKVLDEIRREIERLKERLDRLDEESDRKSEKLKEDLERLLREIEKRIRDERR

SEQ ID NO: 22196 - protein, 172 aa, Artificial Sequence; identical to SEQ ID NO: 22195
  Synthetic sequence.

SEQ ID NO: 22197 - protein, 172 aa, Artificial Sequence
  Synthetic sequence.
DEVRKVLEEIKELLKRLAEKVKKLIKESREISKRAAEKVKRLIEKSRRLLDTLEKANLDKDELRKALEDSKRETEEVVEELKRLNEDSKRKTEELERELREALKELERKIREINGDKDTLKTVLDTIKKKIEELVKELREVDEESKKRSKELKEEMDKVDEDIKRAIERRTR

SEQ ID NO: 22198 - protein, 172 aa, Artificial Sequence; identical to SEQ ID NO: 22197
  Synthetic sequence.

SEQ ID NO: 22199 - protein, 172 aa, Artificial Sequence
  Synthetic sequence.
DEVRKVLEDIKRDLDRLAKRVKDVLREIEELTKEAARTVKKVIEESRRLLRKLKEANLEEKDLRRALEESKKKSKEAKEKLDKIDRDIERKIRKLKEELERLLRELEKRIRTINGRREDLTELLKRIEEKIKRLVEELERLLKRSREESKRLVEEMEKVNREIEEEIKKRAT

SEQ ID NO: 22200 - protein, 172 aa, Artificial Sequence; identical to SEQ ID NO: 22199
  Synthetic sequence.

SEQ ID NO: 22201 - protein, 186 aa, Artificial Sequence
  Synthetic sequence.
EEVERLLKEIKDLLDEVARENKEALKRSKELLEEVAEDNKRVLREIEKLLEDVERKVKDEKGDEEVERKLKKVIEEIDKLVKEVHEKNRRLHERSEELIRRLHERNRRVIERMEKLIRDLKERKKEAKELLKELEDLLRKARKTVEDLDRELEELNEEIRKALEELDKELERLVREIRKRLEDARR

SEQ ID NO: 22202 - protein, 186 aa, Artificial Sequence; identical to SEQ ID NO: 22201
  Synthetic sequence.

SEQ ID NO: 22203 - protein, 186 aa, Artificial Sequence
  Synthetic sequence.
REAEELLKEIERLLREVERENKKALEDSRRLLEEVAEEVKKVLREIEELLKTLEELVRKEKGDKEVAERLDKVLKDVEKLIKDVTDRLRDMHRRSAELIKELHDRNRKVIEEVEKLIREVKERKKEMEELLRELKRLLEEIERRVRELDEELRKLNEDIKRELERLIRELEELLKRAEETLRRLKD

SEQ ID NO: 22204 - protein, 186 aa, Artificial Sequence; identical to SEQ ID NO: 22203
  Synthetic sequence.

SEQ ID NO: 22205 - protein, 186 aa, Artificial Sequence
  Synthetic sequence.
SEVEDALRRLKELLRRVAEENRKVLEESKKLVEDARRKNEEVLKEIEKLLEDVAREVKDRKGDDEVLERLKEVLKRIEDLIRKVTRDNEELHKRSKKLIEEVHKRNRELIERAEKIIREIKERNKEMEELLRELKKLLEEIKKSVEDLDRELKKLNDEIRDESRKSKEELERLLEDIERALRELAR

SEQ ID NO: 22206 - protein, 186 aa, Artificial Sequence; identical to SEQ ID NO: 22205
  Synthetic sequence.

SEQ ID NO: 22207 - protein, 186 aa, Artificial Sequence
  Synthetic sequence.
SEAEEVLRRIEELVERATRTVEKLAEESKRLLEKLAEENKRVLEEIKRLLDEVADKVRKKKGDKEVLEELKKVLDEIRELLERVHRENKRAHDESKKLIDDLKKELDRVREEIKRLIDEVRERLKEMKELLDELKTLLDEITKRLKDLTDKLERLNDKIRRELERLDEELRELLERIREEMEKLTR

SEQ ID NO: 22208 - protein, 186 aa, Artificial Sequence; identical to SEQ ID NO: 22207
  Synthetic sequence.

SEQ ID NO: 22209 - protein, 183 aa, Artificial Sequence
  Synthetic sequence.
DLEEELKELLERIRKAHEELIKELEDLTEKIERDHEKLIKRLEDLLKRIEDEMRKLLEEIDRDELKKLLEEVLREAEELVKRLRKTSEDNIRESRESNKEARKTSEDNIRDIARLLEELKRRTDSRTVKEILKRIEDSLRRAAKKVKDLAEENKDSLRRVAEKVERILEELKRLLEEIARRVK

SEQ ID NO: 22210 - protein, 183 aa, Artificial Sequence; identical to SEQ ID NO: 22209
  Synthetic sequence.

SEQ ID NO: 22211 - protein, 183 aa, Artificial Sequence
  Synthetic sequence.
SLEEKLEDLIRRLKESNERLKRELERLIEELRKNNERLLKELDDLVEEIERALRDLLREKDDEELRRLAEEVKREVERVKREVKKLSDDDKKILDDLLREVERLSREDERTLDKLKKDVSRLTDSRKVEKILKDAKDSNKKVADTVREILKRARDSNKRVAERVKDLLRRLRELLKELAERVK

SEQ ID NO: 22212 - protein, 183 aa, Artificial Sequence; identical to SEQ ID NO: 22211
  Synthetic sequence.

SEQ ID NO: 22213 - protein, 183 aa, Artificial Sequence
  Synthetic sequence.
DLEEELKELIKRIRDAHRELKERLDKLVEEIKRNNEKLSDDVRRLVREIEKELRRLLEEIKDERLKRLADDVRRKVEELLRRLRKLSEEDKTRVDEIRKELEEISRRNEEELKKLEEDLRRLTDKEKVKKLLKELEESLKRVADEVKRLLEELERSNREVEKRVRELLEEARRLLKDLADKVR

SEQ ID NO: 22214 - protein, 183 aa, Artificial Sequence; identical to SEQ ID NO: 22213
  Synthetic sequence.

SEQ ID NO: 22215 - protein, 185 aa, Artificial Sequence
  Synthetic sequence.
DLERELRELIKRIEDDIRKNVKRNEESIRKTEDELRKNVRENERLIEEMRKELEKLRRRNRDKELVRRVEELVDTVMKESRRIIEEAEKRVRDSAKRSKEVIERVKRELERVVKKIEDLVRKLDKVEEVARKLLDELREIKKRINDTSRTTLEDNKRLAKEIHDSSKESLKRLKKILDDIREEAR

SEQ ID NO: 22216 - protein, 185 aa, Artificial Sequence; identical to SEQ ID NO: 22215
  Synthetic sequence.

SEQ ID NO: 22217 - protein, 185 aa, Artificial Sequence
  Synthetic sequence.
RLAEELRKLIDKVRRDLDRNRETNRELIKRAKDELRKNEEENRRIIDEIRRALEDLTRKNKDEELVKRVEREVEKVEEESRRLIEDLKRKVDEVKERSDRVIRELEERVKKAEKKVEDLIRELDKVEEAVRKVKKEIEDIVREIHKLSKRTLEELERIVEKIHEDSKRMLERVKKLLDKIRRDAE

SEQ ID NO: 22218 - protein, 185 aa, Artificial Sequence; identical to SEQ ID NO: 22217
  Synthetic sequence.

SEQ ID NO: 22219 - protein, 185 aa, Artificial Sequence
  Synthetic sequence.
SLAEELRKLIKRVEDEIRRLAEENKDLIRKARETIRKNEETNREVITRIRREIEKLEKDNRDRKKVEEVKKELEELADRSRRVIKEVKEKLERLMRKSEELIERVERLLEEVRRKVEELIRDLDKVEEVVRELLKEIRKVLEDIRRESKTSLDDIRRLLKEINDLSEETIREAEELLDRIRKKAT

SEQ ID NO: 22220 - protein, 185 aa, Artificial Sequence; identical to SEQ ID NO: 22219
  Synthetic sequence.

SEQ ID NO: 22221 - protein, 185 aa, Artificial Sequence
  Synthetic sequence.
SLREELKRLIDESRKSLRENEERNKKSIDDTRRLLRENERRNRETIKELKKTLDELRRRSKDKDLLRTIEKLIREAERESRELIKKIEEDIRRSEERSKRAIDDLRRKNDELEKEVRTLVRDLDKVKEAVDRLLERIRRINEEINRTSEKTLEENDRLVKELHERSERLLRKLEELLRKIDETIR

SEQ ID NO: 22222 - protein, 185 aa, Artificial Sequence; identical to SEQ ID NO: 22221
  Synthetic sequence.

SEQ ID NO: 22223 - protein, 185 aa, Artificial Sequence
  Synthetic sequence.
SLAEELRRLIEEVKKRLKELEDRNRKLIKEARDELKENEETNRKTIEDIERTLEKLERDNKDKELVRRIREEIDKVREESERLIKRVREKVKKVEEESEELIKEIRKEIKRLEDEVEELIKRLDKVEEAVRDLLRRIRELLRDLERLSEESLRKLKEIVEDIHRKSKTMLDKLRKMLEELRREAT

SEQ ID NO: 22224 - protein, 185 aa, Artificial Sequence; identical to SEQ ID NO: 22223
  Synthetic sequence.

SEQ ID NO: 22225 - protein, 185 aa, Artificial Sequence
  Synthetic sequence.
SLAEELKRLIEESRKSVEELERRNRKLIEDARRDLERLARENRKLIEEIRRRLKDLAKDNKDERLVRRVARLVDKAMKESEEVLDRIRRKIDKVAKESEKIIRDIKRENDDLERKVKELIDRLSDVEEVVRRLLEEIKRLNDEAKRKSKESLDRLREILKEIRKTSERTLEKLKRILDRIREEAT

SEQ ID NO: 22226 - protein, 185 aa, Artificial Sequence; identical to SEQ ID NO: 22225
  Synthetic sequence.

SEQ ID NO: 22227 - protein, 188 aa, Artificial Sequence
  Synthetic sequence.
SEIEELLERIRDLMRRINKKSEDHLRELEKILREIRRLAEKSNEEIERLLRELEDLAEKRRTDEVRKEVRRILEEIERRSKEVIDEIRRLLDDLRKTVDKVEREVREILKRIEEEVRDLTRKLKDDKDMKDLKKTLDDLLDELRKDIERNVKENRDTLKRIEDDIRRLAEENKKLLEEVRKKIEELET

SEQ ID NO: 22228 - protein, 188 aa, Artificial Sequence; identical to SEQ ID NO: 22227
  Synthetic sequence.

SEQ ID NO: 22229 - protein, 188 aa, Artificial Sequence
  Synthetic sequence.
SEIEELLRRLEDILRRIEELIRKVLKELRDLVEKSNDLSRRHLEDAKRILKEIEEEVKRRNTEEVRTRIRKLLEDIKRTLDEVTKEDRELLDRARELAERIIRRIRKLLDDARREVEKLARELKDDERVEELRRRLRKILEDIRKRIEELVEELRRLLKEWEEESKKNDETNREVLKRIEDRIRELER

SEQ ID NO: 22230 - protein, 188 aa, Artificial Sequence; identical to SEQ ID NO: 22229
  Synthetic sequence.

SEQ ID NO: 22231 - protein, 177 aa, Artificial Sequence
  Synthetic sequence.
DEAEEIKERIKKVVEDLERKVRELLRRSEKLAEDLHELSKENIERMKRLLEELEDLVRKRRTEEVIKTAEKVLRDSRRSSKEVADRADRVLEESKRLTREVTEEMRRVLEKLRDEVRRANLDEEIEDLLRKVEERIRELEEELRRLNKKIEEEVRRNKDENRRVNEEIERRIRELAR

SEQ ID NO: 22232 - protein, 177 aa, Artificial Sequence; identical to SEQ ID NO: 22231
  Synthetic sequence.

SEQ ID NO: 22233 - protein, 177 aa, Artificial Sequence
  Synthetic sequence.
DESKEILDRIRKVNEDLRRLAEELLKDSRRVVEEAHKLSEDNIRRLEELLKEIEKEVRRRRTEEVIRRLEEVLKRSRESSEEVVRRLERLLERSRRLTEEVAERVREVNERLKEEVDRANLDDKIRKLLEDSKKTSDELKEELDRLNEEIERSVRDNKRRNEEVNKRIEDEIRKLAT

SEQ ID NO: 22234 - protein, 177 aa, Artificial Sequence; identical to SEQ ID NO: 22233
  Synthetic sequence.

SEQ ID NO: 22235 - protein, 177 aa, Artificial Sequence
  Synthetic sequence.
SEAETILEKIRRANEELNRLSEENIRKSRKVVKELHELSKENIKRARDLLREVKKLVEKRQDERVIKTLEDVIRDSKRSSKKVAEELEKVLEDSKRSSERVAREMERVLRELEEEVRRANLDESIKELLKEVEDDVRKNKEENKKVNKEAEDEVRENKERNTRVNKEMEEEIKRLAK

SEQ ID NO: 22236 - protein, 177 aa, Artificial Sequence; identical to SEQ ID NO: 22235
  Synthetic sequence.

SEQ ID NO: 22237 - protein, 182 aa, Artificial Sequence
  Synthetic sequence.
SERERLERLVREAAKELKRLLEELERLHKKIDEDLKRSNDRLRELHERIKKDIERLLRRIGDDEKLERLRRIAEEVKKRSRESLEEHRKRNEDSKRRSRKSLEDVERTMREVRRRIEDLLRKGGDRVEEILKEIEDILRKVKEDVKRVLDENRRVLEENKEHAERILRENKRMLEELRREAK

SEQ ID NO: 22238 - protein, 182 aa, Artificial Sequence; identical to SEQ ID NO: 22237
  Synthetic sequence.

SEQ ID NO: 22239 - protein, 182 aa, Artificial Sequence
  Synthetic sequence.
DSEERLRKLMREAREELKELLRRLRELHEEIRKRVEELLRRLEELSDKLRRDLERLLREIGKDEKLKDLAKLVKEVLERSRESNDRLRKIIEKVLTDSKKSLDDVARIADEVIRRIEKLLRDGGSRVEELLKTIKELVDRLRRIVEKVLDENRRLLKRLEEEIKRVLDENREMLDRLRKAAE

SEQ ID NO: 22240 - protein, 182 aa, Artificial Sequence; identical to SEQ ID NO: 22239
  Synthetic sequence.

SEQ ID NO: 22241 - protein, 182 aa, Artificial Sequence
  Synthetic sequence.
SKEETLEKLVREVKDRLKKLLEEVRRLTEELERELKKLREELEELSKELEKDLRRLKKRVGDDEKVKDLDRRLREVLRRSKKSLDDLRRIAEDVIRRSRKSNRELEEEARRVIEEIEDILRRGGERVEELLKRIKELLEELERRVEEVLRRNRELLKRLEETIRKVLEENKKLLKEVREDAK

SEQ ID NO: 22242 - protein, 182 aa, Artificial Sequence; identical to SEQ ID NO: 22241
  Synthetic sequence.

SEQ ID NO: 22243 - protein, 182 aa, Artificial Sequence
  Synthetic sequence.
DKEEELRRLVEEVEKRLRELEKELEDLTDKIEKRLRESNERIKKLSDDIRRRLEDLLRKVGDDSRLDDLRRDLKRVLDESEKSMRDHAERNKKSLERSKRSLDELRDIARRVLETIKRILEKGGERVEELLKRIRDILKRVEEIVKEVLERNRKVLEDNERHAEEVLRRNKRLLEELEKRAT

SEQ ID NO: 22244 - protein, 182 aa, Artificial Sequence; identical to SEQ ID NO: 22243
  Synthetic sequence.

SEQ ID NO: 22245 - protein, 182 aa, Artificial Sequence
  Synthetic sequence.
SKEDDLRKIVKEIEEEVRKLLKELEELTKELEDRLRESNKTLKELNERIKRRLEELLRRIGKDEKAEELKRSVEDVERKSKETLDRHEKKNRDSLKTSRDLNERLREILREVLETIRDILRRGGSRVEEVKKELEDLLRRLREEVKRVLDDHRRILKENEDHAREVLKRNKELLRKLEEEAK

SEQ ID NO: 22246 - protein, 182 aa, Artificial Sequence; identical to SEQ ID NO: 22245
  Synthetic sequence.

SEQ ID NO: 22247 - protein, 182 aa, Artificial Sequence
  Synthetic sequence.
SKEERLKKLVDDVRKTAEKLKRDLERLTKEAEETLERLKRELDRLNREIAEEIKKILDRVSEDEKVKELKKLADDVLRKSKETLDELKRILERVLEESKRLNDELRKDLERVLKDIERILREGGEDVETLLEEIERKLREVEKRIREVLKRHRELLRRLRETIKRVLERNKELLDRLREAAR

SEQ ID NO: 22248 - protein, 182 aa, Artificial Sequence; identical to SEQ ID NO: 22247
  Synthetic sequence.

SEQ ID NO: 22249 - protein, 182 aa, Artificial Sequence
  Synthetic sequence.
SKEETLKKLMDRAEEELRRLKRELEELNDRIREALKKLNEDLRRLHEKIKEDIRKLLEEVDKDEKFEELKRLAEDVLRRSRENLRDHERVNKESLEESEKSLRELEKTLDKVRKDIRKILEDGGERVEELLETIERILEEVRRRIEKVLEENKRLLDENKKHAEESLKKNKELLKRLRDAVK

SEQ ID NO: 22250 - protein, 182 aa, Artificial Sequence; identical to SEQ ID NO: 22249
  Synthetic sequence.

SEQ ID NO: 22251 - protein, 185 aa, Artificial Sequence
  Synthetic sequence.
SEVDEVRERLERLLRTVERVVERILRELKRLNDELRKIAEDLLRENKDLLRELAERVRKGLEKRELERLLKELRKRSKESNEELRRVAEKAKEDHRRLLDELRKILKTIEDEIRRLLEDLRRRGVPSEALKDIEKLVRKIKEELKRLLKEVAETLERSERSLDKLIEDHRRLVEDIERALKELRK

SEQ ID NO: 22252 - protein, 185 aa, Artificial Sequence; identical to SEQ ID NO: 22251
  Synthetic sequence.

SEQ ID NO: 22253 - protein, 185 aa, Artificial Sequence
  Synthetic sequence.
SEVEKVLETIKDLLRKLEEIVKKILDEDRKLMEKVTKIVEDLLEENKRLLEELERLAREGQPKEELTKLAEELERRSTKSNEDLKRVVEDWERRSEELLRRAEDVLRKIERTVRELLKELEKRGMPSELLKRIRELVKEVKDRLRRLREELEESVRRARKTLEDLERRHRKLLKDIRETIKELIR

SEQ ID NO: 22254 - protein, 185 aa, Artificial Sequence; identical to SEQ ID NO: 22253
  Synthetic sequence.

SEQ ID NO: 22255 - protein, 181 aa, Artificial Sequence
  Synthetic sequence.
DLDREIERLVEELERRLRELLRRNEELVKRVEDELEKLKRESEKLLRELRKKLEEAKKSKELDDLKKRLEDLADKIRRVHERLNRELKELVERSRRLLKKVEEELKRLVEEIRKVLERLKNVKEAVDKLLKELKDILKKLEELSRKSMEDIKDILRRYEKLVKELLDELKKILDELDRADK

SEQ ID NO: 22256 - protein, 181 aa, Artificial Sequence; identical to SEQ ID NO: 22255
  Synthetic sequence.

SEQ ID NO: 22257 - protein, 181 aa, Artificial Sequence
  Synthetic sequence.
DLKDEIEELVKRARERLERLREESEEIVKELEKVLRDLEKENRDLARRLRDELRKIEPSDKLRELRKRLEELLKESEKLLRKIAEEVKRLVDDIRRVHEELNKRLEELVRDIRRVLEELKDSEEAVRRLKDELRRILEEYERVVEELKKRLKDLLREAERLSKESLDELKRILRKLKEDAK

SEQ ID NO: 22258 - protein, 181 aa, Artificial Sequence; identical to SEQ ID NO: 22257
  Synthetic sequence.

SEQ ID NO: 22259 - protein, 184 aa, Artificial Sequence
  Synthetic sequence.
SLEDELRRLVEEDERNIRKLNDENRKSVRKLEELLRRLNKRNRETIERIKRLLDRLREESTDEDLLRKIEERIDDVRRKLEELDRRLEEVIRRLEKKVKDLDDKWRRLSEEIKKELERLAREGADKEEIDRILRKVERLSRKAHEDVRRINEELEKLLEKLKREVKRENDRVEEEAKRLADEVK

SEQ ID NO: 22260 - protein, 184 aa, Artificial Sequence; identical to SEQ ID NO: 22259
  Synthetic sequence.

SEQ ID NO: 22261 - protein, 182 aa, Artificial Sequence
  Synthetic sequence.
REVDELVKRIEELLREMKKKNDESLKDSRDLLRELEKRVERVIEEIEKLLRDLEELVRKEKGDDEVRKKLEDVLRKIEKLVRDLARELEEALRRSKELSDRNRKDNEDLLRDVERLVDKAKKDGLDEKRLKKLLDELRDMSRKADRALRELNKDVARKIEELRRRLKKLLDEVKERADELTK

SEQ ID NO: 22262 - protein, 182 aa, Artificial Sequence; identical to SEQ ID NO: 22261
  Synthetic sequence.

SEQ ID NO: 22263 - protein, 186 aa, Artificial Sequence
  Synthetic sequence.
SEAEKLLEDLKRLVEDLRRKNKKLNDDNERLTTELEKTSRKLLEELKRLLEKVADDVRRTRDKKRLKELAKELRDRVRKVEKDNRDLLRELEERSRRLLEESKRLLKELLDRARKLVRELERDNKEEGELKERLDRLLEEVKKTIRELEKRNRESHKRTKDVARRSAEETKRVLEKIEDDLRKLDK

SEQ ID NO: 22264 - protein, 186 aa, Artificial Sequence; identical to SEQ ID NO: 22263
  Synthetic sequence.

SEQ ID NO: 22265 - protein, 186 aa, Artificial Sequence
  Synthetic sequence.
SEAEKLLKEIKDLVDELRKRSKELIDENKRLTEEVEERARRLLTELRKLLKRLEELVRREEGKEKLDELLKDVDRKVKEVLKELEDLAEELRRRSRELLKRNDDLLRELEKRVKELLDELKERNKEEGELEERIRRLLREIEKEAKRSRDRSREVHRRTDEELRRLEREIKEILKEIKRKLDELRR

SEQ ID NO: 22266 - protein, 186 aa, Artificial Sequence; identical to SEQ ID NO: 22265
  Synthetic sequence.

SEQ ID NO: 22267 - protein, 182 aa, Artificial Sequence
  Synthetic sequence.
SDVDRLLKENRDVSKKVEDDVRRLLEELKRISEEIARRVKRLLEELRRILREIEELVKKGEDIDELLTRLEEALRRVEETLKRLVDESRKVSKEVLTDLRRLIEESKEISRRLLERLERRGISDELRRRAEKSIEDNERKLRKLEEDAKRIIDDNERILRDLERRAKDVIREVRKALEDLKR

SEQ ID NO: 22268 - protein, 182 aa, Artificial Sequence; identical to SEQ ID NO: 22267
  Synthetic sequence.

SEQ ID NO: 22269 - protein, 183 aa, Artificial Sequence
  Synthetic sequence.
DEAEKLLEEVKEENRRVNEDIKRVIEEIKKLIDESRRLMEKIIRDVEALLTRIRDVVEKLKTSEEVLERLKREIEDIDRRAKELLDDSRRKTRELIERVRERIEELRRRHDDLIRRLEERLKDDEDVRREIERIMRELKKNLDRLEEEIRRIADELRRVNTRLEEEIKRVIDEARKTLEELRR

SEQ ID NO: 22270 - protein, 183 aa, Artificial Sequence; identical to SEQ ID NO: 22269
  Synthetic sequence.

SEQ ID NO: 22271 - protein, 178 aa, Artificial Sequence
  Synthetic sequence.
SKEERLEEILRRHKKSLDEIRKELRKLLEDHRKSIEDLIRKLRELLERLKELLERLERSGVSDEARKRLEEIIDEVRRLVEKITKELEDTLKELEDLVRTITRELEKTLRELEDLVRKGGEDVDRLITEIKRINEELRESVRRLLERAKRIDEELRRTAEELVKTIEKLAKELEETVR

SEQ ID NO: 22272 - protein, 178 aa, Artificial Sequence; identical to SEQ ID NO: 22271
  Synthetic sequence.

SEQ ID NO: 22273 - protein, 187 aa, Artificial Sequence
  Synthetic sequence.
DEIEEVVERIRRIDKELNKRAEEVIRRNKELDERLNREIERVKEEIRRLIKRLEEVTRRDLKDKETLDRTARRVLEEIEKLVRDLERKMRESLKRSRETVKRVKDRLDETRERVRRLLDELRKRNTDLEEAKKKLEDLLEEHERNLRKIERDLEELNERHERNLRKLKRELEEILKRAKEVLDELRK

SEQ ID NO: 22274 - protein, 187 aa, Artificial Sequence; identical to SEQ ID NO: 22273
  Synthetic sequence.

SEQ ID NO: 22275 - protein, 187 aa, Artificial Sequence
  Synthetic sequence.
SEIEKVLREIEEIDKRLNKEVEDVLRENRRVDEELNRHSERVREEIERLVKRLDDVAREELKDKETLRRTLDEARRRIEKIVRDNKRELERSIKRSRETLDTLERRAERTKEEVKRLVEDLRRKKQDKEEMKKTLEKLLREHEENIKELKRRLEELNEEHERNIRRSEETLKKLLKEAEDRLREIKK

SEQ ID NO: 22276 - protein, 187 aa, Artificial Sequence; identical to SEQ ID NO: 22275
  Synthetic sequence.

SEQ ID NO: 22277 - protein, 182 aa, Artificial Sequence
  Synthetic sequence.
EEAERVLKRIADLIEELKRHSEEVSRRSKKLLDDLSRHTEKVSKESEDLLRRLEELARRGEIRDEVLKTVLEDSKRLSKEDKERLEKVTRESKKLSDDDRKKVEEVEREIEKLARDVKRKRDEREIEERLRTLRRRLERMVEEIERLNEENLRRVEKRVRELEKENEDNLREAKKLLDEIRR

SEQ ID NO: 22278 - protein, 182 aa, Artificial Sequence; identical to SEQ ID NO: 22277
  Synthetic sequence.

SEQ ID NO: 22279 - protein, 182 aa, Artificial Sequence
  Synthetic sequence.
SEVEEVLKDIERLIKELREENKRSLDRSRRLAEDLERRNRESLRRIEKLLRELEKIARDLRDKDELRRILKELREEVERISEEDERLAEEVLREHEKINDEDRKKLRALLDTVRKLIEDVIRTEEVRKRAEDVLRRLEEVIKELEKTNEDAKRELKRLIDELRRTNEEVNKRLEERLDKIRE

SEQ ID NO: 22280 - protein, 182 aa, Artificial Sequence; identical to SEQ ID NO: 22279
  Synthetic sequence.

SEQ ID NO: 22281 - protein, 182 aa, Artificial Sequence
  Synthetic sequence.
SEVERVLKDIERLLKELEERNRRSLEESAKSTRKVEEDNKRSLDKSTELLKRLEEDAKDDRDKDRLRKRADELLETHRKINRDDDELLKKNHEDHERINRRDDELLRDVERKIRDIIRRVIRDEEVRKRAEDVRRRLEEILKRLKETNEDMKRENKRVLDELRKTNEDAEKKLRDLIRKLRE

SEQ ID NO: 22282 - protein, 182 aa, Artificial Sequence; identical to SEQ ID NO: 22281
  Synthetic sequence.

SEQ ID NO: 22283 - protein, 182 aa, Artificial Sequence
  Synthetic sequence.
SEVEKVLKEIDELIKDVERTNRESLEESERLLEKLKRENERTVERSERLAEELERLARELKDKDSLEKLLEEVERTHRKLNEDDRRKLEDILRRHKKINEDDERLLREVLKRVEDIIRRVIRTEEVKDRADKLLRRLEEMVEKIRRTNETLLRALEKLIRDLKRNNEEVEKRLREIAKKIRD

SEQ ID NO: 22284 - protein, 182 aa, Artificial Sequence; identical to SEQ ID NO: 22283
  Synthetic sequence.

SEQ ID NO: 22285 - protein, 186 aa, Artificial Sequence
  Synthetic sequence.
SEVDELLKRLKKLLEDDKRLAEELLKTIEKVNDDTRKRSEELLRRLERALEELEKLVRKVRGREELEKVLKDIEEELRTLLEDNERLLREDDKVVKDLIREVEKLNRETEEEVRRVVEEVKKKLKDVEEVKRRLEEVLREIKRLVDETRKELRRIDEESKRLAEKSRRDSRRVEERLRTLLEELRK

SEQ ID NO: 22286 - protein, 186 aa, Artificial Sequence; identical to SEQ ID NO: 22285
  Synthetic sequence.

SEQ ID NO: 22287 - protein, 186 aa, Artificial Sequence
  Synthetic sequence.
SEVEKLLEDMERLLKEDEELVRRLSKRSEEIVRDDRRRNKEILDEIRKLLEELKRLADRLEGREELEKLLKELEDRVDKLIKESEELNEESERRNKKLLDDLERLNRDTERKIEEIVKKVRDRLDKVKDVEERLRRAEERIRRAVERTRDHARRNHEKLKELVKETRESNDRLKKEIRKLLEELRK

SEQ ID NO: 22288 - protein, 186 aa, Artificial Sequence; identical to SEQ ID NO: 22287
  Synthetic sequence.

SEQ ID NO: 22289 - protein, 180 aa, Artificial Sequence
  Synthetic sequence.
EEEERIREVKKRSEDLLEELKRSNERVERESDKLAEEIRRKLEELARRADEVIRRLRARKETEELKKLADELRKLVDEVRKRAERLIREDKRMVEEVKRRSRELIERDKRVVETIERLLRAGEPTEKLLEDLKRINKETERLNRELLRDLERINEETRERIDRLLRELERMIDELRKRVD

SEQ ID NO: 22290 - protein, 180 aa, Artificial Sequence; identical to SEQ ID NO: 22289
  Synthetic sequence.

SEQ ID NO: 22291 - protein, 180 aa, Artificial Sequence
  Synthetic sequence.
SERERAEEIRKRSEDVVREMRESNKDVSRKSEELAKKLREDLKRVEKKVRELLEEIKREKRTEDIERLIEELKRVVEEVAKTLEELIKEDRKVVEDIIRRSEKIIRDNEKLVREVIELVKAGEPTEELLKRLEEISRRSRELNRRLLEDLKRINKETKERADKLLEDLERLLEDIKRRVD

SEQ ID NO: 22292 - protein, 180 aa, Artificial Sequence; identical to SEQ ID NO: 22291
  Synthetic sequence.

SEQ ID NO: 22293 - protein, 180 aa, Artificial Sequence
  Synthetic sequence.
DEDERLKEVEEESKKVADELRDRLRRLMEESRRRLKRLREEAEEIKRELDTIAEDLKREKDTEEIKKIITDLKRIIEKVRRDLERLIREDEEASKELKDRLEKIIEDNERVVREVKKLIKKGEPTEEILRRLEEISEESERRVEKLLRENKEINEETDRRVKELLERLKEVLERIERRVK

SEQ ID NO: 22294 - protein, 180 aa, Artificial Sequence; identical to SEQ ID NO: 22293
  Synthetic sequence.

SEQ ID NO: 22295 - protein, 180 aa, Artificial Sequence
  Synthetic sequence.
DERERLREVLERSRKLAEDLRRSNEELERRSRELAKELRKTNKELEKRLKDKADDLRREKNTKEIEDIIRRLEEELERVIRDSEDLIKKDEDISEEIKRRSEEIIRRNEKFVKEVEELIEAGEPTERLLEELERISEESKRRNDELLEKNERVNEETRRRNEELLDELRRLLEEVERRVK

SEQ ID NO: 22296 - protein, 180 aa, Artificial Sequence; identical to SEQ ID NO: 22295
  Synthetic sequence.

SEQ ID NO: 22297 - protein, 187 aa, Artificial Sequence
  Synthetic sequence.
DIEERIREVLRKARRVLERSEERSRELVERLRRVLEDSRRRTKRLTEEAKELLDEVRKRLDKDEAREKLRKLEELIKRLKEKLDEVDKRLADKVRRLSEMAKEVNDRLRKKIEDVERKLDEVRRRGGDKKLVEDLLREIEKIIKEIEDTTKRVVDELRRLLEEIKRTSDELEKEVRKLLEEIKRATD

SEQ ID NO: 22298 - protein, 187 aa, Artificial Sequence; identical to SEQ ID NO: 22297
  Synthetic sequence.

SEQ ID NO: 22299 - protein, 177 aa, Artificial Sequence
  Synthetic sequence.
STREALKELIDRLRDLVRRIRDKHRKLLEEIKRVLDESERRHRELIKRVEELLRDLARRVSEDILRELKRVLEELTKLSKKNIDDIRDVVRRLEELLRDNIRRIDEVLKRIRELAERGGEDVETIIRRAEEALKRLEDSSRKVEETIRKVLEDLRRSSEEVAERVRRVLERLEEKAQ

SEQ ID NO: 22300 - protein, 177 aa, Artificial Sequence; identical to SEQ ID NO: 22299
  Synthetic sequence.

SEQ ID NO: 22301 - protein, 177 aa, Artificial Sequence
  Synthetic sequence.
SSEERLRKVIEDLKRLAEESRKRHKELIDELRKAVERIERRHKKLLDEIKKVVDDIRRRVSEELLKRIEEVLDEIRKELEENIKRIRKVLDELRRTSEENIRRIEKVLRELEDLVRKGGEDVDTIIEEVKRVLEELKRSTEEVEKRVRDAIEELERSSEELARRIKEVLKRLEEETR

SEQ ID NO: 22302 - protein, 177 aa, Artificial Sequence; identical to SEQ ID NO: 22301
  Synthetic sequence.

SEQ ID NO: 22303 - protein, 181 aa, Artificial Sequence
  Synthetic sequence.
SAEEKLDRLRKEVERLSDETRKELERILKKVEDVIRETRRRAKELEEELRRLIRDIEEKLKDDERLKEALRRISEELRKLLEDLERINEKTRRDVERLIRELEKINEETKRRVDDIIRLVEAGVDIETVIREIERLLEEDRKAVEEILRRIEKLIEDDKRAVDRIVKEIKDILDKLREETR

SEQ ID NO: 22304 - protein, 181 aa, Artificial Sequence; identical to SEQ ID NO: 22303
  Synthetic sequence.

SEQ ID NO: 22305 - protein, 188 aa, Artificial Sequence
  Synthetic sequence.
DIEDELRKLEEEIRRVIEKWKRLTEENRRENERVIRKWDKLSKDLADEIRRVIEDARRKLKDERLKRKLEKLVRDLERILKKDKETVDKVRKELDDLDRRDEETMRRLEKELRDILKEVKRVIEEKKDIKELVKELVDRVKRLIREIEKEARRTSEENKDLLKKIEDDAKRSEDELRELIKEIKKRID

SEQ ID NO: 22306 - protein, 188 aa, Artificial Sequence; identical to SEQ ID NO: 22305
  Synthetic sequence.

SEQ ID NO: 22307 - protein, 188 aa, Artificial Sequence
  Synthetic sequence.
DIEDTLRKLAEDIKKVERDMEESNRRNREKNREVIEKWKKLSDDLERELEEVIEDARRKLKSRDATRKLEELVKELKDILREDRETVKKVKEELDKLDRESEELVRELVERLRKILEDVRREIEKKDKIRELVRKLIEDVRRLIEEIRRENKESSDRNKRLVEEIDERAKRSADELKRLLKEIRDRID

SEQ ID NO: 22308 - protein, 188 aa, Artificial Sequence; identical to SEQ ID NO: 22307
  Synthetic sequence.

SEQ ID NO: 22309 - protein, 188 aa, Artificial Sequence
  Synthetic sequence.
DIEEALDEVRKEIEEVIRRWKKLTRENEEENRKVIEDIRRRLDELRREIEKVIRDARRKLKSRDAKEKLDRLEEELRRILKDVERVIRELEERLKKLDEDDRREMERVVRELKRALDEMRKVIRDKTDIRELVKKLIDDIRKLIDEIRRDAERTSRDNKRLVEEIERTIEKLIREVKELLERIKEEID

SEQ ID NO: 22310 - protein, 188 aa, Artificial Sequence; identical to SEQ ID NO: 22309
  Synthetic sequence.

SEQ ID NO: 22311 - protein, 188 aa, Artificial Sequence
  Synthetic sequence.
DIEEILKKVEDDAREVIKEMRKSNEDNKRKNKKVIEEIERTLKKIEDDARRVIDEIEKKLKREELKKRVEELREELKEILDRMRREIEKLAEELKKLDEESDRLVKKLEDELKKVIDELEETIRRKDKSRELVKKLDDELKELIKKIRTDNKRSSERNDELVKEIRKRIEKLVREAKELLKRIREDID

SEQ ID NO: 22312 - protein, 188 aa, Artificial Sequence; identical to SEQ ID NO: 22311
  Synthetic sequence.

SEQ ID NO: 22313 - protein, 188 aa, Artificial Sequence
  Synthetic sequence.
SIEETLDELRKKIEEVIRRMKKSNDDNEKENREVIDRIRRTNEEIRKRAERVIEDARRKLKSEELTRVLKKLAERLEKILRESEKRVRELAEELKRLDEESKRLVEELVRELETILRELEKEIRRKRDVKERVDKLIREVEDLIRRIEEENKKSSEENKRLVRRIEKDNEDSIRELEKLIEDIRRTID

SEQ ID NO: 22314 - protein, 188 aa, Artificial Sequence; identical to SEQ ID NO: 22313
  Synthetic sequence.

SEQ ID NO: 22315 - protein, 185 aa, Artificial Sequence
  Synthetic sequence.
SLEELLEKVKREIDKVLERIERIVRKNAKENERVIREDERLLRELVKEIKEVEDRIRKRGLDKKDVDKLKEDLKRIIEEWKRLSEKLKRDSEKSLEELKELLKRIAETLKRVIDELRRVLREKKEDGDLMRKLLEEVKELIKRLEEEIEKASREDRRLVEEAKEKSKELAKRIKEELKRIEDEVR

SEQ ID NO: 22316 - protein, 185 aa, Artificial Sequence; identical to SEQ ID NO: 22315
  Synthetic sequence.

SEQ ID NO: 22317 - protein, 186 aa, Artificial Sequence
  Synthetic sequence.
DEVDDIIRKLKELIKELREKSKRISEENKRLVRRLEELSRRIIKEIKDLLEELKDRARKDRDKETLRKILREIEERVKRLAEESRRLSKTVTDESKKLMDKSRETSRRLEETVERLIRDLEEKLKDVEEVKDKLRRIKEEADKAIKDNEDLLRRNERENREAVKRNEELLKEVRREVEEVIRRTRK

SEQ ID NO: 22318 - protein, 186 aa, Artificial Sequence; identical to SEQ ID NO: 22317
  Synthetic sequence.

SEQ ID NO: 22319 - protein, 186 aa, Artificial Sequence
  Synthetic sequence.
SEVEEVIKRIKKLNKETEDAVREVIKRIEDSNEKLLRDVEELIKKIEKALRDLEDKARRVREREELERLLRELEEALEEIERRIRRLLEEDKRRLEELVRRVEKMLDDDRREVERLEKEVRERLKNVREVEELLRRVKRHTEEVVRRVERELRRIAEHVKEVEKTVRELVRRIREKIREVVERVRK

SEQ ID NO: 22320 - protein, 186 aa, Artificial Sequence; identical to SEQ ID NO: 22319
  Synthetic sequence.

SEQ ID NO: 22321 - protein, 178 aa, Artificial Sequence
  Synthetic sequence.
DEARELVKELEDLIREITKTVRRLLEESEELIKRIDDAVDDLRRRDEDLNREIKEEIEKRKRKEKLEKLIERLKESLERVKRTIEKLIRDLERLNEKLRRDVERLVAELEKILKKIKDAGLEERILRELEERVKELEKEAREILKRSEDETDKLREKAERILEDLERKNRRTMDEARR

SEQ ID NO: 22322 - protein, 178 aa, Artificial Sequence; identical to SEQ ID NO: 22321
  Synthetic sequence.

SEQ ID NO: 22323 - protein, 178 aa, Artificial Sequence
  Synthetic sequence.
SEVEELVERVKRLIDEIRKRVTDSVEESKRLIKEIKEEVDRLAEEDKRLNERIKETIRRRKEKEILERLREELDKSLERVEREIEKLIRRLEKLNKESKDRSEELVRELEKLLEKVKTDGLEERIVKKLEEEIRKIIKEIRELNKRSEDETKKIVDEARKILEDLRRENEDTKRKITE

SEQ ID NO: 22324 - protein, 178 aa, Artificial Sequence; identical to SEQ ID NO: 22323
  Synthetic sequence.

SEQ ID NO: 22325 - protein, 178 aa, Artificial Sequence
  Synthetic sequence.
SEVEDLAKRIEDLIRRILRENERSLEESKRLIDEIRKRIEDLLRRSKELIDRIREEVRERKREELLRKLKEDLDRANREVEERIKKLIKDLEDLNKRSKDESRRLIEELERILEELERRGLEKRILDELRKAVKKLEDDSRRLNRESEERTKKLKKELDELLKKSKDETKKLVEDLRT

SEQ ID NO: 22326 - protein, 178 aa, Artificial Sequence; identical to SEQ ID NO: 22325
  Synthetic sequence.

SEQ ID NO: 22327 - protein, 172 aa, Artificial Sequence
  Synthetic sequence.
SEVEKLLRELEDVIRRLREDVKRIVEEDERLNKRLNDELRRLSEKNDRLNDRIRREVTDKDKAMKALDDSNKELEKVIREILELLKRSLDKARKVLEDIEKTLRDILRELEKRLEDKEKVKRLRELVKKVIEDMERILRRLEKANRESAERAKDVLRRNHKKDEDSKRELER

SEQ ID NO: 22328 - protein, 172 aa, Artificial Sequence; identical to SEQ ID NO: 22327
  Synthetic sequence.

SEQ ID NO: 22329 - protein, 172 aa, Artificial Sequence
  Synthetic sequence.
DRVREIVERVERVIRDILRTVEKLSEENKDLNRRLTEKIRDLERRDRELNKRLRDEVTDKDEAKKRLEDSLKRAREVVERIRKTLEDSNEKIRKVIEDLVRRLEELLDRARKELSVKEIVEDLRRKVEKVKRDAEKLLEDNHRRDRRNLREIEKIVEELKRRNEKTLRDLTK

SEQ ID NO: 22330 - protein, 172 aa, Artificial Sequence; identical to SEQ ID NO: 22329
  Synthetic sequence.

SEQ ID NO: 22331 - protein, 172 aa, Artificial Sequence
  Synthetic sequence.
SEVEKLEEEVKEVIERLLRTVRDLSRRNEELNKRLTEDNERILKEDEDLNEELERRVTDADDAERLLRDSIRRWRELSKRIKDKLDRSNEELRRVIEEIKRELERILEELRKRVEDKDVLRKLKKEAEDAIKEAEDILRENHEKDKKNKEDSEKLLRDLERRNEETLRRLRK

SEQ ID NO: 22332 - protein, 172 aa, Artificial Sequence; identical to SEQ ID NO: 22331
  Synthetic sequence.

SEQ ID NO: 22333 - protein, 182 aa, Artificial Sequence
  Synthetic sequence.
RIEEILETLREELRTVLKKSKEILDELRKENKESIDRSKEILDRLRDEIRRILREIREKRVSRADEIERKLREAIKRAERLHEESKKRSEKSIRELEKLHEETRRRLKEAADELEKLAREGIDDEELKRAADKVKKLIKELDEENKKARDDDKRLNKKLNKDNDDLRREVEELLKRLRDEAE

SEQ ID NO: 22334 - protein, 182 aa, Artificial Sequence; identical to SEQ ID NO: 22333
  Synthetic sequence.

SEQ ID NO: 22335 - protein, 184 aa, Artificial Sequence
  Synthetic sequence.
RIEDLVRDNKRKNDENTKRHERIVERLEEELRELVKRHEEDVRRLRKELEDLKRDAERKGIDERVLRKIEKLIREIEERLRRSNETLRKLAEDLIRELEKSNRDLRTLSERLKERLDELRRNNADDKKVEDLDRDNERLNRELTRHLEDLVRRVKELLRRMEEHLRELAERVKKLLDELRKEAT

SEQ ID NO: 22336 - protein, 184 aa, Artificial Sequence; identical to SEQ ID NO: 22335
  Synthetic sequence.

SEQ ID NO: 22337 - protein, 185 aa, Artificial Sequence
  Synthetic sequence.
SDVEELAERVRRLSEEHAELVKRIVETSKRLNDDLRRMVKEIADRVRRLLEDIERKVREDRDKDTLKKLVDELEERIRRLIDELRRLVRKVEELDRRLAEELRRTLEELIRRVRELLEDLKRRVDTEDVRKIIEDLRRHLEENRERVERIIRELRRLTEKTKKELEDIARELEKLVDELREEVRR

SEQ ID NO: 22338 - protein, 185 aa, Artificial Sequence; identical to SEQ ID NO: 22337
  Synthetic sequence.

SEQ ID NO: 22339 - protein, 185 aa, Artificial Sequence
  Synthetic sequence.
SEVEKAEEDIRRLLKEVKDMDKKIVDDDERLNRELERTVRELAKEIEKLIRDLEERVRKERDKRTLDDVLRKLEERLREILERIKKAVEDVKRASEKLERESKELVDRLRKEVERIVKEIRDRVDDKDVKKIIKELEEELEKIAKESEESIKRLRKENRDSEERLRKILEKLKKDLEDVKRELER

SEQ ID NO: 22340 - protein, 185 aa, Artificial Sequence; identical to SEQ ID NO: 22339
  Synthetic sequence.

SEQ ID NO: 22341 - protein, 185 aa, Artificial Sequence
  Synthetic sequence.
SDVEDVVRKIRELIRENLKRSKEIADENRRLNTENRERSKTLEEEVRRLLEEVKERAERLRGREEIKRLVDELRKAVEDVVKRIEDIDRRSEEESKKLEERIRRLDEESERRLRTLIEELKKREDREEVRRILEKLRDDLRKLNETNRRIIKELRERNEKSNRDNRKILEELKDRLKKLEDELRR

SEQ ID NO: 22342 - protein, 185 aa, Artificial Sequence; identical to SEQ ID NO: 22341
  Synthetic sequence.

SEQ ID NO: 22343 - protein, 179 aa, Artificial Sequence
  Synthetic sequence.
DEVDEVDKRSKETLKKIEDDARRVLEEYERTLEKIKRDVDRVLKESEETVRKLRADGRLKEEVADTVRRVHEKAKRKIEEAKKDSERVLEEVKRTIERLKEELEREHTRVREEIKAGRSEKELEDLVRELEEINKRLEEELRKLVEELRRHLEELRDELRKLVEELRKINEELEDRLTK

SEQ ID NO: 22344 - protein, 179 aa, Artificial Sequence; identical to SEQ ID NO: 22343
  Synthetic sequence.

SEQ ID NO: 22345 - protein, 188 aa, Artificial Sequence
  Synthetic sequence.
SEMEDLKRVSDEVKKELEDLNRKSAKVSKEVEEEAKRLNRESREVVRRLKEELEKLERDRASEEELKRVIDKVKEVLDDLKRKHEDLNRRNRELLRKLEKEHRDLNEKNKELLERLDRKVKEGNLKKEVADELKKILDTHRKVDKEAKDRSEKLVRDHREVDKDVKRESDEILKRAKDTLDEIRERLR

SEQ ID NO: 22346 - protein, 188 aa, Artificial Sequence; identical to SEQ ID NO: 22345
  Synthetic sequence.

SEQ ID NO: 22347 - protein, 176 aa, Artificial Sequence
  Synthetic sequence.
SELEKILKEIEEELKRVKERLERLHREHERLLRDVTRKLRKLLRDHREVLERVREELRRRRKDVREVEERNRKTHEDLEREVRKAERELEERNERLKRELDDIARKLEEELEDLKRRNLPREDLERTLRRIKEEVRKVERKAKEVLRETREKLKRLLERAREVLDENKKRLDDVAT

SEQ ID NO: 22348 - protein, 176 aa, Artificial Sequence; identical to SEQ ID NO: 22347
  Synthetic sequence.

SEQ ID NO: 22349 - protein, 184 aa, Artificial Sequence
  Synthetic sequence.
SLEDIRRRLRELVRRLEEELRRSHEELERLVRDLERRLRESLRKLEELVDRLKKEIEKRGRDRRELEKIERDIKKILDEYRERLKELVTRLRDLLRRHRERLEELRKRIEELLRRIEEELRRGTDDDTARRLLEEAKKELDRIKEENERALRKIKDVIRKIDEESKRLNKEVADLVKKIEDRIR

SEQ ID NO: 22350 - protein, 184 aa, Artificial Sequence; identical to SEQ ID NO: 22349
  Synthetic sequence.

SEQ ID NO: 22351 - protein, 184 aa, Artificial Sequence
  Synthetic sequence.
DLEDIVREIEKLLRDLERKAREIHERDERLARDLERKHRDIIREIERLLDELRERVERLPVDDELRKEIRKRLEDIKDLLRRSTEKLKKLKRESEEKNKKLIRELKKVLDDIRREVEDIRRKPVDRKKVEEELERVRRIIKELERRLRELHKENKKLLDEILEESKRLAEEVRKTIEDIKRKIK

SEQ ID NO: 22352 - protein, 184 aa, Artificial Sequence; identical to SEQ ID NO: 22351
  Synthetic sequence.

SEQ ID NO: 22353 - protein, 183 aa, Artificial Sequence
  Synthetic sequence.
SEVEDLLRRDRELNREHKRLLEEASKKNKEELERVLEKVKELLERVKKRLDEAKEALERGEVDDEVLKALEEELRKLLKELKDTLRKLNDDTKKLIDKLKEHNKELEERSRELEKRLRDKTGDDERLERVLRESRKLNKESHETLKELIDRNRKLNKELEEAVKKIEEEIKKLLKELKEEKDR

SEQ ID NO: 22354 - protein, 183 aa, Artificial Sequence; identical to SEQ ID NO: 22353
  Synthetic sequence.

SEQ ID NO: 22355 - protein, 183 aa, Artificial Sequence
  Synthetic sequence.
SEVEKLLREDRELNKRHVEKVRELSERNKELLERHEEKLKKVAKEIEDRLRRLEEMLRRGEADEKVLKDLAKRIRDLLRDLTRHNKELNEETERLLRELEDHNRRLKETSDRLRERLRRKTGDTDRLKRVEEESEELNKRSHETLRRLVEENKKRNKELHERVERIKRRLEKLLRELEEEIRK

SEQ ID NO: 22356 - protein, 183 aa, Artificial Sequence; identical to SEQ ID NO: 22355
  Synthetic sequence.

SEQ ID NO: 22357 - protein, 183 aa, Artificial Sequence
  Synthetic sequence.
SEVEELLDEDRKLNEELTKSAKRLTDENKKLLEDMKRKAEELKKRVDELLKEVTDVLRRGELDEEKLKTLADEIKKLLDKLREDLKRLDERSEELLKRLREEVERLERRSKELAKRLEDKTGKTDRLERVLRESRKLNEDSKKRLEELIKENKDDNDRLREDLERIVRELEKRLDKLRKDTET

SEQ ID NO: 22358 - protein, 183 aa, Artificial Sequence; identical to SEQ ID NO: 22357
  Synthetic sequence.

SEQ ID NO: 22359 - protein, 184 aa, Artificial Sequence
  Synthetic sequence.
KELEDLLRRIKRLIDENRRLSKEVLEEVRKLSEKHKKEVEDILKEIKELIEEALRRIERDGPREELLRRLAERVRKLTEELRRSLKELRKRIEDLERDLDRLDKESEKELRKIEEKARRDNSVPKERLDRILKTLRELLRKLREDNERIRREIREIVKRNSDELARIEEELRKLLDDLAKKAEE

SEQ ID NO: 22360 - protein, 184 aa, Artificial Sequence; identical to SEQ ID NO: 22359
  Synthetic sequence.

SEQ ID NO: 22361 - protein, 184 aa, Artificial Sequence
  Synthetic sequence.
KELEDVLKEVEELSRRHKRRAERVSEENRKLLRRLKEEARKILEDIRRLLKKLEERVRRDGPRKEELDEARKRLKDLARRLKELLDRLDRTTEELARDLERTLRELEERIRRIAEDLRRRQSVDRERLKRILDEIRRIVEKNKRDLERLLRENEELNKRLREELRRILEEIEELLRELEERLRK

SEQ ID NO: 22362 - protein, 184 aa, Artificial Sequence; identical to SEQ ID NO: 22361
  Synthetic sequence.

SEQ ID NO: 22363 - protein, 176 aa, Artificial Sequence
  Synthetic sequence.
SEAEEALKELKETSDRHKEDLDRLHEEDRRTNEEVEKELRKLVDEAKKKLDRVREIVEEGRGREELLKKLREDLRRIEEEIKRTLDELKRKSEEIEERVKRTTRELEKKLEDLERANLVDEELLRRLEEIVRDNKRRVEEILERNRRLNEESEKKVRDIIKKLRDDLERLARELEK

SEQ ID NO: 22364 - protein, 176 aa, Artificial Sequence; identical to SEQ ID NO: 22363
  Synthetic sequence.

SEQ ID NO: 22365 - protein, 176 aa, Artificial Sequence
  Synthetic sequence.
SEAEEALKELKRTSDEHRKRLEDLHRRDKKLNDDSKRRLDELLKRDEDTNRTVLDIARQGKAREELLKELKERTRRLHEDNKRLLRELEKRSKEIEDEIRDTLEKLKRKLDELRKANVVDEELLRTLEKIVEDNAREVTEIIKKNRKLNDDSRREHERINDESRRLNEETEKRLRD

SEQ ID NO: 22366 - protein, 176 aa, Artificial Sequence; identical to SEQ ID NO: 22365
  Synthetic sequence.

SEQ ID NO: 22367 - protein, 183 aa, Artificial Sequence
  Synthetic sequence.
DELEEILRRVDELIKTIEEELKKIEKRVKELLETHRELNKRLLDDHRRLAEEVKKANLDRRDAERLMREMEKKNEEVRKRLEESLERVKDTLRKIEKKLRELAERLRRELEKLRDDLRRRGSDRDRVEDVLRKIAEKIKRLEDRIKEVLDKLRKLAKELEDESRKVLDDSNKLIERVKRELKR

SEQ ID NO: 22368 - protein, 183 aa, Artificial Sequence; identical to SEQ ID NO: 22367
  Synthetic sequence.

SEQ ID NO: 22369 - protein, 185 aa, Artificial Sequence
  Synthetic sequence.
DTERVVTEIKKTNDELKRRHEKVVEDDRRLLEELRRRHERVVREVERLLRELKERVDRRAKDKRELKKRLKELKDRIRKELEDLTRKHEDLDRRVEDEHRKLSEEHEKVHREIRERLEDIRRKKVPREVLKKLLDDNRKIIEDLTRKNEKLHEDSKRIIEKIDDENREILRRVEEIVRRIEEELN

SEQ ID NO: 22370 - protein, 185 aa, Artificial Sequence; identical to SEQ ID NO: 22369
  Synthetic sequence.

SEQ ID NO: 22371 - protein, 180 aa, Artificial Sequence
  Synthetic sequence.
SAEDVKRRIKESADRIRKRLREALERAKKLHTDNEEENKRVNDEIKKRVEEIRRRIPDGEKAKELEDRLRKLLEDSKRDDDRSRKESRELIERTREVLERLARLLDELERRLDEVRKKPTDEKLLRELERDVRRLEREITEVVKRLEDEHKRASERNKRLLEEIKDRVRKLIEEAEERRK

SEQ ID NO: 22372 - protein, 180 aa, Artificial Sequence; identical to SEQ ID NO: 22371
  Synthetic sequence.

SEQ ID NO: 22373 - protein, 178 aa, Artificial Sequence
  Synthetic sequence.
EEVERVRRTIDELSKENEKALKEVEERIKKLSDENEKAVRKAEEDNERLNRTAERLKRSNVSEDTLRRILEEVRRATEDLRRKLEDINRELRERVKRLIEEIREINKRLDDELRRIEEEGVDEKVLRDIRKKIKENHEKNERVIREIERLLKENEERNEEVIRRIKESNRKTEKDLTD

SEQ ID NO: 22374 - protein, 178 aa, Artificial Sequence; identical to SEQ ID NO: 22373
  Synthetic sequence.

SEQ ID NO: 22375 - protein, 178 aa, Artificial Sequence
  Synthetic sequence.
SEVEEVERRIDRLSKENRRVLEEAKRRIKKLSDENKRMLEEARKRNEKLNREVKKLKKSNVDEETLRRKLKEVKERTDKLRKEIKEINEKLAEDVKRIEDEIREINERLDRSLKKIEDDGVDEKVLRDIREKAKRNHDANEKVIREIRDILRRNNEENKRVIEEIDKSNKDTEDELRK

SEQ ID NO: 22376 - protein, 178 aa, Artificial Sequence; identical to SEQ ID NO: 22375
  Synthetic sequence.

SEQ ID NO: 22377 - protein, 178 aa, Artificial Sequence
  Synthetic sequence.
REVEEVKKEIKKLSDENKEVLERARKRIEDLSRENEDVLRRLKERNEDLNRRVRELKERNVSEDELEKILRELEKKTEELADEIRRINEDLDRKLREIEKEIEEINEKLKKKLEEIERRGVDEEVLRDIRRELKENHDENRKVIEDVRRIAEENHRRNKRVIDEIRRSNKETVDELRK

SEQ ID NO: 22378 - protein, 178 aa, Artificial Sequence; identical to SEQ ID NO: 22377
  Synthetic sequence.

SEQ ID NO: 22379 - protein, 184 aa, Artificial Sequence
  Synthetic sequence.
RAEELRKEIEEIIKKNKKENEDVLREDRRRLKELKEEIEKVVREDRRTLEELEERLRRSGLPEEEVERIIRELRDEHRRVEERAEELRRKLDERHKEVEEESERLRKEVRDDKRRLDERLKRNSTEEVLKEIRERVEKLSEKNKRALEKWKRDSERLSREVERELEEWKKRSKRLAEEVEEATR

SEQ ID NO: 22380 - protein, 184 aa, Artificial Sequence; identical to SEQ ID NO: 22379
  Synthetic sequence.

SEQ ID NO: 22381 - protein, 186 aa, Artificial Sequence
  Synthetic sequence.
DLEELEREVEKKLKELEDRVRKVIEESKTELKKLEEELRENSREVRDILRRLEEDVRRKVKDDEDLKRKLRKLKEDMERVNEEVEKRFRDLARELRKHARDLEREAKRLKEEVEETLRRVRKKNVEDKRLLEELRRRLDRVRKEVERLIKEHRETTDELRKRVEKLSEDHRREVEKLAKTVKDELK

SEQ ID NO: 22382 - protein, 186 aa, Artificial Sequence; identical to SEQ ID NO: 22381
  Synthetic sequence.

SEQ ID NO: 22383 - protein, 178 aa, Artificial Sequence
  Synthetic sequence.
SRAEKIREDIRRLRKENEDRIKEIEDEFRKLLEEHERKNKEIEERVRRLVKRIEDEIRRKNVPKDEVKRIRDDIRRLEKRAKEVHERSKRRLDELRERFKRLEKRLREIHEEIERELRKRGLTDELAKRVREVSEDVNRRLDKIMKDLRRVIKELDEESKRLLEEIKRRMEEILEELR

SEQ ID NO: 22384 - protein, 178 aa, Artificial Sequence; identical to SEQ ID NO: 22383
  Synthetic sequence.

SEQ ID NO: 22385 - protein, 180 aa, Artificial Sequence
  Synthetic sequence.
SEEEKLAKDNERLVREHEEESKKLLKTIRDLSEEHKRDLKRAMEENKEKVDRLRDMLKRGEVDDRVIEELKRDSERLLEELRKRSKELKDEIKKRLEDLKKHLDDLKRDSRRLLKELVDKKKRRPEEIATKSEELHKELEETNERIAREVEKLEKENDEILEEIADRSRRLHEDLDRERK

SEQ ID NO: 22386 - protein, 180 aa, Artificial Sequence; identical to SEQ ID NO: 22385
  Synthetic sequence.

SEQ ID NO: 22387 - protein, 178 aa, Artificial Sequence
  Synthetic sequence.
DELEEVLRTIEKLVEDHNRELERVLRRVKELADRHREESERVAREIKKLVDDARRLVEERGPDEEVLRDLERRVRELVDRLRRHLEELEKELDKLKKDLKRSLEELERRVKEIADRLPETDEVRRIRERVKELLDRNRERLERIEREIDRLLEDLKRKNEKIEREVRRLLAKLKEEAR

SEQ ID NO: 22388 - protein, 178 aa, Artificial Sequence; identical to SEQ ID NO: 22387
  Synthetic sequence.

SEQ ID NO: 22389 - protein, 178 aa, Artificial Sequence
  Synthetic sequence.
SELEKIVEENRRLVKEHNERLKRILDELRELAKRHEDRSRKAMKENEELVRTVLELMKRDGPDERVLRELRKRSKDIVDDLRRHLKELSDTARKLIEEIRKSLEELERRTKKLADDLPETEKVRKIREESKRLHETNRRRVEKIEEEIRRLLKRLEDTNRDIERRSKKLHEDLEREAR

SEQ ID NO: 22390 - protein, 178 aa, Artificial Sequence; identical to SEQ ID NO: 22389
  Synthetic sequence.

SEQ ID NO: 22391 - protein, 178 aa, Artificial Sequence
  Synthetic sequence.
SELDKVMRDNDRLVKEHAEVSKELLDRLKKLAEDHKKRSEEVLRENKRLVDEVRRLAKERGPRDEVLDTLRKESKKIKEELEKHLEELSREAEKLIRELEEHLKKLREETKRLRDALPETEKVRKIARRSDDLHRELKERNDRIKREIERLLEELKRTNDKIVEDSKRLHDDLEREAR

SEQ ID NO: 22392 - protein, 178 aa, Artificial Sequence; identical to SEQ ID NO: 22391
  Synthetic sequence.

SEQ ID NO: 22393 - protein, 178 aa, Artificial Sequence
  Synthetic sequence.
DELEEIRKTIEELSKENKKKLEEVMKEVEELARRHEKRSRDLLRRLKKLVDELRDRVEKTGPDKDDLKRLEDELRRLKEDLKRHLTELEKRLRRLSEEMKKHHEELEKRVRDLERALREEERVRKISEDVRKLLEDNKRIAERIDERIKELLKRLEDTNRRIEEEIDRLLEELKREAD

SEQ ID NO: 22394 - protein, 178 aa, Artificial Sequence; identical to SEQ ID NO: 22393
  Synthetic sequence.

SEQ ID NO: 22395 - protein, 179 aa, Artificial Sequence
  Synthetic sequence.
DELDDLLRRAKETSDRHKETLKKILDEMREEVKRHNRDLERILEEVKRLIDEVRKANSKDETLIRELRKRIEELRERIERSLRELRRKLEELERRIRDTLRKLEETLRRLEEELDRRGVPREDVKRIKETMKKLLDENRTEVEKIKREADRLLEENRRLVKEIEDTIRELLKRLEDERR

SEQ ID NO: 22396 - protein, 179 aa, Artificial Sequence; identical to SEQ ID NO: 22395
  Synthetic sequence.

SEQ ID NO: 22397 - protein, 178 aa, Artificial Sequence
  Synthetic sequence.
SKKETIKKDAEEALKRSKKKLDELKERLRKVMRETEERLRRLEKELRDLAREIREKIKKRRVDEDKVKKIEERLKRLEDKLREVEKRLREKYRELEKEVDKVVEKLERDYRRLKDKLEKEPADDRLRKEVEDLNRETDKVIEKLREDIDRLDKESEEVIRRLKDEIRRLFEEIDRRLR

SEQ ID NO: 22398 - protein, 178 aa, Artificial Sequence; identical to SEQ ID NO: 22397
  Synthetic sequence.

SEQ ID NO: 22399 - protein, 183 aa, Artificial Sequence
  Synthetic sequence.
SELEEVKERVDRLIREVEKMNRDSERRVKKLIDDVRRENRRTEEDVRRLVKRAEEIVRKDGKIDEKVLRELEERLRRLKEENDKLLTELEKRLRKLKRENDELLRELKKRLEDLKRELDKDGLEKEKVDRLKKEADDLLRKIKEDNERITEKVKELLERLRKNNEEIKREADRLLEELRRRVK

SEQ ID NO: 22400 - protein, 183 aa, Artificial Sequence; identical to SEQ ID NO: 22399
  Synthetic sequence.

SEQ ID NO: 22401 - protein, 176 aa, Artificial Sequence
  Synthetic sequence.
SELEELDKRITELSEEIKRRLEELLRRNEDLSRRIEEAIRRILKRNEDVIRDIKRKNKKDERLLRELKKLSDENRKRLEELHRRHAEHVKRTEDELRELHREHKEAVDDIRRRMGREDKKVRDIEEKIERLNRELEKIAKEIRERTERLNKRLEELIREVDERNRDLLRRLEEEVK

SEQ ID NO: 22402 - protein, 176 aa, Artificial Sequence; identical to SEQ ID NO: 22401
  Synthetic sequence.

SEQ ID NO: 22403 - protein, 182 aa, Artificial Sequence
  Synthetic sequence.
KDEEDARRKLEELRELARRDIERNKRELERLRREIEKDEEDNEEVIKRLRERVEELRRRQTDKDRAREVLEELKRLIDELRRRNEETKEKLKRIIDEIRKRNEEMEERLRRIIEEIEKKLGREDESLKRLKEELEKLLRDYKKKLDDSDKELRDLLAEYDDRLTRSDKRLRDLLKEAREKSK

SEQ ID NO: 22404 - protein, 182 aa, Artificial Sequence; identical to SEQ ID NO: 22403
  Synthetic sequence.

SEQ ID NO: 22405 - protein, 186 aa, Artificial Sequence
  Synthetic sequence.
DTAERAEEELERSDRELKETLRRAEEELKRSHKELERIVERARRELRRLAEELEEVIRRKKLDEKEVRKLEEILKDVERRVDELLDTLRKISKELEDRMRELDKELKKDSDDIRRRLDELKKREKEEETLRRKLERLLERHKKVVDDVERTLRDLLERHKEVVERVREKLTDLLRKLKKVIDDVRR

SEQ ID NO: 22406 - protein, 186 aa, Artificial Sequence; identical to SEQ ID NO: 22405
  Synthetic sequence.

SEQ ID NO: 22407 - protein, 179 aa, Artificial Sequence
  Synthetic sequence.
SELETIKKRAEELSKESEDILRDIERKLRKLSEESKDILRRLKEELEKLHKELVDKKGRETERIRELKKRNRENLERLRDELRKLNEELERKLREIEERLKELNRKLEKKEEELRRRPTDEELEKELEEVLTEYREVVERLADELRRLLKKYEDDVRRLEEHARRDLEKLDRDIKEEER

SEQ ID NO: 22408 - protein, 179 aa, Artificial Sequence; identical to SEQ ID NO: 22407
  Synthetic sequence.

SEQ ID NO: 22409 - protein, 179 aa, Artificial Sequence
  Synthetic sequence.
SKLDDLLRKIERLVTESLRRLRKTNEDAKRLLERSVRELEKSNKEIRDLVKEIKERNSKDERLLREAERVLDELRKRHEENHRRLEEELRKLLEDHEKNHRELKKVLDKIDEDVKADGVDKKKVDELRERLRELLKRHRDAVEKNRRDLEKLREDHRRLVEKNKRDLDKLKEELDRTKK

SEQ ID NO: 22410 - protein, 179 aa, Artificial Sequence; identical to SEQ ID NO: 22409
  Synthetic sequence.

SEQ ID NO: 22411 - protein, 179 aa, Artificial Sequence
  Synthetic sequence.
SELDELLKRLEELVREIIKRLRDSNRRAKEVVDRSVKRLEESNRTLRELIKDVKDKNEEDERLDRELEERVRELEEEHKENHKRLEETLRKLEKEHRDLLREAKEMLKKLEEELKKRGAPEEKLRRIKRRIDELEKTLRKIIKDNTDNLRKLTEDHRRLVEKNKRDLEKLEEELKRRRK

SEQ ID NO: 22412 - protein, 179 aa, Artificial Sequence; identical to SEQ ID NO: 22411
  Synthetic sequence.

SEQ ID NO: 22413 - protein, 179 aa, Artificial Sequence
  Synthetic sequence.
SKLDELLERIREEVKRSVKRLEDSNKEIKRLMEESADELRRSNKELRDAVRDLKRKNSKDETLTRRLEKLIEDLERRHKRNHEELKRVLDELAEEHKRNHKELERVLREIKERVKADGAPEEKVRRLDKVLEDLRREHEKIVRDNEENLRRLLERHKRLVDKNKEDAERLLRELRETVR

SEQ ID NO: 22414 - protein, 179 aa, Artificial Sequence; identical to SEQ ID NO: 22413
  Synthetic sequence.

SEQ ID NO: 22415 - protein, 183 aa, Artificial Sequence
  Synthetic sequence.
SELEELLKRLRDLIERIVKRLRELSKESEDLIRRIERTIEKLSEDSERAIEEILRRIDKGTSEDTARRLLERFKELNKRSEDELEKLKRELEKLDKRSDDELREIKEELRRMVREVRERVRKVTEDRLREVEEEAKKLEKRIEDMIRKHKETNKRLKEELDKLVKEHKDRNRKLLEELKKRAT

SEQ ID NO: 22416 - protein, 183 aa, Artificial Sequence; identical to SEQ ID NO: 22415
  Synthetic sequence.

SEQ ID NO: 22417 - protein, 178 aa, Artificial Sequence
  Synthetic sequence.
SEIEEVIERLDDTMRRIEERIRDTNRRLKKVIDDSKRRNERTNREVRKTIEKLTRELERDGRGGELAKRIREVLEELKRRSEELEKENRRLLDELRKESEDLADEIRKTERKLEDDLRKADAREEVKRRLEELRRRIEKMLEEHRESLRRLEEELEESHKRHKDTLRKLSKELEEKLK

SEQ ID NO: 22418 - protein, 178 aa, Artificial Sequence; identical to SEQ ID NO: 22417
  Synthetic sequence.

SEQ ID NO: 22419 - protein, 182 aa, Artificial Sequence
  Synthetic sequence.
DEVDEVLKRVDELLKRHEETNKRLEEEIRKIHEENKRTIEELLKEVRKRAEEVERLVRRDGPREEEIRKIEEALKRLLRELEKHLDRSRKRLKKLLDENRRHLRELERELDKIEEDLRRNRVPEEELKRVKERLKEIRKRAKESHDRLRETVKELIDRNRKLLRELEEELRKIEEKIREDAR

SEQ ID NO: 22420 - protein, 182 aa, Artificial Sequence; identical to SEQ ID NO: 22419
  Synthetic sequence.

SEQ ID NO: 22421 - protein, 173 aa, Artificial Sequence
  Synthetic sequence.
SEEDELRETAKRIREEVKKSIEENRELAKRITDEVRELLERNKRRIEEVKERLERSGVDERVLREAERVLRELKKRHEDLLEELKKAIKRLEDKHRKVLKELEDEIRELERLSKRKDEDDLRRRLEELLKRLRDESRKVNEDLKRLVDELRRLSKEMNEELKELEDRVREKER

SEQ ID NO: 22422 - protein, 173 aa, Artificial Sequence; identical to SEQ ID NO: 22421
  Synthetic sequence.

SEQ ID NO: 22423 - protein, 182 aa, Artificial Sequence
  Synthetic sequence.
SEEDEVREDNKRIVEEVERLLKEIEDNNREITREAEELLKRLEEEARRLMEEIRRSKSGDKRLLEELIERLKEVLTELERRLRELKEENEEVLTRLRREVEKIKRENKELLDRVRELRKKVRDEELLRRLRDMNRRSKERADRLIEEAKKENDRSSKRVRDLIREVDEILKEVKKRVEDVTT

SEQ ID NO: 22424 - protein, 182 aa, Artificial Sequence; identical to SEQ ID NO: 22423
  Synthetic sequence.

SEQ ID NO: 22425 - protein, 177 aa, Artificial Sequence
  Synthetic sequence.
SEAEKVVEELKKLLREVEKKIRDHTEDVKRILEELERRLRKHSEEVRRTAKELKDKNSDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 22426 - protein, 177 aa, Artificial Sequence; identical to SEQ ID NO: 22425
  Synthetic sequence.

SEQ ID NO: 22427 - protein, 177 aa, Artificial Sequence
  Synthetic sequence.
SEVEDVIRKLRRKAEDLTRRLKEHTDDVKRLMEELSKDIKDHTREVKRIAREAKEKNRDRETLRRILEELRRSNEELKRRLDEALEELRKSNEELRERLERVLRDMRRLLEELKDRVDEEVLRDLERVLRDIERRLRELLRRNEEVLDRIRRTLEDLHRKNEEVLREIERDLRERER

SEQ ID NO: 22428 - protein, 177 aa, Artificial Sequence; identical to SEQ ID NO: 22427
  Synthetic sequence.

SEQ ID NO: 22429 - protein, 177 aa, Artificial Sequence
  Synthetic sequence.
SEVEDVIRRLKKKLRELVERIREHTKRVRDLARKLEEEIKRHTEEVKRIADEAKKRRSDEETLRRIEEELKKSNEKLERKLRKVVKELAESNKRLREELKKVVDELRKEVESLRDRVSDELLKRLEDVLRKIRKDLEELLRKNNRDLEEIKKRLEELHRRNRETLERIRKDLEEDER

SEQ ID NO: 22430 - protein, 177 aa, Artificial Sequence; identical to SEQ ID NO: 22429
  Synthetic sequence.

SEQ ID NO: 22431 - protein, 182 aa, Artificial Sequence
  Synthetic sequence.
SEIEEVLERIKKLLDELRKESRKLLEDHKKRAEELEEKARRLSERHKELLDRLKEVVDRDGPRDETLERLRRESEKTKKEMEDTIRRVEEESEETIRRHRRSVREVRERLKELRRELDKANLPEEMLKRAEDLLRRIDEELKRSHEELKELSDRIRERLERLLRTLEELSKEIDKRADDLRK

SEQ ID NO: 22432 - protein, 182 aa, Artificial Sequence; identical to SEQ ID NO: 22431
  Synthetic sequence.

SEQ ID NO: 22433 - protein, 182 aa, Artificial Sequence
  Synthetic sequence.
SEIERVLEELRKLLEELRRESKKLLDELRKLLEDARRESEKLLRELKDLLRRAEELVKRDGPDKDTLDKVRKRMEELHRTHEKILRELKRRADELREDHRRKLETIEKRLKEIEDELRKANLPEKVLDELRRELDKIREDLKKSHRELEELIKKIRTELDKSNRKLEELLKRIEERLDEMRR

SEQ ID NO: 22434 - protein, 182 aa, Artificial Sequence; identical to SEQ ID NO: 22433
  Synthetic sequence.

SEQ ID NO: 22435 - protein, 182 aa, Artificial Sequence
  Synthetic sequence.
SEAEKVLEELKKLLRDLEETSKRVLREIRELLKEAREKSKRLLDRLRKLARDLKELVRRDGPVDEAIRRVKEELERLSREHRKMVEEIKRRLEELHKRHKKKLEDIRKTLDDIKKELERTNLPKEVLDRIKRLLEEIERELERSNKELEDLLRKIEEDLERSHRELEKLIREILKELEDARK

SEQ ID NO: 22436 - protein, 182 aa, Artificial Sequence; identical to SEQ ID NO: 22435
  Synthetic sequence.

SEQ ID NO: 22437 - protein, 177 aa, Artificial Sequence
  Synthetic sequence.
DAEERLRKLLDDIRRELKRLTEETRKSLEKIKRDNDELEKKLRKLNEDSDRRLKEANVDERIKEEMERSRRELEEKNRRSRKRIEDMARRVEETHKRIEDDLRRLAERIKELEARGIDEKTIEDLLRELEKALRDLEKEVREINKELKRVLDEIAKTHEDLLKKHEELLRRVEERAR

SEQ ID NO: 22438 - protein, 177 aa, Artificial Sequence; identical to SEQ ID NO: 22437
  Synthetic sequence.

SEQ ID NO: 22439 - protein, 178 aa, Artificial Sequence
  Synthetic sequence.
DLERELEKLLKDIKEELDKLIRTNEETLKEIEREVRKLLKRNKELLDRIREEVRKTGTDEDEAEKLLRDLKRSVEKLEREHREVRREIEEKLERLRRLHEEIRKRIRDLLEDAKRRKVPKEVVDRILKEARELLERIREENRRTLEDLRRILEDLRRRNKRHLDELRRVLKELRDKRK

SEQ ID NO: 22440 - protein, 178 aa, Artificial Sequence; identical to SEQ ID NO: 22439
  Synthetic sequence.

SEQ ID NO: 22441 - protein, 178 aa, Artificial Sequence
  Synthetic sequence.
SLEERLEKLLKEIRETVKKNIEENRDLLRRVEEDLRRLTERNKRLLEKIRDALRKAGSGKDRVRKLDEDMERTLRELRRRVEEVRKKLEESLRRLEEELKRILERIERLIERIRREKVPEEVARRLMDDLRRLLEKIDRLSREHLERVRKILEDLRRLSEKHLKELEDLLREAEEEAR

SEQ ID NO: 22442 - protein, 178 aa, Artificial Sequence; identical to SEQ ID NO: 22441
  Synthetic sequence.

SEQ ID NO: 22443 - protein, 178 aa, Artificial Sequence
  Synthetic sequence.
SLEERLEELLDEIRKMLKRLEDENRRLLKEIEKRVRENTRTNRELLKRIEDRIRKAGSDEKDADEVRRRLEKTVEDLERELRRLLEEIRRSLDKLRRDLERLEEKIERLIEEIKRRKVPEEVVRTLLRELEKILAEAEDLSRRHLERLRDILREAEDLSRKHLEELKKVLEELERRAK

SEQ ID NO: 22444 - protein, 178 aa, Artificial Sequence; identical to SEQ ID NO: 22443
  Synthetic sequence.

SEQ ID NO: 22445 - protein, 179 aa, Artificial Sequence
  Synthetic sequence.
SDVERLLRELEDLLRRLEERIRELNKRHEELVRRLKEEVKRLSREHNEVVADVARKNDKDEKLDRDLRRLNEKVRRDVEKLIEDAKRVNDEVRKTVERLKEEAKRTLDEVKDRIDKRRVPKELRDRLRDVVRRLEDELRRLDDELRKNSEEVKKVLDDLRRHLEENSKRAEDTLRELRR

SEQ ID NO: 22446 - protein, 179 aa, Artificial Sequence; identical to SEQ ID NO: 22445
  Synthetic sequence.

SEQ ID NO: 22447 - protein, 179 aa, Artificial Sequence
  Synthetic sequence.
SEVEKLLRELEKALEDLRRTNEKLDREHDAVVKEVKKIAKDLSREHRDVVEDVKRKNSKDETLERDVRRRTERIREEVKRLADDVKRRNDELKKRLDELKKRLEELLREAERRIDENRVPEELRDELRRVVEDVEKKLDDLRKRNEENSRKVKEVLEKLTRELDKNREEVERTLEELRR

SEQ ID NO: 22448 - protein, 179 aa, Artificial Sequence; identical to SEQ ID NO: 22447
  Synthetic sequence.

SEQ ID NO: 22449 - protein, 179 aa, Artificial Sequence
  Synthetic sequence.
SEIEKLLEEIKESLERLKKTAEDLLEELRRLLEELERRVKELSDEHRRLVKELKDRNSKDDTVVERVRKRSTEIRKELRELLEDVRRKLEKIREELEELSKRHKETLEEIDKEMDRRNISEELKKRVEDVLREIKRAHDDLRRRLEKILRDIEKTIEDLERHMKENHDDAERVIEELKR

SEQ ID NO: 22450 - protein, 179 aa, Artificial Sequence; identical to SEQ ID NO: 22449
  Synthetic sequence.

SEQ ID NO: 22451 - protein, 176 aa, Artificial Sequence
  Synthetic sequence.
SEEEALERVLRELRRSLEELEEELRRAIRKLEDNLRRLREALETILKKLDDLLDDLRRRKPRETLEEIRRRLEELKEKIKKILTDLEKAYRDLKKKLDEILKRLEERYRELEEKVRRNGFDDKLKKEADDLDRRSRKTIKEVLDEIKELDDRSNERIEEVIREIEDEARRLAREVD

SEQ ID NO: 22452 - protein, 176 aa, Artificial Sequence; identical to SEQ ID NO: 22451
  Synthetic sequence.

SEQ ID NO: 22453 - protein, 176 aa, Artificial Sequence
  Synthetic sequence.
SEEERLREIRERLKKSLEDLKRELEEILRELERSLDKLRRDLERLLEDLRRLLDELRRRKDTESLEEIERRVRELEEELKKIDKDLEDEYRRLEEELKKVTKELKREYDELEKEVRKRGVREELEKKARELNERSKEKIKRLLEKLRKLDKESKDEIKRVLDKLRELAKRIKEEMD

SEQ ID NO: 22454 - protein, 176 aa, Artificial Sequence; identical to SEQ ID NO: 22453
  Synthetic sequence.

SEQ ID NO: 22455 - protein, 176 aa, Artificial Sequence
  Synthetic sequence.
SEEERLRRVIEEYKRVLDELSERLKRLLDELRRSLKKLEEDLKRLLDELKRTLDELIRRVEDDRLRELREEVKKAAEEIKKILKKLRELYTELEKELDRAHKENEKELRKLEEEVRRKGFSEELEKKLREALDTVRRLYEALIKKARELDKRSKDEIKRVVDKLKKLVRDIEERVR

SEQ ID NO: 22456 - protein, 176 aa, Artificial Sequence; identical to SEQ ID NO: 22455
  Synthetic sequence.

SEQ ID NO: 22457 - protein, 182 aa, Artificial Sequence
  Synthetic sequence.
DDIEDVLRRIEKLIRDLRDHSRKLVEEIEKLIEDHTRHSRKLERDIKELLKRLRELRRRGDLTEELLRKAKEELKDLLRRHEEVSERLKRRLDKLETDHDRVIKELEDRLRRIAEELERRDTSEEVKKRLDEARRKAEKVVKESRDTLRELKDKVRENLDRSRKELKKLEEELEEVLREARE

SEQ ID NO: 22458 - protein, 182 aa, Artificial Sequence; identical to SEQ ID NO: 22457
  Synthetic sequence.

SEQ ID NO: 22459 - protein, 182 aa, Artificial Sequence
  Synthetic sequence.
SDVERVAKTIEDLIREHTEHVKRSAERVERLIKEHTDHVRRSLTRIEDLLRRLEEMRRRGDSTEEVLDTVRRELRKLLKENEDRSRELEKELRELLERNEKKTKELEDELKKILRELERKPTSEDVERKARELERKVRENVRKVRDDHRKLEEKFRDNLRKVKREHEEAERKMRDLLREARR

SEQ ID NO: 22460 - protein, 182 aa, Artificial Sequence; identical to SEQ ID NO: 22459
  Synthetic sequence.

SEQ ID NO: 22461 - protein, 182 aa, Artificial Sequence
  Synthetic sequence.
KDVDKVEEDIERLLADLRRHNEKLHRDIERLLEELRRHNDKLRKTLEDLLKKLKELAERGDNEERELKRAKEEVDKLIRDHEEVLRRVEEEIEKLIRDHEKKLEDVRRTLRDILRKLEKKPTSEDVKRRLEDLERKARRVLEESRKDLEEAKKKVDELMKRARDSLRELTRRLEELVRRIRK

SEQ ID NO: 22462 - protein, 182 aa, Artificial Sequence; identical to SEQ ID NO: 22461
  Synthetic sequence.

SEQ ID NO: 22463 - protein, 182 aa, Artificial Sequence
  Synthetic sequence.
SEVEEVMKEIERLIEELRRHNEELARRLEELIKDHTRHNEELHKTIEDLIKELEDLARRGDLDEETLKRVARDLDELLERHERRSREIEERIRRLLERHEEELERIAREVKKILDELKRKPTSEEVEKRLRELKEKLDKVLDELRETLKRLEEKARENLKRSRDDLETIKRKLKKVMDEARR

SEQ ID NO: 22464 - protein, 182 aa, Artificial Sequence; identical to SEQ ID NO: 22463
  Synthetic sequence.

SEQ ID NO: 22465 - protein, 185 aa, Artificial Sequence
  Synthetic sequence.
SDVERLIEELERLLDELRKKTEEIIRRIKKLIDELRRKTEEVIKRLEKLARDLTRLTERGSDKEEVDRILDEIKKRVEKIERELEETHKKVRRRLEELETEMEKLHKELKERIEKLSKELEDKGTSEEARRRIDEIRKKAEEVNKESRDRLRRLKEEVDKVDKDSKRRLDELREELRRLMEESKR

SEQ ID NO: 22466 - protein, 185 aa, Artificial Sequence; identical to SEQ ID NO: 22465
  Synthetic sequence.

SEQ ID NO: 22467 - protein, 176 aa, Artificial Sequence
  Synthetic sequence.
DAARELRERLKKAIEDHRRLLERAARDVERLNKELEDILRRMAEDMKRSIEELKRVSEEGRVDDEIARRHEEDNKRLEEELREVAKRLEDKHRKVKEENDRSAEELKRRIDKLRKDKLLDEKDLRRLEEEIRKEIRRSNETLKKLKKKTEDSLRTIKRRLEELHEEAKKVLDDLRR

SEQ ID NO: 22468 - protein, 176 aa, Artificial Sequence; identical to SEQ ID NO: 22467
  Synthetic sequence.

SEQ ID NO: 22469 - protein, 178 aa, Artificial Sequence
  Synthetic sequence.
REDETLKRLEEENEEVNKRSEETLRKLLEDNRRLLERIEERLRELLEELRRLLEKIRKDRRLPEEMIKRLRDLLRRLEEELRKALEEAEKSLRELEREIEELRRRSRESSKKVKDELRERRDKDELTERVKRHIEENKKLTEDVARKSEKHLRDLEELLERLRKLVEDLLRRLEEEAR

SEQ ID NO: 22470 - protein, 178 aa, Artificial Sequence; identical to SEQ ID NO: 22469
  Synthetic sequence.

SEQ ID NO: 22471 - protein, 185 aa, Artificial Sequence
  Synthetic sequence.
SELEKVRKESERNLRSNEKLLRELDELSERNLDKLRRFVEEVRELVREMLERLDSVRRRNVSEDELRKLAREVEEILKRIKERLERLAKESEDLLRELKKRLEKHEEDSKELAKRLRDELRDRRVSEEVKRDVERNEKENKELLDRTRRKVEENAKRNKKLLEDIREDLKRLATELRRKLEEIRR

SEQ ID NO: 22472 - protein, 185 aa, Artificial Sequence; identical to SEQ ID NO: 22471
  Synthetic sequence.

SEQ ID NO: 22473 - protein, 177 aa, Artificial Sequence
  Synthetic sequence.
DKEETVKDLERRYRDLLREIEKRLRELVRRNDKLLEEIKKAIEDLIRENEKKIKEIKERRGRTKEVEEIEKSLEELRKEHERVVREAEKSVEELRKRHEKAIRDSRRHLEELKDELEKRRIDDELRRRAEEALERNKRLLEELKKENDDHLKRLKELLEELKKRNEDHLRRLDEEER

SEQ ID NO: 22474 - protein, 177 aa, Artificial Sequence; identical to SEQ ID NO: 22473
  Synthetic sequence.

SEQ ID NO: 22475 - protein, 182 aa, Artificial Sequence
  Synthetic sequence.
KELEEIKRAVDESLKRAKELMDRHRREVEKSLEEMKRLAEDHKRRADRLLKELKRLADEGRPREDLERKLDELKRDLERHSTELKKELEKNHRELEEHSKKLKEDLKRNHEELDRLVKSRKKSDEVRRAVKELKDRHKELLDRIERESERLREEHRRLLEKIERTSEDLIRRLEKLIRDIRR

SEQ ID NO: 22476 - protein, 182 aa, Artificial Sequence; identical to SEQ ID NO: 22475
  Synthetic sequence.

SEQ ID NO: 22477 - protein, 182 aa, Artificial Sequence
  Synthetic sequence.
DEVETVEEEVKKSLEELRDLARKHEKKVRESLKRLEESLRRSEEKVKDIIRRLEELKKRGEPKKDLERDIDELKKRLDETAEKNDEEMRRNHRELEEHSRRLKKKLEDNHKELEDRLRSEKKSEEVKKRLEDLRKEHEDTLRDIERRSRELLKRHKDKVDEIRKAHERLIRELEEIARRIKK

SEQ ID NO: 22478 - protein, 182 aa, Artificial Sequence; identical to SEQ ID NO: 22477
  Synthetic sequence.

SEQ ID NO: 22479 - protein, 182 aa, Artificial Sequence
  Synthetic sequence.
SEEEELKKKLEKSLDELRRSLKKSAEDVRRILEELKELMKRHKEVVEEIARELDELRKRGEPEEDLERRLRKLLEEARRHSRELEKRLRELEEEVRRIAKENRDRMKRNHEELEKELRSTKKSEDVERSLRDLRRKHKELVDRIDEEHKRLEKELRDIIEEIERRSRKLLKELEDIIRETRR

SEQ ID NO: 22480 - protein, 182 aa, Artificial Sequence; identical to SEQ ID NO: 22479
  Synthetic sequence.

SEQ ID NO: 22481 - protein, 184 aa, Artificial Sequence
  Synthetic sequence.
SLEEELKRVMKEVRDLAKEHSDRSRDVMREIRELSEENERRLRRVLEEAKRLADDLRRDRRKELLEDLERKLRKLVEDARRHHKKLEDDVKRITDELEKHLRELEKRLRDLTRRLEELLRREKVEERLKDILRRIREDIERLLDELRKLNEKIKRDVDRLLKENKETLDDIERRIRKLLDDERR

SEQ ID NO: 22482 - protein, 184 aa, Artificial Sequence; identical to SEQ ID NO: 22481
  Synthetic sequence.

SEQ ID NO: 22483 - protein, 181 aa, Artificial Sequence
  Synthetic sequence.
SVEELITRVERENERVARRDEELLRENEKRNRDVTREDRDLLKKLKEEVEEVLKRIREEGKEREEIAKRLKEILDRLKKESDDVEERSKELLEELERSSREAKARMDEHLRDLRRRVKGGVSEETVKELVKHNEDLLRKWEKKSEDLSRKNEEALERWRRKSKKLAEELKKTLEDIRREVT

SEQ ID NO: 22484 - protein, 181 aa, Artificial Sequence; identical to SEQ ID NO: 22483
  Synthetic sequence.

SEQ ID NO: 22485 - protein, 179 aa, Artificial Sequence
  Synthetic sequence.
DVEDKIRRLKERIKEVTERDRKLLEELKREAEEVLRRDKKSLEEVEREIEEILKDAERKGKRDERIEKTLRDLVERYRREHKRAAEDVERLKEEYERKHRDAKRKIDELERKLEDKLRDKKRGGDELIREVEKVLEDWKRKVDELNRRLKKVLKEWEDTVRKLNEELKDVLDKLREELD

SEQ ID NO: 22486 - protein, 179 aa, Artificial Sequence; identical to SEQ ID NO: 22485
  Synthetic sequence.

SEQ ID NO: 22487 - protein, 174 aa, Artificial Sequence
  Synthetic sequence.
DMEDKLRKIKEAIKKVLDEIRKLLEDIRRRLKRVREEIEEIHKRNEEENDRVKKELNVTEDLLREIEEVDKKLKEDSEDHKKKVDEVRKRLEDKLETLRKRAEDLAKKIDDDLRKDGVTDELIKKIRELLEELKDELRKLLEEAEEVLERLKRSVEELSRRNKKLVEDLDRKTR

SEQ ID NO: 22488 - protein, 174 aa, Artificial Sequence; identical to SEQ ID NO: 22487
  Synthetic sequence.

SEQ ID NO: 22489 - protein, 174 aa, Artificial Sequence
  Synthetic sequence.
SVEEKARDILEKLKRVVEKIKEIADRNRRENEDADREIKRLIEENKKRNEDLLRRLNVTEDLLRELEEADKESEKTFKRLDEDVETKNRDSDKKVRDIEEKIRDVLRKIKDELDKKGVTDELIKRIKEIIETLEKEVEDLSRENKKKVEEILDKVRKVSTRNREKLDELDKKVR

SEQ ID NO: 22490 - protein, 174 aa, Artificial Sequence; identical to SEQ ID NO: 22489
  Synthetic sequence.

SEQ ID NO: 22491 - protein, 182 aa, Artificial Sequence
  Synthetic sequence.
SDEEILRELEKRLEENVRRVEKRHEELEREVRDNLRRAEEKHRELEERVKRVIEEVIRTKGDEGEEARELSKTLRRLSEKHRRDTEKLLRDLKELSDRHRDRTRKIREELRRKLEEARRANSSEEMVRKLVEDVDRLITDHTRSLEDVDRKVKDVIRRHTDSLRKVEEDVKRIIEELRKKAE

SEQ ID NO: 22492 - protein, 182 aa, Artificial Sequence; identical to SEQ ID NO: 22491
  Synthetic sequence.

SEQ ID NO: 22493 - protein, 182 aa, Artificial Sequence
  Synthetic sequence.
DDEEILKKLREDVERVIKKIEDSLRELRKRLKDNVDRAEELHRRLEERAKKLIDEIIKKRGDRGERLDELRRRLEELSDRHRKETTKLERELEELMKRLREELKKALEELEKLLEDIRRAKLDREFVRRLAERVKKLLKELEDRLRELEERVKEVITRHTRSLEEIVRRVERVLEEMERAAK

SEQ ID NO: 22494 - protein, 182 aa, Artificial Sequence; identical to SEQ ID NO: 22493
  Synthetic sequence.

SEQ ID NO: 22495 - protein, 178 aa, Artificial Sequence
  Synthetic sequence.
SETEEAKKEIDEIIKRIEEETKRLRETYKRIIEEIERVSKRLEDEYRKLIEELERAKREGRSEKELTDLEKRLKEEDDRTREDSRRLEEEVKEKNKKSKKESDDLARKVREDLDRLRKGGVKTEELDKLRRRLEEILKRHEESNKKLSEDLERILEEHRRENERLHRELREILERLRR

SEQ ID NO: 22496 - protein, 178 aa, Artificial Sequence; identical to SEQ ID NO: 22495
  Synthetic sequence.

SEQ ID NO: 22497 - protein, 178 aa, Artificial Sequence
  Synthetic sequence.
SIEDILRELEKELRESSKRSREILERLREELRDSSRRSEEILERLKRKVKRVKEEIEPRESVERVEEELRRLEKELKDLNEKLERDHRRLEEELERLNKELKDEHEKLVRRLEEEGNVDDKRVREVAERLRRLNERYNREVKRLEKEARRLNEEYNRLVERLAREVEKLIRDLKEEAR

SEQ ID NO: 22498 - protein, 178 aa, Artificial Sequence; identical to SEQ ID NO: 22497
  Synthetic sequence.

SEQ ID NO: 22499 - protein, 184 aa, Artificial Sequence
  Synthetic sequence.
SLEDLVREIRKRLDDMEREVKKVDDESRKRLDEARKRVEKINRESEKRLKEVADELSELKDDELKKRLEDLRRELRKLHERADRELEELTRRLEEKHKEAKRELDELKRRMEEILRDIERKNSSDEKLARDLRREVRKLEKRLEELLKELKETTEKILRELERLLKKLEDDTRRVLEEIKELKR

SEQ ID NO: 22500 - protein, 184 aa, Artificial Sequence; identical to SEQ ID NO: 22499
  Synthetic sequence.

SEQ ID NO: 22501 - protein, 173 aa, Artificial Sequence
  Synthetic sequence.
DEEREVKRKYREDLDDIRRHSEEVLKRYDEAVKKLDEDLKKVVEEYERALEEIVRRAGEDEELRREVEENRKRNEDKARTKREDHKRNSKRYKDEHDRLEKEHRENEKRKDDENSSEEEMSKDLERELRRSRRENERLAKELEDALRKSEEDIRRLVEENKERLERLERELSR

SEQ ID NO: 22502 - protein, 173 aa, Artificial Sequence; identical to SEQ ID NO: 22501
  Synthetic sequence.

SEQ ID NO: 22503 - protein, 186 aa, Artificial Sequence
  Synthetic sequence.
SEAEKVEEEVKELVKRNREKHDEIRRRIEKLKEDLKRTSERSERKIKRLVEKIDDTLRKKGPDTDKLKRIRKRLEDKERKMKEDHRRLEEELERADKERKERTDKSDKKLRDDTEKTKDDLRKRGPGEDELKRMADTIRDEIRKDNERLRRTLEKAKREADEYRERDKRKLEDFEREIRRIEEETR

SEQ ID NO: 22504 - protein, 186 aa, Artificial Sequence; identical to SEQ ID NO: 22503
  Synthetic sequence.

SEQ ID NO: 22505 - protein, 178 aa, Artificial Sequence
  Synthetic sequence.
DEREEIEKTIRELMRENDDLVRKIRREIEESLRENRRTLEKIKKEIEELTRKAKRDVRPDEELDRDAKKIREEMERRERRYEEEAKKIRDRDREKKERSEEEKRETEEREEDLKRKNADEETLRKRLEEVKRKSDEHKKELEERLREVRRRSERVNEELKKTLEEVRKKIRELIERDR

SEQ ID NO: 22506 - protein, 178 aa, Artificial Sequence; identical to SEQ ID NO: 22505
  Synthetic sequence.

SEQ ID NO: 22507 - protein, 174 aa, Artificial Sequence
  Synthetic sequence.
SEEEVARRVEERVEELDRRLREIVKDLRDHNRRMKEKLEEAVERVRRRDKELDDILRETSLDERVEKEHRDRHKKEDDETRKDDEDNKEKEDRVKKEEDDLRKETEEERKRLEEDRSTSEELRKKLEDLRRKIDEKVKKVTKEHRDSAKKIRDDVRRVKEENKKANRELAEKRR

SEQ ID NO: 22508 - protein, 174 aa, Artificial Sequence; identical to SEQ ID NO: 22507
  Synthetic sequence.

SEQ ID NO: 22509 - protein, 173 aa, Artificial Sequence
  Synthetic sequence.
SREEEVEEEYERLLEEIRRRVKEVEKEYRDLLKKIEDDVREVRKEYEKLVEDLSRKAGRVEDEERKLEKNRRDNDKKEEDKRRRHERNADDFRRRADEMEKRHKRNRDEERKRNVEDEDASRRLRDIARRSREELEEEVKRLRTEIEKSERELRETTKENRKIIEDVRRRLEK

SEQ ID NO: 22510 - protein, 173 aa, Artificial Sequence; identical to SEQ ID NO: 22509
  Synthetic sequence.

SEQ ID NO: 22511 - protein, 173 aa, Artificial Sequence
  Synthetic sequence.
SEKEEVEREYRELLKEIEKRIDEVIKEYRDLLRDIRREVKRVLREYAELVKELKKTTGPVREEKKKLEDNDRKNKEEAKRLEDEHKENDERNKRRKDTLKKEHDENEKRERDEDRERDEAARELRKKAEDSKRELEKLEEENRRIIKRSRERLKKIEEDNRRIIKEVLDRARK

SEQ ID NO: 22512 - protein, 173 aa, Artificial Sequence; identical to SEQ ID NO: 22511
  Synthetic sequence.

SEQ ID NO: 22513 - protein, 174 aa, Artificial Sequence
  Synthetic sequence.
SKEELVKKARDELRRVLEELKRAVDELRKRDEDYERKSEDVVRRLRKIDKDVREVLRRGELDERTLEEIERRLREIHRRVREDSKRTEDELKERHDALRDRMKKLKEKLREERERLDLDEEVEEEIRREAKRIDDELEKVEEENKRTLDRAKKHNEEVEKENRDTLREIDKERE

SEQ ID NO: 22514 - protein, 174 aa, Artificial Sequence; identical to SEQ ID NO: 22513
  Synthetic sequence.

SEQ ID NO: 22515 - protein, 180 aa, Artificial Sequence
  Synthetic sequence.
SIEEEAKEIIDKVRKEVEDIVRRLKETNDEVRERLERILRRLEEVDEEAKRRVEELRERKRTLEKKTVKDIEDKLERDSERVKRETREETKELEDRSRDLTRRTREELERIRRELEDRDRRLRIDDRLREELEKLARDVERRTRELEKHHRELMKRAKEETERLERHHDELAKRVREKLK

SEQ ID NO: 22516 - protein, 180 aa, Artificial Sequence; identical to SEQ ID NO: 22515
  Synthetic sequence.

SEQ ID NO: 22517 - protein, 182 aa, Artificial Sequence
  Synthetic sequence.
DEIETVLDEVRRLHEDAKRRLEEMIDEVRKLNEESVRELARVVEEVERLLRTVKEEVERAGLDKGKLEELEERLERVREDVERILREIKRRNEKTLEDSERILEENKERNRTVLKKLKELRDRGSDAREALKESRKVVEESRESVRRVLEKNRRVVEESKRLAEELLRRVKKVVDEIRKRVE

SEQ ID NO: 22518 - protein, 182 aa, Artificial Sequence; identical to SEQ ID NO: 22517
  Synthetic sequence.

SEQ ID NO: 22519 - protein, 182 aa, Artificial Sequence
  Synthetic sequence.
DELEEVVRRVRELSRTVKEELREVIERVRELSERVKKKLRKVLREVAELHREVMKRVRDSGLDKSKLEKLEDESRRVLDKSREILRKNEEDNRRLNKELEEILKKNEDDNEDVRRKVDEVTRKGKDAEEVLREVEKVVEDSRRSAKDALKRVEDRVRESDKSVRELLEENRKVVEDIKRRVD

SEQ ID NO: 22520 - protein, 182 aa, Artificial Sequence; identical to SEQ ID NO: 22519
  Synthetic sequence.

SEQ ID NO: 22521 - protein, 174 aa, Artificial Sequence
  Synthetic sequence.
EELERILDKVRKVIEEVRKRLRDDLRTVEKVLKETEEVLRRAAERAKRALERVEEAARRGRDRREIKEELKKVLDDLRELLRALEEKNRRVNKENEDSLRKIEEDLRDVLRKLEEEIKGREVLRKVRELLRTIREEVERVLRKSNELSTRIKKRIDDVLETLERLLKELDDKLR

SEQ ID NO: 22522 - protein, 174 aa, Artificial Sequence; identical to SEQ ID NO: 22521
  Synthetic sequence.

SEQ ID NO: 22523 - protein, 174 aa, Artificial Sequence
  Synthetic sequence.
KDVEDVEREVDEVVKRSDDTVEENLRRAEDVVRDTDRIVKEMKERIDRVVERVEEVVRRGRDKREIEDELRRVLEELKRLADEVEKKNRDVNRRSEKLLRDDEKELRDVERELRKKIRGEEVLRKVTRLLREAKRRTEESHKKVNDLSRRVKERVDEVLERVKRLLEEVKRKVK

SEQ ID NO: 22524 - protein, 174 aa, Artificial Sequence; identical to SEQ ID NO: 22523
  Synthetic sequence.

SEQ ID NO: 22525 - protein, 176 aa, Artificial Sequence
  Synthetic sequence.
DEAEKVLKESKDTVDKIRRDVERLVDESRKTVDRIRELVDKAVKDSKDSVDRLRDVMRRNTNDKKELEKISRDDRKRLDEVRKRLKDLLREDNERLKKVLKEMRELLKRDNERLKRANVDEEVLRRIEKVNRDVARRVEEVFREAKEVNKKVDREVEDVIRKVKRVNEKVDEELKK

SEQ ID NO: 22526 - protein, 176 aa, Artificial Sequence; identical to SEQ ID NO: 22525
  Synthetic sequence.

SEQ ID NO: 22527 - protein, 176 aa, Artificial Sequence
  Synthetic sequence.
SEAEEVVRRSRETVTRNVRMLEKVVRDSEETVKKIVRDVERLLEESKKSVDDLRRLKEENRVDDRELKRISEKDEEDLRRALKDLEEKLKRDNERLEKVLEDSKRTLDEDNKRLDEANADEKVLREVKEVNERVRETSRDIADRVREVNEDVKRKVKKVIDDIRRVNEKVKRELEK

SEQ ID NO: 22528 - protein, 176 aa, Artificial Sequence; identical to SEQ ID NO: 22527
  Synthetic sequence.

SEQ ID NO: 22529 - protein, 182 aa, Artificial Sequence
  Synthetic sequence.
DEAREVVKRVKDLVRRLRRLSEKSLEDDKRLIEEVNKRSKDILDKVKKLVDDLRDMVRRTRDKDTLRKLVKEVKDRADDLLRRLEEIDKRIRDRSEENLRRNKEISEDVKRRAKELLDDARRRKLEEEVIKEIERVVRKVLEESREVHERIRETVKEVNDRNRKVLREIREVVKKVFEDARR

SEQ ID NO: 22530 - protein, 182 aa, Artificial Sequence; identical to SEQ ID NO: 22529
  Synthetic sequence.

SEQ ID NO: 22531 - protein, 179 aa, Artificial Sequence
  Synthetic sequence.
SDAEEVVRENRELVERIVREVEKILRDNEELVKRLVELVETSLRRNEKMVDELKKLVDRNKDKERLLEDAKRRSEKNERELEEILERLKRESDKSLKRIKEVLDELRKESKRLDDELRARRVDSRVIKEIRDTSKDAVRKVEEVLRRIEETVRDAERKVKEVIKRIRETSKEVLDRVRK

SEQ ID NO: 22532 - protein, 179 aa, Artificial Sequence; identical to SEQ ID NO: 22531
  Synthetic sequence.

SEQ ID NO: 22533 - protein, 179 aa, Artificial Sequence
  Synthetic sequence.
DAAERALRRSEEVVRESVEEVKTWVDENRRSVERLREELRKDEERVRRVVERIRKLVEDGEDKRELRKDLTRVLEESKESVRRIKEDLKRDTDKTEKLLDENRRKNEKSRRELEEIVRKGLVSEEVLKRVRKTNDDSDKEVKRLIDEARKLNDDVRKEVEEVLERTTRILDRVRKEVEK

SEQ ID NO: 22534 - protein, 179 aa, Artificial Sequence; identical to SEQ ID NO: 22533
  Synthetic sequence.

SEQ ID NO: 22535 - protein, 178 aa, Artificial Sequence
  Synthetic sequence.
DEAREVERRVREMVKELKRRLEEDVKESDKSVKDLERIAKEDVDRSRESVKELRDRVRRRRDEDVRRELREKLKKDNDESRKSKKELDDISREDEKRSRDSLRDLERLLRELERELREAKVEEEAVRRVKRIIEEVRKVLEDVFRESERLNREVREKLKRMFETSKELNKRVEEALRE

SEQ ID NO: 22536 - protein, 178 aa, Artificial Sequence; identical to SEQ ID NO: 22535
  Synthetic sequence.

SEQ ID NO: 22537 - protein, 179 aa, Artificial Sequence
  Synthetic sequence.
DSRRELEDDVRRIVETNRRLLEELERRVKKILEENRRLVEELRKENERIVRELTDRVRRDGKDDDLRRKLKEILDEIRKRNEDVLRESRKSLKDLARLIEEVRERSRESLEEIKKRLREANVEEDVVRTVEKLIRDLEEESRRVLEEVRRLLDEVRKESEEVHKRVNEIVKRVEDEIRR

SEQ ID NO: 22538 - protein, 179 aa, Artificial Sequence; identical to SEQ ID NO: 22537
  Synthetic sequence.

SEQ ID NO: 22539 - protein, 178 aa, Artificial Sequence
  Synthetic sequence.
SSKDEIRRRVEEVVERSDEIVKRSREHVKTVVDELDRVVKELERKVREVVKKLDKIRKDGGSEETLKRVLDELREILKELKEEVKKVKRKLEKVVKENRDTIREVEERNRKILDELRKRGVEERALREVEEISRKSEEKLRRVLKESEDIAKEAEDRLKTVLERVERIADEVLKRLTK

SEQ ID NO: 22540 - protein, 178 aa, Artificial Sequence; identical to SEQ ID NO: 22539
  Synthetic sequence.

SEQ ID NO: 22541 - protein, 178 aa, Artificial Sequence
  Synthetic sequence.
SKVKEVEDRVREVVKESERVARESLEHVRRVVRKTEDVVRRLKEKVRKAVEDLKEIKRRGGSEETLEEVERRLKKILDELRKEVDDVEKDNERALRDNRRKIEKVERENRDELEKLKKSGIGEEVLKKVEEISERSRRELRRALKESDKISEESLRRLRKVLREVEEIVRRVLEELRR

SEQ ID NO: 22542 - protein, 178 aa, Artificial Sequence; identical to SEQ ID NO: 22541
  Synthetic sequence.

SEQ ID NO: 22543 - protein, 178 aa, Artificial Sequence
  Synthetic sequence.
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRDSGVDEEVLRRVEETSDRSEKELRTVLRDVTEDIKRIAEELKKALEDSTEIIRRAEDELRT

SEQ ID NO: 22544 - protein, 178 aa, Artificial Sequence; identical to SEQ ID NO: 22543
  Synthetic sequence.

SEQ ID NO: 22545 - protein, 176 aa, Artificial Sequence
  Synthetic sequence.
DSDRKIDDEVRKVVETSERSLRENIKRIEKVVRKLEEEVRKDLEEVRRVVKELREIVKRNKEKKEDLERLIREVKKKSEKSLEDLRREIKKVEDESRKNLEENKRLLEKVKERLDRANVDEEALRKVEEDLRRLDRRVEEVVTRSKEILDEARKSVEEVVRRSDEILRRVEEDLRR

SEQ ID NO: 22546 - protein, 176 aa, Artificial Sequence; identical to SEQ ID NO: 22545
  Synthetic sequence.

SEQ ID NO: 22547 - protein, 177 aa, Artificial Sequence
  Synthetic sequence.
DEVEDILRKVEEIVKKSITDARRLLKEAREIVEESIKTAEELLRRNEDIVRKLSEDVKRTTDEEKKKKLEEESRRVLEKTKRDLDRTKDDNRKALEKIRKRVKETEEENREVVDRVRKAGVDKRVLEKIKKVVDDSVRVNREVLKRVEEVLEESKRVNEKVEEDVRRVHEEVRKEIK

SEQ ID NO: 22548 - protein, 177 aa, Artificial Sequence; identical to SEQ ID NO: 22547
  Synthetic sequence.

SEQ ID NO: 22549 - protein, 177 aa, Artificial Sequence
  Synthetic sequence.
DRVEKLLEDAKKIVEDSKRTAEKLLRENEKIVEKIKREADKILEDNKKIVDELAEAVKRTTDKDKKEELKRRSEKVNKESEDLVRRLRKESEEVLERTERVVRETEKRNDEMRKRIEEGGVDRRVLEEVKRVIDESRRVNKRVEEEIRKVHRDVERRLEEVLKRVRDTSEDVRRKIK

SEQ ID NO: 22550 - protein, 177 aa, Artificial Sequence; identical to SEQ ID NO: 22549
  Synthetic sequence.

SEQ ID NO: 22551 - protein, 177 aa, Artificial Sequence
  Synthetic sequence.
SEAEKLLRDVEREVERVIEDADKLLREIEEIVKRSEDKAREILKENEKIVRELKEAVRRTTDERKKEELKRRSEKVNRKSRKLVEDTKKENEDVLREIEKRLRDLDRRLKEVEDRIRKAGVDEEVLRRIKKVVDDVRERLREVEKRIRDVIDRSRRVNERVLREAERTSREVERAID

SEQ ID NO: 22552 - protein, 177 aa, Artificial Sequence; identical to SEQ ID NO: 22551
  Synthetic sequence.

SEQ ID NO: 22553 - protein, 175 aa, Artificial Sequence
  Synthetic sequence.
DEAEDVLRKVRERVKESERHVEKVLEDVRRVVKKSIDHARDVLRKVKEVIDRVRELVERNERDKKELEEDLKRLRERVEEMIRTNEKENRDLERDVERAIEENRRRNDKVEDDVRKSNIDERVEREIRRVLKRSKERLEEVVKEIRELSEKSRRVLEEVKKRIREVLERVRKDVE

SEQ ID NO: 22554 - protein, 175 aa, Artificial Sequence; identical to SEQ ID NO: 22553
  Synthetic sequence.

SEQ ID NO: 22555 - protein, 175 aa, Artificial Sequence
  Synthetic sequence.
REAEEVLKEVRKAVEDSIRHVEEVLEEVKKVVEESIRHIRDSLRDVRRVIEEVDRLVKRNERDKKELKERLERALRKDERVVEENEDTNRRLIEKVEKAIRENEKRNDDVKRKVDELNVDKRVKEEIDRVLDESKRVLEEVVTRIRKVSDDSEKEVRRVHKESKRVVEEVERTVD

SEQ ID NO: 22556 - protein, 175 aa, Artificial Sequence; identical to SEQ ID NO: 22555
  Synthetic sequence.

SEQ ID NO: 22557 - protein, 175 aa, Artificial Sequence
  Synthetic sequence.
DEAEDVLRRVREMVERSIEHVRRVLKEVEDVVRESIKHVEDVVREVREVIREVEELVDRNEVDKKELRKRLKELEDKVEKRTRENEERNKELNKKVKDADDENRKRNEKVRRDVRRSNIDKRVEEEIDKLLRESKRELDEVRKRIEDLSRESERRLREAVEEIRRLVKKVAEKVN

SEQ ID NO: 22558 - protein, 175 aa, Artificial Sequence; identical to SEQ ID NO: 22557
  Synthetic sequence.

SEQ ID NO: 22559 - protein, 175 aa, Artificial Sequence
  Synthetic sequence.
KEAEDVLDEVRKAVEESIKHVKRVLEEVEEIVRRSIKHARDSLRKVKEVIDKVRTLVRRNEVDKKELEEELKRLEDEDRKMVKDNRDDNREANRKVDKMVKENEDRNRRVEEKVRELNIDERVRREIKRLLDESREVLKEVTKRIRKVSRDSERVVEKVHRDSKDVLDKVREDVR

SEQ ID NO: 22560 - protein, 175 aa, Artificial Sequence; identical to SEQ ID NO: 22559
  Synthetic sequence.

SEQ ID NO: 22561 - protein, 178 aa, Artificial Sequence
  Synthetic sequence.
SSLEKAEDEVRELLRDVERVLKEVRDRIEELNRKVNEVLRRVIEESERLLREVLERVRGRREVTELLKEVKKRNDKVRKDIRKESEEDKKKVEETVAEIKKELDDLRRDVRRVAEENGPSEKVRRLVDKVRETVTDIVRRVTRLLEESEESVRRLIEKVKKLNEESRRIVEKIEKDAR

SEQ ID NO: 22562 - protein, 178 aa, Artificial Sequence; identical to SEQ ID NO: 22561
  Synthetic sequence.

SEQ ID NO: 22563 - protein, 178 aa, Artificial Sequence
  Synthetic sequence.
SELERVEEDVKRVNKEVNDTLEKVIRDSKRVLDEVEERTRKVKRDSERLLERVERAVEGLKELKELLDRLREENREVVKDSERLLREWERENREVKKRIEDESEEDKRRLEEVARRNGPEEVVERVLEESRRSVETLIRDVERVNKKSREAVERNIRRSTAANERSKKIVKEIIDTAK

SEQ ID NO: 22564 - protein, 178 aa, Artificial Sequence; identical to SEQ ID NO: 22563
  Synthetic sequence.

SEQ ID NO: 22565 - protein, 174 aa, Artificial Sequence
  Synthetic sequence.
DEAEDVVRRVREEVERLIRRSREVAEESKRTVDKLRRELEELLRRSRETVERIKKLIDEGVDRREIEKLNRDNEEEVRRMEEKARRINTENRDRVRKVHEESKRELERIKEEVRRVDIDDKVREDIERVLREVEEVDKEVKERVRKVDEDSKKEIKEVKDEIRRVDEESRERAE

SEQ ID NO: 22566 - protein, 174 aa, Artificial Sequence; identical to SEQ ID NO: 22565
  Synthetic sequence.

SEQ ID NO: 22567 - protein, 177 aa, Artificial Sequence
  Synthetic sequence.
DEAEKVLEKARDLVRRNIERSRRVLEENKKSVDDLIRRNEETNRRNEKSVDEVKKLVDNGGSEEAVRTVAERDEKSLEENREENERILKRDEDTLEKAKRESDKSLAELKKLLDDAKRKGVDDDVLREVKRVLDEARRVSEEVEKESRRVLEEAKRVAEEVHKRSKKVVDDVKERAR

SEQ ID NO: 22568 - protein, 177 aa, Artificial Sequence; identical to SEQ ID NO: 22567
  Synthetic sequence.

SEQ ID NO: 22569 - protein, 180 aa, Artificial Sequence
  Synthetic sequence.
SELEDVKRRIDKVVREVEEVVREVSERSKKVLEEVRRSAERVNREIERVLREAKDEVRRRTRDDKIRKKVEEVERRVRKLIEDNRRINEEVERRVERLNEELRRLVEKVRKELEELKKDIKDKDAKRVLEEARKIVDRLRKIVEEVVRRSEELIRRLKKINEDSLRRVEELVKDLIREVS

SEQ ID NO: 22570 - protein, 180 aa, Artificial Sequence; identical to SEQ ID NO: 22569
  Synthetic sequence.

SEQ ID NO: 22571 - protein, 181 aa, Artificial Sequence
  Synthetic sequence.
KEAEEVVERVRELIERLRRRVTEMLRESKRLVEENIKRSEDALKESERLVDKLRELVKRTRDKETLKKLLEEIEREIKKINKRTEDILRESARRVEEINKRTKDILEEIARRITRIREEARRRNVDDKVLRTIEKLLDDVKKEVEKVNEDSKRLLRDVERVSKEVNDESRRVLEEVKREAK

SEQ ID NO: 22572 - protein, 181 aa, Artificial Sequence; identical to SEQ ID NO: 22571
  Synthetic sequence.

SEQ ID NO: 22573 - protein, 181 aa, Artificial Sequence
  Synthetic sequence.
SELEKIVEKIKRIIDESRRTVEESVRKSEKIVEEVKKRLEELVEEVRKIVEEIVRIIRNGDRREEVEEKARRTAEELRRRLEELRKRLEDLVRKDLRENEENLKRTEDLVREVKDELEKLPRNEELEKVKRMVDKVVDDVRKVNDTSRKRSKETLEEARRKVEEVKRRIDKVLRDVKREID

SEQ ID NO: 22574 - protein, 181 aa, Artificial Sequence; identical to SEQ ID NO: 22573
  Synthetic sequence.

SEQ ID NO: 22575 - protein, 177 aa, Artificial Sequence
  Synthetic sequence.
DEVEEVVKRVKEVVEKIVRELEKLVEESKKIVEDAVREDERLVEKIERVVRRLVEEVRRSTDEKKLEDLEKELEDVRKDIERVLEDNKRKLEEAHEKSKDKARRLREELERALREVEETGVSEEVKKLVDEVVKEVEEVIKRVEDLDRRVLEENRESTRDVERRVREVVKRVREALK

SEQ ID NO: 22576 - protein, 177 aa, Artificial Sequence; identical to SEQ ID NO: 22575
  Synthetic sequence.

SEQ ID NO: 22577 - protein, 176 aa, Artificial Sequence
  Synthetic sequence.
SDAERVVREVERLVDTTRKLVKKVVEDIRRVVETAKRDLDRVVKRSEDVVREVKKLIEEGVREEEIKKILDEIRKETKDVERKIKKILDDIRKKVEKVTEEIKDVNRKTKEIVDRAKDRIDDRVIKLVRKLNKDSERKLREVRDRVERVIEEVEKRLREVKERSKETIEDVERARK

SEQ ID NO: 22578 - protein, 176 aa, Artificial Sequence; identical to SEQ ID NO: 22577
  Synthetic sequence.

SEQ ID NO: 22579 - protein, 177 aa, Artificial Sequence
  Synthetic sequence.
DEAEKVVEEAKRRVKEVVERLREVADRNRRSIEELVKELRAVVEDSRKSVEDLVRRVRNGGSKETVEEIDRRNEDKLRELEKRVRKIIEENKRSLEKLKRDIERIERRLEELLERVDRNNVSEEVKKLVEDVIEEVRKVVKEVEDISRRVIEDLKRVLEEVEKRSRKLIKEARDETR

SEQ ID NO: 22580 - protein, 177 aa, Artificial Sequence; identical to SEQ ID NO: 22579
  Synthetic sequence.

SEQ ID NO: 22581 - protein, 181 aa, Artificial Sequence
  Synthetic sequence.
DELREVVKRVRRLIEEVRRLVKELVDRVRKVIEELKRRSEDSARESERVVREIKKLVEERKDKEELLKEAEKKVEKIHRDNKKLLRELEEKIERIREELDRVLRDLERRLRELKEELKRGPKNEELEDVDRDIERVREEVKRVVDEVRKRIRDVLEDARRESKRVLDRSRESLREVREAVR

SEQ ID NO: 22582 - protein, 181 aa, Artificial Sequence; identical to SEQ ID NO: 22581
  Synthetic sequence.

SEQ ID NO: 22583 - protein, 181 aa, Artificial Sequence
  Synthetic sequence.
DELEELVKRVEDVIREIEERVRRLVRESERVVKEILKKSRKSVEKVKEVVDRAVDLVRKRKDDKRALEELRRVAEEIKEENERLLRDAEEKVKKLDRELEKLLEDLRREIRRLLEELRRGPDDERLKDVEREIRRVLRRAEKVVDEALKRSRDTLREVRKVSKEVREDIERVVKEADEAAR

SEQ ID NO: 22584 - protein, 181 aa, Artificial Sequence; identical to SEQ ID NO: 22583
  Synthetic sequence.

SEQ ID NO: 22585 - protein, 177 aa, Artificial Sequence
  Synthetic sequence.
SVVDRVREELEKVLRHSKKVVEDVKREIDKVLKRSEDALRRVEEESKRVLEEVERDGISEELEERLRRIHRESRERLKRLKEENERIAEELRKRLEDLTRENEKIIRDLDRELKKTRDKDTLKKLVEEARKVSEDSRRRLERIVEEMRRVSEDSRRRLEEIVRENRKVVEEVRRRAT

SEQ ID NO: 22586 - protein, 177 aa, Artificial Sequence; identical to SEQ ID NO: 22585
  Synthetic sequence.

SEQ ID NO: 22587 - protein, 177 aa, Artificial Sequence
  Synthetic sequence.
SVVERVREEIKRVLENSKRAVDKVREDIKRVLDESRKAIKEVEDEIRKVLEEVERGGIDEELRKELKRIVDELRAELKKLLDENEEAVKELEERLKKLTRDNEEIVERLERRLKKTTDSDTVRRIVEEIEKVSRESVKRLEDIVREMKKISEESKETVDRIVEKIREVVKRLLEAAK

SEQ ID NO: 22588 - protein, 177 aa, Artificial Sequence; identical to SEQ ID NO: 22587
  Synthetic sequence.

SEQ ID NO: 22589 - protein, 177 aa, Artificial Sequence
  Synthetic sequence.
SAVETVRKTIEDVLRNSERVLKKVREDSKKVLENSERVLKEVEDRSKEVLKEVEDGGIDERLREELEDIHRRSKKRLDELREENKRIHDRTEEELKRLLRENEKIVEDLARRLDKTTDKKELDEIAEEIKRVSEDSVRKARELAERNKKVSDESVKRVKKIVRENEKVVEELLKAKK

SEQ ID NO: 22590 - protein, 177 aa, Artificial Sequence; identical to SEQ ID NO: 22589
  Synthetic sequence.

SEQ ID NO: 22591 - protein, 177 aa, Artificial Sequence
  Synthetic sequence.
SEVDEIVRRIKEISKRSVDDLEKLARDNKKAVEEVLEELRKLLEENEKMVREVLEEVRRSTDEDRLAKLRKRVEDVNRRTRRVLDEIRKKVEEVHDRTRRRLEELKRRNDEVLRKIASKPIDERLDRMLKEVIKHSEKVVRDVEETSKTVLKEIEDALKKVEEASKRVVDRLEEATR

SEQ ID NO: 22592 - protein, 177 aa, Artificial Sequence; identical to SEQ ID NO: 22591
  Synthetic sequence.

SEQ ID NO: 22593 - protein, 177 aa, Artificial Sequence
  Synthetic sequence.
RRVDEIAKKIKRISEESVKTLDKIMEDARKIVKDVLDELRKLAEDNKRVVREVLERVRRSTDEDTLKKLDDKLRDVHRRTKEVLDKLTDEVRDVKRRIDELLEKLKEENERVLREIESEDIDERLRRTVERVIRHSREAVKRVKDEVEKVVKELEDVVRKVKEDSERVVKEVEEAKR

SEQ ID NO: 22594 - protein, 177 aa, Artificial Sequence; identical to SEQ ID NO: 22593
  Synthetic sequence.

SEQ ID NO: 22595 - protein, 181 aa, Artificial Sequence
  Synthetic sequence.
SEAEDVVRRSKRSVERLKKELDDVVRESKESVERLVRRNDEVVKRSRESVDELTEAVKRGLRREDIERILRENRRLLEEAHKENKKILEENKKLLDDLRRRVREILERNKRLLEELKRRLKDKDLVERVERTVRTTLKELEDALREVKRMVEDTLKKAEDVNRRVAEEVKKSEKRLRDVAK

SEQ ID NO: 22596 - protein, 181 aa, Artificial Sequence; identical to SEQ ID NO: 22595
  Synthetic sequence.

SEQ ID NO: 22597 - protein, 181 aa, Artificial Sequence
  Synthetic sequence.
DEVDDVVRKSEKSVEELVRKLETVVKRSEESVRELLEKNREVVERNERSVRELLERLEKGLSEKEVEDILREDEESLKKLHEDNKRILKENRDLLRRLEEEVRRINRENERLLDDLRKKLTDKDLLKRVEDTARRVNREIEEALDRVRKAVEKTLKKLKDVNDEVRKESEKVLKELRDATK

SEQ ID NO: 22598 - protein, 181 aa, Artificial Sequence; identical to SEQ ID NO: 22597
  Synthetic sequence.

SEQ ID NO: 22599 - protein, 177 aa, Artificial Sequence
  Synthetic sequence.
SDEDRVREMVRTVIEKLDRVLEEVERDSAKTDRDNKKSAEDVRRESKRTDDELKDVVRKAGRELEKIRDVVDKNRRLVEKLDKENRKTLEENRRLLEELKKLADEVKEELERLRKEIKDKDVDEVVERAKKLVKRLEDRLREVVKESRRLVRRVVERNREVAERSKDLVRRLVEDTR

SEQ ID NO: 22600 - protein, 177 aa, Artificial Sequence; identical to SEQ ID NO: 22599
  Synthetic sequence.

SEQ ID NO: 22601 - protein, 177 aa, Artificial Sequence
  Synthetic sequence.
SKEEEVERRVEEVIKELEEVLRRVEEEIKRVIDDNRRSARDVEEKSKRTDEELKDVVRKAGRRLEEIERIEEENKKLVDELRKSNEKTEEELKKLLEELREMVREVKERLKDLLDKIKDRDVDEVARRVKEMVERLRKLAEEVVREAERVVREVVDENRKVVEESKRLVKELLERVK

SEQ ID NO: 22602 - protein, 177 aa, Artificial Sequence; identical to SEQ ID NO: 22601
  Synthetic sequence.

SEQ ID NO: 22603 - protein, 177 aa, Artificial Sequence
  Synthetic sequence.
SDEERVDEEIKTVIEELKRSLKEVEDTIRKVIKENKDSAKRVKETSEKTDREIEDVVRKAGRELEDIKKVKRDNKELVKRLDERNRETEKELRELLDRLRKENKESEDRLRKLRDEIKDKDVDTVAKEVRDLVRENVERNKEVVKRAKKVVDDVVRENRKVAEDSKKLVKEVKDRVR

SEQ ID NO: 22604 - protein, 177 aa, Artificial Sequence; identical to SEQ ID NO: 22603
  Synthetic sequence.

SEQ ID NO: 22605 - protein, 177 aa, Artificial Sequence
  Synthetic sequence.
DDEERVKELIKEVIRELEESLRRVKEDSKRTDEKNKKSMEDVERKIERVRRRLDEVVKEAGRDLEDIKRIDKELEELLRKLREENERTRETNEELVRKLDEENRKSKKELEKLLREVKDKDVDEVAKRATDIVKRNAELNKEVVDESRRLVEEVVDRNEKVAKRAEEIVDELERRTR

SEQ ID NO: 22606 - protein, 177 aa, Artificial Sequence; identical to SEQ ID NO: 22605
  Synthetic sequence.

SEQ ID NO: 22607 - protein, 185 aa, Artificial Sequence
  Synthetic sequence.
DEFKEVVDRVKRLVTENVRENRRVVEESERLVKEALKRLEDLVRRAKEIVDRLDDLVRKIRDEDTLREVVDRIEKILRELEEEAKRVARRIKEESKRLNDEVKEINDRSRRKLTELLKRLDESRVPKDLLKRVRDSIETVKKELDDSMKKVSDDDERSKKELEDVLEEVRKRIEKVMKELRDTSR

SEQ ID NO: 22608 - protein, 185 aa, Artificial Sequence; identical to SEQ ID NO: 22607
  Synthetic sequence.

SEQ ID NO: 22609 - protein, 185 aa, Artificial Sequence
  Synthetic sequence.
DEVREIVREVKRLVEENVRRNDDVARKSRKLVKENKDRNKEVVDRLRELVKRALDEVRRIKEEEELRRVVKEIRDELRRLRKKLKDINDDSERKSRELNKLVKDINKKSEEELEKLRDRVRRLRVPEKLLKEVEDMIRTVKKELKDSARRVSEEDKRSKEDLKRSAKEVEETIKDVLRKLDTETT

SEQ ID NO: 22610 - protein, 185 aa, Artificial Sequence; identical to SEQ ID NO: 22609
  Synthetic sequence.

SEQ ID NO: 22611 - protein, 185 aa, Artificial Sequence
  Synthetic sequence.
DEAEEVVRRVERLVKENVKLNKEIVKRSRDLVKELEERLREIVKRVEEIVKRAKDLVEEIKDKDTLKEVVDRIRRELERLLEEVERIARKIIEESKELNKRMREINKKSKEDLKRLLDELDKSRVPKDLLKRVREVIERVDRELDKSMKEVHDENEKSVRRLREVLERVKKRIKDVTKELEDRTR

SEQ ID NO: 22612 - protein, 185 aa, Artificial Sequence; identical to SEQ ID NO: 22611
  Synthetic sequence.

SEQ ID NO: 22613 - protein, 185 aa, Artificial Sequence
  Synthetic sequence.
SLVEEVVRRVEDLVRKNVRLNEEIVRRSEDLVRRNVELNEELVRRAEDLVRRIEELVKKIKDRRELERVLREIRRTLRELKRELEEINKRSKDESRRLNDEVRRINEKSEEELKRLLDELRKRPVDEELLRKVEKMIERVVRELKKSAKRVHDENRRSDEDAERSMERVERVIERVERDIDRRLR

SEQ ID NO: 22614 - protein, 185 aa, Artificial Sequence; identical to SEQ ID NO: 22613
  Synthetic sequence.

SEQ ID NO: 22615 - protein, 185 aa, Artificial Sequence
  Synthetic sequence.
DEAREVVTEVKRLVRENEERNKEVVKRSKKLVEDLKDLARKLVDRAKKLVDTLRDLVRKIRDKDTLKEVVERIRRELDKLRKELEEILKRVHEEDKRLRDEVDEINKRSEDELRKLEDELRKSRVEERLLEDVERKIETVIRELRKSMEEVKESSRRSNEELKKVADDVERTIRKVERELEKEST

SEQ ID NO: 22616 - protein, 185 aa, Artificial Sequence; identical to SEQ ID NO: 22615
  Synthetic sequence.

SEQ ID NO: 22617 - protein, 175 aa, Artificial Sequence
  Synthetic sequence.
SDAERVVDDLERRVRENLEDLRRAVREVREVVKKNLETITRVLEEVERVVDRLSKLVKEGTDRKDLEKELRDLEEKIKRISEESRRHLDELRRKVEEINKRSRDHLRDLARRLKEEIGRVREVDKVLKDVARKVEEANEKSRRVLEEVEELVERVNRELHETLKRVAERVKRDAT

SEQ ID NO: 22618 - protein, 175 aa, Artificial Sequence; identical to SEQ ID NO: 22617
  Synthetic sequence.

SEQ ID NO: 22619 - protein, 177 aa, Artificial Sequence
  Synthetic sequence.
SDEERVTKVLEEVKERIERANRTLEKRVREVTDRVREVNERSDKVNRDSERKIREIIKRLTDKDLVRKLEKLLEEDRRRSEEALEESDRLVKEAKRRIDKALKESEDSLRDMEREVRERPKLEKLVRDLRKIVEENERKNRDLLRKIEKIVEEIERRNRDVVRRSKESVERLREEVR

SEQ ID NO: 22620 - protein, 177 aa, Artificial Sequence; identical to SEQ ID NO: 22619
  Synthetic sequence.

SEQ ID NO: 22621 - protein, 181 aa, Artificial Sequence
  Synthetic sequence.
DADRELRRVAKEVTDRSRRVLEDSERVVRESHEKSKRVLEDLRRVVKEVAERIDEVLKRVRGEDLERLERIKERIKEEVDRVDERSKRTVEENKRRVDEVRKESKKIVDDMRELLERAKDLTEEVARDVVRKLKRIVTENLKKNTKVVRDSEDLVRRDLEEVDRVVKKVKKDVDEIERDVK

SEQ ID NO: 22622 - protein, 181 aa, Artificial Sequence; identical to SEQ ID NO: 22621
  Synthetic sequence.

SEQ ID NO: 22623 - protein, 181 aa, Artificial Sequence
  Synthetic sequence.
DEVREVVKELKRIVDELLDELRKVVEELEKIVTDDLRRIEEAVKRSKDSVEDLERRLKSGGSEEMVKKIKDENKELLKKVREESKRSNDRSKEVLDRVKKRVEDIIERLRRELKRVTKDIEDKDLLRELEEVARRVEEKIKKAVRELEKVMREVNRKSTEVLKRLEKVVRDSEKRIDDATR

SEQ ID NO: 22624 - protein, 181 aa, Artificial Sequence; identical to SEQ ID NO: 22623
  Synthetic sequence.

SEQ ID NO: 22625 - protein, 181 aa, Artificial Sequence
  Synthetic sequence.
SDVDEVVKEVKAIADDSTRLNKESAEKSRELVDRDTKKNKRSVEELRRLVTEILKVVESGGPGKVVEEAKKRLDRLLERDEETNRDSERKDRELLRTDEELNRETDKRLKDLLDRVRRRISNDELLRKLEEVVEKVRRDDERSHRESERVSRESTKRSRDSHRESREVVTEVKKEVDRAAK

SEQ ID NO: 22626 - protein, 181 aa, Artificial Sequence; identical to SEQ ID NO: 22625
  Synthetic sequence.

SEQ ID NO: 22627 - protein, 185 aa, Artificial Sequence
  Synthetic sequence.
DEAEEVVDRARKLVKESEDLNRRSVEESEKLVTTSTELNKRTVDRLREIVEEVKDLVRKTRDEDTLRELVRRIEERLEKLLRDDREINKETNKESRRLNEEDKRINDESRKKLDELKKEIDKRGLPEDVLRKVKKTLEEVKRRDDEAMRRSHKKDDDSRKRDEESMRRSDEVVREVIEEVREAER

SEQ ID NO: 22628 - protein, 185 aa, Artificial Sequence; identical to SEQ ID NO: 22627
  Synthetic sequence.

SEQ ID NO: 22629 - protein, 187 aa, Artificial Sequence
  Synthetic sequence.
DEIEDVVRKVEEMVKESKDRVDRNVEESRRIVTESREKVKDSVRRVEEVVKEIKKLAEQGRSEEELKRILDEAEKTLRENRRRNKKVHEETRRRLEESDRHLKKVHEDTKRLLDALKEELKRLKEKIDDKVVKKVDDALKRVEKKDRDAIREVERVNREVEKDDERVLRDSERVLEEVRKRVEEVTT

SEQ ID NO: 22630 - protein, 187 aa, Artificial Sequence; identical to SEQ ID NO: 22629
  Synthetic sequence.

SEQ ID NO: 22631 - protein, 187 aa, Artificial Sequence
  Synthetic sequence.
SEIDEVVERVRKAVEDSRKVVEDLIKTVEDAVREHERLVRRVVEEVDKLVEDIRKLLERGESEEMLKRILEDAERRLKELKEELKRSNEDIERILRELKKELKKVHDRTRKILEELKRRLDELRKDIDERMLRKVDEVIKRVAREDERVVKKLEDVLRDVKRRVDEASKEVDRRLKEVKKRVEKEAE

SEQ ID NO: 22632 - protein, 187 aa, Artificial Sequence; identical to SEQ ID NO: 22631
  Synthetic sequence.

SEQ ID NO: 22633 - protein, 187 aa, Artificial Sequence
  Synthetic sequence.
KEAEEAAKRAEEAAKRHEDLAREAAKEAKRAADESRKAAEEAAKRAEKAARDIADLARKGLDEEALDRAAKRAKELLDELRKELEKVHRDTERLLDELRRRLERSDEEIEEILRRLKDELDKARERIDEKAARKAEDALRRAREIAKKASEDAKRALDEARKADEDAARKAEKALKEAEDAAREARR

SEQ ID NO: 22634 - protein, 187 aa, Artificial Sequence; identical to SEQ ID NO: 22633
  Synthetic sequence.

SEQ ID NO: 22635 - protein, 184 aa, Artificial Sequence
  Synthetic sequence.
DEEEELKEVVREVAERVEEVNRKSERELDKARKDSERALEKLERVLREVAERVKRVLDEASKRVPEELIKRIKEELEKMKREIEKILTDNRRKTEEMEKKIRKINEDSRDHLRKVEREVERVKDEGKDVKDVIRELEEVVRRNTDLVRKVEEEIRKVVEESKRSIEEVIKRLRKLVDDIRKAIK

SEQ ID NO: 22636 - protein, 184 aa, Artificial Sequence; identical to SEQ ID NO: 22635
  Synthetic sequence.

SEQ ID NO: 22637 - protein, 184 aa, Artificial Sequence
  Synthetic sequence.
DEREKLAEVVKRVAEDVKRMNKESREALKRVKEEVKRVNEKSEKVTREVKKEVERVIEEAKRTIPEELLKRIRDKLKKVEEDSRRTNEESKRHLKEAEDRIREINKRSEDHLREVIKKVEEVMTRGKDVEDVIRELEKVVEDNKRLVEKVVRDARKVVEDNKELVDRNVKRLEEVVREITKEIK

SEQ ID NO: 22638 - protein, 184 aa, Artificial Sequence; identical to SEQ ID NO: 22637
  Synthetic sequence.

SEQ ID NO: 22639 - protein, 186 aa, Artificial Sequence
  Synthetic sequence.
RDVDELVRELRDVVRKVLETARDSVRELKRIVTESLRRAEDLVKEITDVVREVLDAVRRARDKDTLKKLKDDAERVLERLERRIRELHERSRRVSEESEKLVRKLEEDAERVIRKVEDALRKRLKDNREVVKKLRDVIREVKEDVERVLKEVRDVNREVNKIDKEAVERIRRVLDEVRKRVDEAAR

SEQ ID NO: 22640 - protein, 186 aa, Artificial Sequence; identical to SEQ ID NO: 22639
  Synthetic sequence.

SEQ ID NO: 22641 - protein, 174 aa, Artificial Sequence
  Synthetic sequence.
KEIDDVVRELKEIAKRDEDKVRRVVEDLERVAREDLRKVREVVKELRRVVKTLLDLVRRGVDKRELKKILEELEKRVREVHDESRRTLEELDKKIKKVKEESERTLREAEKRARDIEKDKRLDDVLREVADIIRRSIRDLERVLEEVKRIIETSNDELRKVLKEVRETITEAER

SEQ ID NO: 22642 - protein, 174 aa, Artificial Sequence; identical to SEQ ID NO: 22641
  Synthetic sequence.

SEQ ID NO: 22643 - protein, 174 aa, Artificial Sequence
  Synthetic sequence.
SEIDEMVRKLKEMARRDLETVRRVVERLRKLAEDDLRRVRKVVKKLKELAKDIVRLVEEGSREEELEEILKRIEEEVRKVEEESKKSLREIREEVEKVKRESERTLEDIERKAEEIEESERLRKVLKEVKDIIRKSNKELDEVLRDVERIIRESIEELRRVLEEVKKIIKEARD

SEQ ID NO: 22644 - protein, 174 aa, Artificial Sequence; identical to SEQ ID NO: 22643
  Synthetic sequence.

SEQ ID NO: 22645 - protein, 181 aa, Artificial Sequence
  Synthetic sequence.
DEVDEAVRRLEEIVTRIEKDVDDVARRSEESAKEVEKAVRKVVEEHKKVAEDIRKLVEDGGDERELRKILEDLRKTSREVERALEEILRENDRLLTEVRRKLERILERLDELAEDVKRRVRGREVKERLKKVLDKVRKRIKRVVERLEEAARKSRKIIRDAKEELERVSREVEKVIRDVRR

SEQ ID NO: 22646 - protein, 181 aa, Artificial Sequence; identical to SEQ ID NO: 22645
  Synthetic sequence.

SEQ ID NO: 22647 - protein, 186 aa, Artificial Sequence
  Synthetic sequence.
EEVKELVERLRDLVRESEKRVDEVVKRLEDLVRRNEELNRELVTRLRDLVRKLEEKVKDTKDEETLRRLAEEVRKRLDELRREMEKINRDSERELDRLDREVERISETTERRLRELEKKAKDDIKDDKEMVREIKRVVDEVRKRDKEALDRLKKVIEEVRRKVKRSEDEARRVVEEVKRIVDRVET

SEQ ID NO: 22648 - protein, 186 aa, Artificial Sequence; identical to SEQ ID NO: 22647
  Synthetic sequence.

SEQ ID NO: 22649 - protein, 186 aa, Artificial Sequence
  Synthetic sequence.
REVDDLVRRLEELVRRNEKKNEDVVRESKELADRSRKLVKELVKRLRELVKTVVRLVEETKDEDTLRRLIEEVEKRLRDLKREIEEISKETKKRDEELLRKAEKINKDSKDRIEDLLREAKRRIKDDKELVRKLKKVVDEVRERIDRSTEEVRRVSKESKDIDKRAKEEIEEVLRDVEKKLRETAT

SEQ ID NO: 22650 - protein, 186 aa, Artificial Sequence; identical to SEQ ID NO: 22649
  Synthetic sequence.

SEQ ID NO: 22651 - protein, 186 aa, Artificial Sequence
  Synthetic sequence.
DEFRDVVRKLEKLVEDITREAEEVVKISKALAEENKRLNDELVDRLRRLVEEVRKKVEDTKDEETLDEELRRVKETLKRLLEEVERINKESREKDRKLKEEVRKRIEEVEERLRTLLEEVKKRLKDDKEVVKRVKDVVDRVRDEVRRVAEKVDRVSKESKRIIDESTKRAREVLERVRKRVEDERK

SEQ ID NO: 22652 - protein, 186 aa, Artificial Sequence; identical to SEQ ID NO: 22651
  Synthetic sequence.

SEQ ID NO: 22653 - protein, 186 aa, Artificial Sequence
  Synthetic sequence.
SEVDDIARKLRDLVRRNKELNDEVVRRSEKLVKENKELNEELVRRLKELVDRLEDEVRRTKDKDRLREIIREVRERLKRLLDTIKRINDESRKEDKRLLDEAERINRESRKKIDKLEKDAEKDIKDDKEMVKKLRKVVEEVRREIDDSMRKVKKVSEDSKRRIERSTEEIEEVAKRVADKVTDVER

SEQ ID NO: 22654 - protein, 186 aa, Artificial Sequence; identical to SEQ ID NO: 22653
  Synthetic sequence.

SEQ ID NO: 22655 - protein, 178 aa, Artificial Sequence
  Synthetic sequence.
RELEEVVRELRKLVTEDLDRVRKSVEESERVVREDERRVDESVKRTREIADEVRRLKEEGVDESRLRELLKRVEDMNRESLKRSEDSLKRLHERNRKSLKESRDSLEEAERRVEDVRRRGVDEEELKKVLKEVRKVVTDSERRDKEANRKVEEVIRRSKKKDEDAHREVRKVVEDVRT

SEQ ID NO: 22656 - protein, 178 aa, Artificial Sequence; identical to SEQ ID NO: 22655
  Synthetic sequence.

SEQ ID NO: 22657 - protein, 176 aa, Artificial Sequence
  Synthetic sequence.
SKDEKLEKVIREVKRVIERVSKESEDVLRKVRKVIEDVSRESRRVLEDSRRVLERVAREGKRDERIKEVEDRSRRTLERLEELNDTVRRLLEEVVRRLRELNKDVERRLRDLARKLKDLDVDEVVDRARRIVDDVDRLNREVVKRLKDLVEDLRRLNEEVVRRNKELADTVRKDVR

SEQ ID NO: 22658 - protein, 176 aa, Artificial Sequence; identical to SEQ ID NO: 22657
  Synthetic sequence.

SEQ ID NO: 22659 - protein, 176 aa, Artificial Sequence
  Synthetic sequence.
SEDEKLKEVVDEARKILEDADRELKRVVKEVEDVIRDVSKKSTEVRKEVKEILKEAADKGDEDERIREVEKTVEDLLRKLEEMNRRIEETLKKLAEEVHRRNREVEKEVEDLARRVKELDVDKVVDDLRKLAEDLLRENKEVVDKLRELVERVKKLNEDVVREARRLADEVLKRVT

SEQ ID NO: 22660 - protein, 176 aa, Artificial Sequence; identical to SEQ ID NO: 22659
  Synthetic sequence.

SEQ ID NO: 22661 - protein, 179 aa, Artificial Sequence
  Synthetic sequence.
SEVERLEERLKRIVEDIKRLVKKSVEDSRKIVEEIRKLVKDSVEKNKRSVEEVEDIVRKDKDVKERLEELVRRDEEVNKKTKEDIKELLDRVREINERTNEKIERLLRELKKEIDDVRRRGVDEERVKRVLREVEERVKEVKKENEKAHEEVRKDVERVLEDDDRALRESRERAERVKK

SEQ ID NO: 22662 - protein, 179 aa, Artificial Sequence; identical to SEQ ID NO: 22661
  Synthetic sequence.

SEQ ID NO: 22663 - protein, 179 aa, Artificial Sequence
  Synthetic sequence.
TEVDELLDSLRKIVTEIEKLVEESEKRLREIVKTIEKLVKDSVRTLKKIAREIEELAKDRKEVEDAIRKLLKEVEDIVRETNKTSEELARRIRKLVKEVNERTDKLRREVEREVEEVKKNGVNEERVEKVLREVRDRVKKVNKRNEDALREVDKKVKDVNKENEDVLEEARRVVEEVRR

SEQ ID NO: 22664 - protein, 179 aa, Artificial Sequence; identical to SEQ ID NO: 22663
  Synthetic sequence.

SEQ ID NO: 22665 - protein, 174 aa, Artificial Sequence
  Synthetic sequence.
REDEKIKKVVEEVRKKLEDVDKNSRDAIEDDKRVNKEVDRNSERAFKENEDEIRKVKEAGVDEKKLKESRDNSKRVLDRSKELLKRSEENTRRLAKESKELLKEVRDRLEDLRRRVKNADEVVKELERIVAEVEKLSREVVKRLKENVKRVRDLSKRVVEYLKEDADRLKEDVR

SEQ ID NO: 22666 - protein, 174 aa, Artificial Sequence; identical to SEQ ID NO: 22665
  Synthetic sequence.

SEQ ID NO: 22667 - protein, 174 aa, Artificial Sequence
  Synthetic sequence.
DEERKIRKAVEDVRRVIKEVEENSKRVFDENKKVIDDVRKEVEKVLKENRDVIKEVRDKGVDEKLLDESRRNSERVVTKITKLLKDSEDNSRRLLEESKRLAEDVRRRLEELRKDVSNADEVLKELKKLVEELEKLSREVVKYLREDAKRLKDLVRKVVEYLKEDARRLDEEVR

SEQ ID NO: 22668 - protein, 174 aa, Artificial Sequence; identical to SEQ ID NO: 22667
  Synthetic sequence.

SEQ ID NO: 22669 - protein, 186 aa, Artificial Sequence
  Synthetic sequence.
SVVEKLLEDARRVVEKVREAVERNLKKVRDLVKKLREDVKRSKDHLEEVVRKLEEAKKTTDEKVLRDLKREVEEVLKRNEDLTRKLKEEAERINKESKDHLERLREEIERIIEDLRRKLEEAKDRVSEEVERRVEEVIRDLERVLREVRERVRRINEESRRMLEDVERESRKALRDLEEVLDRVRR

SEQ ID NO: 22670 - protein, 186 aa, Artificial Sequence; identical to SEQ ID NO: 22669
  Synthetic sequence.

SEQ ID NO: 22671 - protein, 186 aa, Artificial Sequence
  Synthetic sequence.
SVVEELRKRVEDVVDEVREVVERNRDLMRRVAEESKKIVDDSLRHIKEVVDEVRRAKNTTDEKVLDDLRKKVEEMLRRNEETTKRVSEKSEKINKESEDHLRELRKKIKKIIEDLEDRLRKAKDTVDERVKKRVRDVLRKLREVLERVAEEVKKVNKRSREVNKRVEEKSEEVLRDLERVLREVET

SEQ ID NO: 22672 - protein, 186 aa, Artificial Sequence; identical to SEQ ID NO: 22671
  Synthetic sequence.

SEQ ID NO: 22673 - protein, 178 aa, Artificial Sequence
  Synthetic sequence.
SEVEEVVERLRRKAEEDLRRVEEAVKEHRRVVKEDLDRVRDAVERHREVVETIRKLKEDGGDEKELKKIEEDLERSSRKVKEESDRTLERLEETSRKVDKESKETLDRLREEVKDVARRGGDDEKLKRVLKEVEEVVRESKERLREVHEEVRKVIEDSKRILKTVHDDVRRVIEEVKK

SEQ ID NO: 22674 - protein, 178 aa, Artificial Sequence; identical to SEQ ID NO: 22673
  Synthetic sequence.

SEQ ID NO: 22675 - protein, 178 aa, Artificial Sequence
  Synthetic sequence.
DDVERVLKELDELLKRDETEVREVEKRHREVLETIERRVREVIERHKEMLRRLAELVRSGGSEETLKEILDRLRRTSEELKKELEKILRDLERTSREVEERSERTLREIEKRIEDLRRKGGDVEELKKVRDKVRRVIEESKRRLEELHEEIRRLITELKRRLEEVTEEIKRAIDELRR

SEQ ID NO: 22676 - protein, 178 aa, Artificial Sequence; identical to SEQ ID NO: 22675
  Synthetic sequence.

SEQ ID NO: 22677 - protein, 178 aa, Artificial Sequence
  Synthetic sequence.
DEVEDVVRRLRKIVEDIRRDVERVVEEHDRVVRKLKRRVEEAVEEHRKVLEEIKKVKENGGSERELEEIAKKMEESSRRVEEEIERIARELDRTSEEVKKRLEKLLRDVREEVKKVAKDGGDREDLKRVLKEVEDVVREVDKILTDATERVKRVITEVKDILRRVHEEVREVIKRVKE

SEQ ID NO: 22678 - protein, 178 aa, Artificial Sequence; identical to SEQ ID NO: 22677
  Synthetic sequence.

SEQ ID NO: 22679 - protein, 178 aa, Artificial Sequence
  Synthetic sequence.
DEVEEVVRELREILKRDLDEVRKAVEDHERLLREITKDVKRVADRHRDLLRKIRELKENGGDEKLLKKIEDELRRTSEEVKRRLDEILKRIRDTSEEVKERSKETLKRLEDRVREVAREGGDDEKLKRVLKELEDVIRESEEILERVTRKAERVIERVRKILEEATKEVERVIREVRR

SEQ ID NO: 22680 - protein, 178 aa, Artificial Sequence; identical to SEQ ID NO: 22679
  Synthetic sequence.

SEQ ID NO: 22681 - protein, 172 aa, Artificial Sequence
  Synthetic sequence.
EEDERIEKVTEEVKKVIEDVTRLTETVMRESEKVIEDVTRDSDRVRKEVKKVLEKVRKSEELDDVARKLEKLFRDLARTNKKVKDDSKRTIERLREKNEKVKRDVDRLRKKVKSEDVDEVVKRLKELVTRLAEENKRAVDTNRKLAEDLKELNRKAVEELKELLRRVDERDR

SEQ ID NO: 22682 - protein, 172 aa, Artificial Sequence; identical to SEQ ID NO: 22681
  Synthetic sequence.

SEQ ID NO: 22683 - protein, 172 aa, Artificial Sequence
  Synthetic sequence.
SEDEEIDRVDKDVKRVSDTSNKILDDVEKEVDKVIREVTAESKKVLDEAKKVLDKVREDERLKEVATRVKELFDRLREENKRVRRRLREIVKRVRELNRRSEEEIRRIKEEAKDRDVEEVVRRLEKLVDDDRKLVEKVVKELRELLKELRDKNKEVVDELRRLAKTVDEEDR

SEQ ID NO: 22684 - protein, 172 aa, Artificial Sequence; identical to SEQ ID NO: 22683
  Synthetic sequence.

SEQ ID NO: 22685 - protein, 177 aa, Artificial Sequence
  Synthetic sequence.
SAEEIAERVLRELRKVTKEVAEEDERVLREDEKVTDEVRKEDKRVLDEARKVIDDVRKKGIPEEVLRRAEEVLERLRRKSEEILKESKKSTETSRRESEKVLRDSEDSIRELEERAKKTKVDEEVVKRVRENVKRTRELSKRSVEKNEENVRRTREMSKRTVKEIRDVVKELRDRVK

SEQ ID NO: 22686 - protein, 177 aa, Artificial Sequence; identical to SEQ ID NO: 22685
  Synthetic sequence.

SEQ ID NO: 22687 - protein, 177 aa, Artificial Sequence
  Synthetic sequence.
SKREKAEEVLKEAKKVIDDVREKDRRALEEDKRVTDEVARIAEKVLKDLRDVIEEVRERGIDKRVLDTIKELLERLEKELRDVLKRSKESTEESKRKSEEILRRAEEVLKRLEEELERTRADEEVVRRVRKVVTELEELSRRSVEENRRNAEETERLIREIVERARRVVETLKETVR

SEQ ID NO: 22688 - protein, 177 aa, Artificial Sequence; identical to SEQ ID NO: 22687
  Synthetic sequence.

SEQ ID NO: 22689 - protein, 181 aa, Artificial Sequence
  Synthetic sequence.
SVEDILRKVAKEAEDVAREVTRILEEANRRVEEVVKRVKEENERANEKVERVVREVKARGLNREELEKILRKIHEENKKMKKRHEDILKRIHEENKRVLEELKRILEEVKELLKEVAKRVRDEEVVRRVVETVKDIVKRLRDIVREVLKKNERIVEELKKTSDESKKRNDDIVRELDERAR

SEQ ID NO: 22690 - protein, 181 aa, Artificial Sequence; identical to SEQ ID NO: 22689
  Synthetic sequence.

SEQ ID NO: 22691 - protein, 181 aa, Artificial Sequence
  Synthetic sequence.
SVEEILEEVLRRAEKIVKEVKDLDRRALEENKKAIKEVADELRKVDEEVKKVVDEVRREGFNDETLDDILRRIHESNKRVKEKSDESLKRSAEKSEDSRRRLEKITKEVRDTLREVRKRVRDEDVVRKVVRDVEDIVRRMREEVRRSVEDLKRNADENRDEVRKVVKENKDIVREMRERVR

SEQ ID NO: 22692 - protein, 181 aa, Artificial Sequence; identical to SEQ ID NO: 22691
  Synthetic sequence.

SEQ ID NO: 22693 - protein, 174 aa, Artificial Sequence
  Synthetic sequence.
REKEKLEKAVRDARRVIERVERKDREALKEVERVVRESHKTLEDVLREIRKVATEVRREGLDREKLKKLLDDVEDVIRKAHELSERILREVEDVSRRSKEALKRIEEEIEDLVRKLDDVDKLMKTIEDLLRRVEELVDRSVKELKRLLDENRKLVKRVLEEIRRILKELRDEVK

SEQ ID NO: 22694 - protein, 174 aa, Artificial Sequence; identical to SEQ ID NO: 22693
  Synthetic sequence.

SEQ ID NO: 22695 - protein, 174 aa, Artificial Sequence
  Synthetic sequence.
DEEEKLRKVKKEADDVIRRSHEEDERVLREVEKVVRESHEELKRVADEIRRVVEEVKTRGMDREELERLREEVRRLLEEVHEKSKEIEEEIKRRSEESHRRSKELKERVADLERKLSDVDKVMETIRRLVTKNRELVKRSVDELRDLVDKNRKLVERVVERIEEIAKKARDDVK

SEQ ID NO: 22696 - protein, 174 aa, Artificial Sequence; identical to SEQ ID NO: 22695
  Synthetic sequence.

SEQ ID NO: 22697 - protein, 182 aa, Artificial Sequence
  Synthetic sequence.
KVVEEIEKEVRRSVEELERLVTEDLRKVKEVVKRAEEVAEEDERKVDEVVKELKRAAKEGRDKRELEEEVRRVHEDSKRTLEELRRDIKRVNEDSRRSLEEIDKLSRDVKKRLDEMVRDLVRTEEMERRVREVLKRNEDVTDEVKKKIEESNRDLEDALRKVEKKIRESNERLRRVLEEVRK

SEQ ID NO: 22698 - protein, 182 aa, Artificial Sequence; identical to SEQ ID NO: 22697
  Synthetic sequence.

SEQ ID NO: 22699 - protein, 175 aa, Artificial Sequence
  Synthetic sequence.
KEVEDVLDDVRRVVEKLEREVKKVEDTNERVVETLDEIVKEIRDRNRKVVETLKEIMKSNKESKDELKRILDEVHEDNRRILEELKDLLRKVHTENRDIKRRLDKELDEVRRRIEKVGTSDKLRKAEKDLRDVAKEVRDKIRRADERLKRVIERVADEIRKVNTDLKRVADEVRK

SEQ ID NO: 22700 - protein, 175 aa, Artificial Sequence; identical to SEQ ID NO: 22699
  Synthetic sequence.

SEQ ID NO: 22701 - protein, 174 aa, Artificial Sequence
  Synthetic sequence.
SEVEDVEREIEEVVEELRKIAEDDLRRNDTVVKEVRELVKRDREKNRKSAEELKKLKEEGRDKTKLEEIFRRDEEENERSRRELKKLLDDVERENRKTLRDLERILRRVKKRLDEFRDSEELKRVMEKITRVVEKVKEDVDRSKKKAEEVIREVEERLKRSLDESRKVLEEVKK

SEQ ID NO: 22702 - protein, 174 aa, Artificial Sequence; identical to SEQ ID NO: 22701
  Synthetic sequence.

SEQ ID NO: 22703 - protein, 174 aa, Artificial Sequence
  Synthetic sequence.
REVEEVKKRVDEVVKRLRKLAEDDDRKNKESADRLRAIVDRDKKENTRSMETLRRLRERGEDRDELRKIVKDDREKNERSEKELKDILREDHKENKKSEDTLEELLRRAAEELKAVDRSERLEDAKKKLEDVIDEVRRRLEESNKRSRDVMEEVRKEVRRSLRESEEVVKDVEK

SEQ ID NO: 22704 - protein, 174 aa, Artificial Sequence; identical to SEQ ID NO: 22703
  Synthetic sequence.

SEQ ID NO: 22705 - protein, 174 aa, Artificial Sequence
  Synthetic sequence.
DEVREIKRLVDELVKRLKELAERSRRLVDEVAKRSKELAKENLDLNEDIVRRLDEVAKRGEDRKVLEELRDRIRKINEESKRRDDRLLEEIRRISEETKRRLKKLRDEIRELIERIRDTKELKDVAREIERVLKEVEEEDDDALRKIEEVSKRSKEIIDESMEKVKKVMEDVTR

SEQ ID NO: 22706 - protein, 174 aa, Artificial Sequence; identical to SEQ ID NO: 22705
  Synthetic sequence.

SEQ ID NO: 22707 - protein, 174 aa, Artificial Sequence
  Synthetic sequence.
SEVETVKKLIEDIVRESRRLVRENEELNKDVIRRSEELVRRSKEAVKRLVDKLDELRKRGSPEDDLERLLREIERISEETKRRDKKLLDEIEEINERSKREDDKLLTTVREIVKAVRRARELERAVEEIERVSRDSKREIKRSTEEVRKASERSRKEDEELERRARRVVEEVKR

SEQ ID NO: 22708 - protein, 174 aa, Artificial Sequence; identical to SEQ ID NO: 22707
  Synthetic sequence.

SEQ ID NO: 22709 - protein, 175 aa, Artificial Sequence
  Synthetic sequence.
SELEKVVEEVEEIVRRSERHVTEVVKTSKKSVEDSNRHVAKVVEDVKKKVTELIEAARENRVDKRELTREAERVEEELRKVLRTNEKLAEEDKRRLEKVARDNERLIDEVRRELDKVRKDKVLERVKRELKKAADRSRDIIRRVARETEEALRTSREIAKRVEDELRRVLEEVRK

SEQ ID NO: 22710 - protein, 175 aa, Artificial Sequence; identical to SEQ ID NO: 22709
  Synthetic sequence.

SEQ ID NO: 22711 - protein, 175 aa, Artificial Sequence
  Synthetic sequence.
KELEDVVKRVREEVRRSLEHVAKAVKESEDSVRELKEEVDRVVKESEDIVRELEKLKRENRVDEKELEKIAKENVDRNDTVREELERRVEEDERRLEKILRENEEEVERVERELRKVRDDKRLKEVDKELKRALEESRKIIKKVKEETKDVLRRVRDILRRSVRTSEKVLKEVKD

SEQ ID NO: 22712 - protein, 175 aa, Artificial Sequence; identical to SEQ ID NO: 22711
  Synthetic sequence.

SEQ ID NO: 22713 - protein, 178 aa, Artificial Sequence
  Synthetic sequence.
SKVERVVEESRENAKRDLDRVDKVVKDSRRSVEEDLKEVRDVVKEVDDMLREAEELMRRGEDEREIERILEEIERRLREVEKKSEKSFREDEERLKRVREESERNLREDRKRLEEVRKDNVDEKVIREVAKESEDAFRESERRLREVLKRSAEALKRSRDILKTVRERVKRVIDEVRR

SEQ ID NO: 22714 - protein, 178 aa, Artificial Sequence; identical to SEQ ID NO: 22713
  Synthetic sequence.

SEQ ID NO: 22715 - protein, 178 aa, Artificial Sequence
  Synthetic sequence.
REVEEVVKRSEKSVKEMEDKSRETVKKSRKSAKEDIDKVEEVVRRVEKVLREAKKLADDGEDRRTIEKILRDIEEELRRVEEESRRSLKKDREDNKKSLKELEELFDRDRRELEEVAKRNVDKDVIEEVRKKSDEVLKRVRKINKEVTEESERAFDESRRILETVAREVKRVIDEVRR

SEQ ID NO: 22716 - protein, 178 aa, Artificial Sequence; identical to SEQ ID NO: 22715
  Synthetic sequence.

SEQ ID NO: 22717 - protein, 179 aa, Artificial Sequence
  Synthetic sequence.
DAVEREVRKAEKIVEDDLRRVAKVVDESRKSVEKNEEDVRRVVEELRKILEEIDRLKRNGGDDESLERIARELEDLIRRVKERSDENVEENERLLRRVEEESKDSLKKLREALKRIRDNNVVDERVLRRVKKKLEDAVEDSRRILTELAEEVKTVVERSKRILDTVRDELKKALERVKK

SEQ ID NO: 22718 - protein, 179 aa, Artificial Sequence; identical to SEQ ID NO: 22717
  Synthetic sequence.

SEQ ID NO: 22719 - protein, 182 aa, Artificial Sequence
  Synthetic sequence.
DEVDEVVEKLRRLLEDTIRLVREAVDYLRRNLEDLRRKIREIVERLKRLLEELRKLVKDTRDEETLKKIIEDVRRTVEELLKELEEILRRSEENVKRVLKRLEEILKKSSDDLRKELKRVREAGLDEKRVRDAADEVRRMNEEVKKIIDDARKELERVHRDVKREIDRVARELDEEIRRVEK

SEQ ID NO: 22720 - protein, 182 aa, Artificial Sequence; identical to SEQ ID NO: 22719
  Synthetic sequence.

SEQ ID NO: 22721 - protein, 182 aa, Artificial Sequence
  Synthetic sequence.
DEVREMVKTLTDLLRRNRELVKRVVEELRKLLEETRKLVEDMVKELEDLLRELEKLARDTEDKDTLRELIERAKRKVEELRKRLEEILRRSHEELRRLEERVRKIDEESKKRLRELEEEAKRAGLDEKVVEEVARKVARANEDSNRILDEARKEVEKVNEEVRRIIKEVTDRLEKKVREVEK

SEQ ID NO: 22722 - protein, 182 aa, Artificial Sequence; identical to SEQ ID NO: 22721
  Synthetic sequence.

SEQ ID NO: 22723 - protein, 178 aa, Artificial Sequence
  Synthetic sequence.
SKAERLDEEVDKIVRDLRRLVDELEKRIEKIVRDNRELVKRVRESNKRIVETLRRLKENRGDKRVLDKIARDIHEENKRALERSEKSAEDVERELKKVKDELKEIVDRVKKTLDEARRAGVDKREVDKIEKKLRDVVREVEEIVTRVDKRLKDVLKESREILKEVNDETKKVLDEVKT

SEQ ID NO: 22724 - protein, 178 aa, Artificial Sequence; identical to SEQ ID NO: 22723
  Synthetic sequence.

SEQ ID NO: 22725 - protein, 178 aa, Artificial Sequence
  Synthetic sequence.
SEAEKVVRDVREIVERLRDIVRKVVEENEEIVKRLRKLVTDLVEENKRTVEALRDLKRRRGREEELEKIAEDDKRRNEEVRKDLERIAKEVHDRNREVLKTIKRILDEVKERLDDVRRRGVDEEILRRVEEEARRAAKEVEERIRTVNRRTEKVLEEVRKIVKDATDTSEKALREVRE

SEQ ID NO: 22726 - protein, 178 aa, Artificial Sequence; identical to SEQ ID NO: 22725
  Synthetic sequence.

SEQ ID NO: 22727 - protein, 176 aa, Artificial Sequence
  Synthetic sequence.
SRVEEVLRKVEEIVKRNEDLARKVVDESRKTVDKLRTLVEKVLRESRETVKRLIDLVRRNEVDKRRIEELAERDKERLKRVLEEIEREAREDERRLTDVVRRSEESIRRLKEDLDRANAREDLLTRVTDVLRKLRDRSREIIKRVVDETRRVLEEVKELIKRVLEETERVLREVRR

SEQ ID NO: 22728 - protein, 176 aa, Artificial Sequence; identical to SEQ ID NO: 22727
  Synthetic sequence.

SEQ ID NO: 22729 - protein, 178 aa, Artificial Sequence
  Synthetic sequence.
SEVDEVVDRSRKTVKKMIDDVREVLERSRKNVKEDIERVRKVVRESEETVKTARRLKEEGADDREIKRLIDEDRERLRKVLKESEDNLRENKRENDDMRRRIEKLKRDDERRLDRVEEEGVDEEVLRRVREVTERATREVEELLKRSDEESERALKTSTDVLREVLERSDKVEEEVKT

SEQ ID NO: 22730 - protein, 178 aa, Artificial Sequence; identical to SEQ ID NO: 22729
  Synthetic sequence.

SEQ ID NO: 22731 - protein, 182 aa, Artificial Sequence
  Synthetic sequence.
KEVEEAVRRVEESVRRLEEEVDRVVKENRKLVKDLIELAEEVVRRVKELVDRLRETVRRAKDKDTLDKLIREVADRARRLVERIDEILKEIKKRSEESLERIRDSLRKHHEELKRLIKEAEDRGLDKDVVTEVKKRAEDVDRRVERVIEEAEEVSREALKRVRDIIDTVRKVAETVLKEVKD

SEQ ID NO: 22732 - protein, 182 aa, Artificial Sequence; identical to SEQ ID NO: 22731
  Synthetic sequence.

SEQ ID NO: 22733 - protein, 177 aa, Artificial Sequence
  Synthetic sequence.
KEKEVMDEVERVLEKVKEDNRRVVREVEDVLRRVEKENKEIVDEVKDVARKVLEEVRRRGIPEEVLKELEDILRELDKKVRESNKRTRDIIERLRRDVERSNKELKDIVRELRKELRDTRVDERVLEKVKDVVRRSRDIVRRILEDAKDVVRKSREIAKKILEEVTEVVKRAREKVK

SEQ ID NO: 22734 - protein, 177 aa, Artificial Sequence; identical to SEQ ID NO: 22733
  Synthetic sequence.

SEQ ID NO: 22735 - protein, 175 aa, Artificial Sequence
  Synthetic sequence.
SKLEELLKRSEKSVREAKRLVEELKRRSEETVRRNKELAERLEDESRKTVELLKRIVDSNKEVRETIEDIVRRDREKLEEMRRRSEKSLDEDRRRLEEMRKRIEELLRRDEEDLRRVEPDKLLEEVEKESRKVVEDVRRVIEDVKRRSDEALKESEDIIRDVRRKSEKALRDVEK

SEQ ID NO: 22736 - protein, 175 aa, Artificial Sequence; identical to SEQ ID NO: 22735
  Synthetic sequence.

SEQ ID NO: 22737 - protein, 175 aa, Artificial Sequence
  Synthetic sequence.
SELEDLLRRSKESVDRLRELIRRLEDESRKTVETLRDIVKKLKEENKKTVDDLRDIVRRRKDDEETIEKIFKEDKERNEEATRRIETILTRDREKLEKVLREAEKLIRDDKRRLKEIEKDELLERVREVSDKVLEELKKIIDEIRKRSEKVAEEVKDVIRKVNELSKKVLKDVKK

SEQ ID NO: 22738 - protein, 175 aa, Artificial Sequence; identical to SEQ ID NO: 22737
  Synthetic sequence.

SEQ ID NO: 22739 - protein, 175 aa, Artificial Sequence
  Synthetic sequence.
RKLEELLKRSERSVEELRRKVTRLLEENDDTVRRLRELVTKLTDDSRKTVTRLRDIVRKDKDVTEEIKRIVEEDRRRLEKVKRDIDKLLREDRKRNRDVEEELRELLERDRDELRKVEPDKLLEEVTKVSEKVAEEVRRVIKTVNDKSTEVLREVKRVIETVRRESEDVLEKVEK

SEQ ID NO: 22740 - protein, 175 aa, Artificial Sequence; identical to SEQ ID NO: 22739
  Synthetic sequence.

SEQ ID NO: 22741 - protein, 175 aa, Artificial Sequence
  Synthetic sequence.
SKLEDLLRRVTEIVKRLEEIVRKLEERSRRTVKRLEELVDTLRKENEDTVRRLEKIVRDRKDDTDKIRDIAEKDRRRNKEVKDRVKKLLDDDRELLERVRREIEEIVERVREELDRVEPDELLKEVRDVLETVVKRVREIIEKVRKESEDALRKVDKDIREVNRRSEKALEDVKT

SEQ ID NO: 22742 - protein, 175 aa, Artificial Sequence; identical to SEQ ID NO: 22741
  Synthetic sequence.

SEQ ID NO: 22743 - protein, 175 aa, Artificial Sequence
  Synthetic sequence.
SEAEKIEREVDKVVEDHRRLVRADLERVERVVEEHRRLVKEDLDRVDEVVKRLRKLKEDGTPKEEIRRLIEEVERRSRESLKEIKRTTDEVRKESKKSADRLRETTERAKKRLDEANVREDVLRRVRELLKTVHEEVKKVIKTSDDILRTVHDEVRKVIKTSEKILREVAEEVER

SEQ ID NO: 22744 - protein, 175 aa, Artificial Sequence; identical to SEQ ID NO: 22743
  Synthetic sequence.

SEQ ID NO: 22745 - protein, 175 aa, Artificial Sequence
  Synthetic sequence.
KELEDATREVETVADEHRRVLEEDKRDVKEVVERHRRLLEDLRRKLEKVVRDLRKLLKDGVPKEELKKLVDDLKRTIDRLLREAEKTTREVDKKSERSVRELERTSKEMKERLDRLNLREDVLRRIEKKLKDVTDDLRRVIKESKDRLTKLHKEVEDALRRLRDRLRELEDEIRR

SEQ ID NO: 22746 - protein, 175 aa, Artificial Sequence; identical to SEQ ID NO: 22745
  Synthetic sequence.

SEQ ID NO: 22747 - protein, 182 aa, Artificial Sequence
  Synthetic sequence.
RELEEAVKEVEKKIRELRERLKEVVERSTKKMDDLRKENEKVMRESSELVTELVKEIKDRASDKDKARRVIEELEKVNRELKKEHDKTVKELEDVNRRIERKAREVERELEEVLRDIERLIREGVDLKDLRKKVDDVARKVDKILEDLERESDTVLDRVKKVLERSRRDSEDVARRVEEKVR

SEQ ID NO: 22748 - protein, 182 aa, Artificial Sequence; identical to SEQ ID NO: 22747
  Synthetic sequence.

SEQ ID NO: 22749 - protein, 183 aa, Artificial Sequence
  Synthetic sequence.
SELDELRKMVKEVLDRVRDLLKKLEDEARKVAEDNKRLLERNKREIEAALRRVEEIIRRRRTEDVRREVEKILEELIRESERSVRESKKHLDDVKRRVEEIVRRIKKELDDLLREAKRIVDEKEDKRVREVLREVEKRIKELEDLVRKVLDKIRELIERLKRETDKVLEESKKLIKELSERLE

SEQ ID NO: 22750 - protein, 183 aa, Artificial Sequence; identical to SEQ ID NO: 22749
  Synthetic sequence.

SEQ ID NO: 22751 - protein, 183 aa, Artificial Sequence
  Synthetic sequence.
DELEDVRKEIEDVRKENEDTVRESKDEIRRLEDTNRKTLKESRDDIEKARERVKKERRDSDKRVLERVAEELRRIVKRIREKDKEVIERSRKILDENRRRNEEVIKKTEKRLEEIRDRLSRVENEKDVRKVLKEVEEEARELVKLNRDVLEELRRRVRKLVEDNKDVTREVEDILKKLEEELK

SEQ ID NO: 22752 - protein, 183 aa, Artificial Sequence; identical to SEQ ID NO: 22751
  Synthetic sequence.

SEQ ID NO: 22753 - protein, 176 aa, Artificial Sequence
  Synthetic sequence.
SMDETIRKLAEDNRRRSDETVERIERLAKKLDEDNRRVVEKSERLAKEVADKVRRVKNTTDERELKEVMEELERILKRIAEDHEKVIRDSEDILRRIEKLVERSIRESRKSLKRIRELKVDERVIKEVEDISRDLERKNKEVVERARRIVEKVKETNKRVLEEVEKIVRKLKEELK

SEQ ID NO: 22754 - protein, 176 aa, Artificial Sequence; identical to SEQ ID NO: 22753
  Synthetic sequence.

SEQ ID NO: 22755 - protein, 184 aa, Artificial Sequence
  Synthetic sequence.
SVEEVVEEVRRVAEKVEEDVTRVIKEDEDIARELEKRIDDVIKESKTVADELLERLRRAGADRRLLEEVRRLMEEVTRRHEELRREVEERVKDSKRRHDESRKELEDLLREVEERARDVRRRGGIEEELERLLREVEELIERVKERHKRLVEDSKRLLDEVDKRLKDSNREVRERIEEIKRRVD

SEQ ID NO: 22756 - protein, 184 aa, Artificial Sequence; identical to SEQ ID NO: 22755
  Synthetic sequence.

SEQ ID NO: 22757 - protein, 175 aa, Artificial Sequence
  Synthetic sequence.
DELEKIREEVREIVERSKREAKELLDRNKEIVKDLERKAREILRENRDRVRRLAEKTNEDEKTVRELLERNKKVARDVEDKVRKLIEDNERVARESEKRIRESEKKNRDVLRELEKRVDSEVLDELRRIIETSEKLNRDVLRESKEVNRDLTRKLEEVLRRSKEDNKRLSEKIKE

SEQ ID NO: 22758 - protein, 175 aa, Artificial Sequence; identical to SEQ ID NO: 22757
  Synthetic sequence.

SEQ ID NO: 22759 - protein, 175 aa, Artificial Sequence
  Synthetic sequence.
DELEAIKDEVRRIVRESEERAKKILRDVERMLDEIRKKLKEILDRNREVVDELKRQINEDKETVERLLRDNKRVLDRVEDSARRLEEELKRVLDEVEERVKRSLDRNDEVLKELEKRVDSEVLKELRRIIEESKRRNKRVLDEIRKRAEDLRRVIKEVLDRSREINKRLSDEIRK

SEQ ID NO: 22760 - protein, 175 aa, Artificial Sequence; identical to SEQ ID NO: 22759
  Synthetic sequence.

SEQ ID NO: 22761 - protein, 175 aa, Artificial Sequence
  Synthetic sequence.
DELEKIVREVREIVKESKEEARRILEENKKIVEELRRRLRKILEENEDMVRKLEKKTNEDKDTVRRLLEENKRVAKEVEDKVRKLIKENEDVMREVEKKVEKSLRDNKRVLDDVRRRVDSRVLEELERIIRESEEANKKVLEDSRRVNKKLSEELKRVLDESRRRNEELSKRIKD

SEQ ID NO: 22762 - protein, 175 aa, Artificial Sequence; identical to SEQ ID NO: 22761
  Synthetic sequence.

SEQ ID NO: 22763 - protein, 185 aa, Artificial Sequence
  Synthetic sequence.
DELRDLEREIRRIVEESERHLKEVLERNHEASKRNRDDLKRMVDDIRRKVEEVRKLREEGTDKEKLKEELERALRKVEKIARDSERHLDKVLKESREAIERNERENRRLLEEVKRTIEELRRRTDAETVDRVLEKLKRIVEDSERRVKEVLKELEENSKRIKDETKDVLRKVEEIVERLRKEIER

SEQ ID NO: 22764 - protein, 185 aa, Artificial Sequence; identical to SEQ ID NO: 22763
  Synthetic sequence.

SEQ ID NO: 22765 - protein, 185 aa, Artificial Sequence
  Synthetic sequence.
DELEELKEEVKRAVDENRETNKRALDRNHEISKDSEDHLRESSERIRRRIEELARLVEAGEDKRRLEEDVKRLLEESKKLIKENKDRNREVVRRSEKIAEDSKRHLDAVLEKVERTIRKLREETDRETVKKVLKELREEIERVKRESEKVVKAVRDNSKRSEEKVEEVLERNKRIVDDVLRKIKK

SEQ ID NO: 22766 - protein, 185 aa, Artificial Sequence; identical to SEQ ID NO: 22765
  Synthetic sequence.

SEQ ID NO: 22767 - protein, 185 aa, Artificial Sequence
  Synthetic sequence.
DELKEAEDRVREVVRENEERLRKALEENHKISRDSEKHLRDLERTIKEIVKRVRDLRRRGTDKEELKKELERVLDKVRKDITDNLRTNEEVLKRSERIAEESERHLDKVLKDLEDIARKLKDKTDKDTVEKVLRDLRRIIKEVKERSREVLKRVRENSDRSLKKVEEVLKRLEDIIRTVKEEIKK

SEQ ID NO: 22768 - protein, 185 aa, Artificial Sequence; identical to SEQ ID NO: 22767
  Synthetic sequence.

SEQ ID NO: 22769 - protein, 179 aa, Artificial Sequence
  Synthetic sequence.
EDAERALKKIEEIVRRLTEELKRVLDANRESVDRLRRELEEVLKRNRELVRKLEKILEERKDDQDTARKVIEDSERHIKELEERVERVIRENKKTVDDALKRVKDVVERLKEEVKRLEDRGVDREVVERLKKIIADLDRVVEEVIRTSRKVIKELEDTVRRVIEELKRVSDELKKKVED

SEQ ID NO: 22770 - protein, 179 aa, Artificial Sequence; identical to SEQ ID NO: 22769
  Synthetic sequence.

SEQ ID NO: 22771 - protein, 178 aa, Artificial Sequence
  Synthetic sequence.
DKLEELLKRVEELVERLKEESERVLRRNHELSEKLRRILEEILKRNHDLSRDLEDRLRKLKDKKEVDDLVREVLKRSKETVETLRRIVEEIKKRSEDSSEENRRRVKEALDELDRLVKRIEGDEVVKRVEDIIEKVREDLERSDEKLNDNVRRLEREVREVLKAVEDNARRLAEKTKT

SEQ ID NO: 22772 - protein, 178 aa, Artificial Sequence; identical to SEQ ID NO: 22771
  Synthetic sequence.

SEQ ID NO: 22773 - protein, 178 aa, Artificial Sequence
  Synthetic sequence.
SEAEKLLEEVKDLVRRLKKDLERVLRDNHRLSEELRRRLREILEENKKLIDTLREIREKLSDRDKLEKIVEEIVRRSEETVRRIKRVVEEVEKRSKESVEDLRRRVKTVLDRLKELVDRADGKEVAEKMRKIVEELRKEVEEVLKALKENLDRLRREVEKVVERIEDTLRELKKRATD

SEQ ID NO: 22774 - protein, 178 aa, Artificial Sequence; identical to SEQ ID NO: 22773
  Synthetic sequence.

SEQ ID NO: 22775 - protein, 182 aa, Artificial Sequence
  Synthetic sequence.
SEAEKVLEEVKRLVEDIERKLREMLRRDNEISRKVRDDLRKILEENNELSRRVEEEIRRIKDKDTLKKVVDEVRRELERTLERVRKLVEEVKRTSRKTLEDIKRIVETIKREMDRLLKEIEDRGLREEVVEALEKVVRDVARRLEDVIRRVAENAKRLEDDLRKVEEELKENADRLEERAKK

SEQ ID NO: 22776 - protein, 182 aa, Artificial Sequence; identical to SEQ ID NO: 22775
  Synthetic sequence.

SEQ ID NO: 22777 - protein, 175 aa, Artificial Sequence
  Synthetic sequence.
SEVEKLLEKLRELVERVEREARRILEENKELIKESLKRIRDLLEDNKRLIREVKEILRRGDKDERLLKDVRRRVKESKEELKKLLETNHRLARETVKKLEDVVRKLEELIRDIERKIDDKDVVKRIRDIAEKVRRDLKRVIDAVRDTSRESDRRLRDVIREVDESSRELVREIER

SEQ ID NO: 22778 - protein, 175 aa, Artificial Sequence; identical to SEQ ID NO: 22777
  Synthetic sequence.

SEQ ID NO: 22779 - protein, 175 aa, Artificial Sequence
  Synthetic sequence.
SDMERLLRELEELVKELRERLRRLLEENKDLIRRSLDRARKLVRRIEELVRKVKEDLDRGDNDERLLRKLEEDARRVLDELRRLLEENHELMKETIRKLEELLKEVTERAKDIRRKVEDEDVLRKIEETARRLVKEIEDVIREVERTSRESDKKLEDVIDKLRKIVRKVLEELRT

SEQ ID NO: 22780 - protein, 175 aa, Artificial Sequence; identical to SEQ ID NO: 22779
  Synthetic sequence.

SEQ ID NO: 22781 - protein, 175 aa, Artificial Sequence
  Synthetic sequence.
SEVEDLVRELERLVREAKKALDDLRRKLEELVRDSLRKAEELLKENHDLSREVKKLLEDGANDERLLREATERVKRSLERLKRLLEENHKLVRTVIKEIRELLDRVRKKARDIEEKIKDKKVADELRRIAKRLVEELERVIRELEKIAKESDERLKEVIDRLRENVERLVRELRR

SEQ ID NO: 22782 - protein, 175 aa, Artificial Sequence; identical to SEQ ID NO: 22781
  Synthetic sequence.

SEQ ID NO: 22783 - protein, 188 aa, Artificial Sequence
  Synthetic sequence.
KELEDLDRDVRRVVEELREELRRLEEEDKRSVEENEERLERLERRLRKKVKELEEKRKRIREKEKKEELKEEIKKVLREAEKIIEDSKRHIDENLKKSEEEIKRLKRKVEELEKKVEDIARELAEKRDREEVRRVLEELREKIKRVLEEIEEVLRRSREINKRLRDRTRTVAKRLKEIVDDVLRKVET

SEQ ID NO: 22784 - protein, 188 aa, Artificial Sequence; identical to SEQ ID NO: 22783
  Synthetic sequence.

SEQ ID NO: 22785 - protein, 188 aa, Artificial Sequence
  Synthetic sequence.
RELEELLKEVEKAVRENTKLLKDLLDKDKKSVKENEETLRDLERKLREVVERLKRELKDIRDDRMKKKLADKIETVRRDIKRIIDESEDHIRKNLEESKKIADDSRKHLDRVLEKAEDLIRKLKDKRDEKRVRDVLKRLREIIDTVKKVTKEVMERSEEINRRLLKRTKDVLRELEKIVKTVLDEVRK

SEQ ID NO: 22786 - protein, 188 aa, Artificial Sequence; identical to SEQ ID NO: 22785
  Synthetic sequence.

SEQ ID NO: 22787 - protein, 177 aa, Artificial Sequence
  Synthetic sequence.
SEVDKVREDVKRLIEDAERVSDDVDRRVKRLAEALKETSDKVKEDVERLVRDIKREIDKEEVKRRVDDALREIKEILERSKRHIDEVLKRVKDRLRESKRHLEEVLRRVKEILDRTTDEETLRRVLRKVEDVIRRNKEDNEKVLKDAKRVVEEDKRENEKALERIERIVRKLKEDTR

SEQ ID NO: 22788 - protein, 177 aa, Artificial Sequence; identical to SEQ ID NO: 22787
  Synthetic sequence.

SEQ ID NO: 22789 - protein, 177 aa, Artificial Sequence
  Synthetic sequence.
SEAEEVVRRVEKLAEDIKRVIDKSLEDVERLVRDAKRRSREVLREVEKLVEDITRRIRDEEVKRRVEKVLREIRRIIRESEKHLDKVLDDIEKILRKSKKHIDDVLREVKEIIDRVRDEEILRRALEKVERVITENKKENEDALRDAKRKIDKDKEDNKKVLDDVRRIIEELKEETR

SEQ ID NO: 22790 - protein, 177 aa, Artificial Sequence; identical to SEQ ID NO: 22789
  Synthetic sequence.

SEQ ID NO: 22791 - protein, 183 aa, Artificial Sequence
  Synthetic sequence.
DEVDRVAEEVKKLIDDVKRVSDEMLKRSEDLIREVKKTSDDVLETVERLIRDVERKVEERVDKEKARRLRKKLRELLEEVRKAIERSRKNLEDLLRKSKRSVERSREDLERIRREVEEVRKMKDDEVLKRLLDKIREDAKRNKDDNKRNLDESKKEVDRNKDENRRVLEKVKETVKRLKDEVK

SEQ ID NO: 22792 - protein, 183 aa, Artificial Sequence; identical to SEQ ID NO: 22791
  Synthetic sequence.

SEQ ID NO: 22793 - protein, 183 aa, Artificial Sequence
  Synthetic sequence.
KEVEEMLKEVKKLIEKVKRRSDDVLRRSEELARDLKKMSDDVLREVKKLIDDVKRTVDERVDKEKARRLREDLKRVLDEVREVVRESREDIERILRESKRSVEESRKNLEKLKTDVERASSVKDREFLKEVLDRVRERVEENERRNDENLKKSKKRIDENKEKNERVLRKIREIARRLKEELR

SEQ ID NO: 22794 - protein, 183 aa, Artificial Sequence; identical to SEQ ID NO: 22793
  Synthetic sequence.

SEQ ID NO: 22795 - protein, 183 aa, Artificial Sequence
  Synthetic sequence.
SEVDRVLKTVEELIRRVKRISDRVLTEVKKLVDDVRRVVEKSRRDVEELVKEVKRSVDERVDSTDAERLRRKLEKLVREVEEVAKRSEDDLERILRRVEEVIKRSRDNLEKLLRKVEEVSKIKDKEMLERALKEIKEEVKRNEDDNRRMLREIEELAKRNKEENKRVLDEVRDIVRRLAEEVK

SEQ ID NO: 22796 - protein, 183 aa, Artificial Sequence; identical to SEQ ID NO: 22795
  Synthetic sequence.

SEQ ID NO: 22797 - protein, 183 aa, Artificial Sequence
  Synthetic sequence.
EEVERVREEVDKLLKTLKEVSDRVLKASKDLLDRVKEIVEKSLRDVKRLIDDVKRKVDERVDKEEARRLREELEKVLREVEKVVEESKKDLERILEKSKRSVERSRKNIEELREEIERASRVERKEVLERLLKKAEEIIRKNKKENDDNLEESRKEIEKNEEDNRELVKRIEDEVRRLKKEVE

SEQ ID NO: 22798 - protein, 183 aa, Artificial Sequence; identical to SEQ ID NO: 22797
  Synthetic sequence.

SEQ ID NO: 22799 - protein, 183 aa, Artificial Sequence
  Synthetic sequence.
SEVEEVLRRVRELIERVKRIVDESEKEVRRLIEEVKKIVEESLKRVEELLRDVKRRVDERVDSTDAERLRRKLEKLLREVEEVVERSKRDLERLVRKVEEVVKRSRKNLEDVRREVERMSRVEDRKMLREVLEKIKKIVKDNEDDNRRALTEVRERVRENVEENKKVVDRVRKIAEDLRKEVE

SEQ ID NO: 22800 - protein, 183 aa, Artificial Sequence; identical to SEQ ID NO: 22799
  Synthetic sequence.

SEQ ID NO: 22801 - protein, 183 aa, Artificial Sequence
  Synthetic sequence.
SEVERVLEEVKKLIEDVKRVVKESEEEVEKLIRDVEREVERSKRTVDELVKDVKRAVDRDVDKEKAERLRRKLEELKREVEKVAERSKENLKRLLTRVREVVRESREDLERLLKKVEEMSRVKDREVLTKVLREVEEAVRRNKERNKRALEEVKKTVDRNREDNKRMVDKVRETAKRLKDEVR

SEQ ID NO: 22802 - protein, 183 aa, Artificial Sequence; identical to SEQ ID NO: 22801
  Synthetic sequence.

SEQ ID NO: 22803 - protein, 176 aa, Artificial Sequence
  Synthetic sequence.
SSIEKVREDVKELIRDVERAVKRVKEESKKLVDDLRRAVKRVEEESRKLLKDLERNKRREEVDKILKDNEKSLKELKDEVERILKENEDLLEKLEREVKRILDELKKRLDDADKIEGDDDVRRVLREIERIVKEVKDDLKRVLEESERSIRRVKEELRRVLEDNRRLLKEVKDRAR

SEQ ID NO: 22804 - protein, 176 aa, Artificial Sequence; identical to SEQ ID NO: 22803
  Synthetic sequence.

SEQ ID NO: 22805 - protein, 178 aa, Artificial Sequence
  Synthetic sequence.
SEVEAVLREVEERVDRVRKESEKTLREVERLVREAKRRSKKSLDDVKKKVEEVKKKIRDIKDEETLRRLIKRIEEELKEIVERNKKTVEEILRRLEEIIARDRRRIDKIVKDLRRIVEEVKDAEEVKREIEKLVEDVRRVSDRVVEEIKELVKDVERMSRKVVEDIKRLAEDVRREAE

SEQ ID NO: 22806 - protein, 178 aa, Artificial Sequence; identical to SEQ ID NO: 22805
  Synthetic sequence.

SEQ ID NO: 22807 - protein, 178 aa, Artificial Sequence
  Synthetic sequence.
DEVERVLEEVKERVDRVKRESEKSLKEVEKLVRTNERLSERTLKEVRDLVEDAKKKIDDIKDKETLKRLVDEIVKRLEDILRENREIVERVLKKLEEIVEKNERDITEIVERLRRIVEEVKDAEEVRREIEKLVEDVKRVSDKVVEDIRRLAEKLRRDNKRAEDEIRKLVRDVERRAK

SEQ ID NO: 22808 - protein, 178 aa, Artificial Sequence; identical to SEQ ID NO: 22807
  Synthetic sequence.

SEQ ID NO: 22809 - protein, 178 aa, Artificial Sequence
  Synthetic sequence.
DDLERVLEEVRKLVKELKERSRKSLEDVRRSNERNETESRRTLREVRELVKKVKEVIDRTKDKETLKKRVEEIVRELDKIAKRNKELVERVLEVNKKLVRDNTEEVRRILKELEDIVRSVKDAEKVKEDIRRLVEEVERVSREVVERIKKLADESRKKNKKVIDEIKELVKRVRDRAK

SEQ ID NO: 22810 - protein, 178 aa, Artificial Sequence; identical to SEQ ID NO: 22809
  Synthetic sequence.

SEQ ID NO: 22811 - protein, 178 aa, Artificial Sequence
  Synthetic sequence.
REMEEVLKEVEKRVRDIEDESRKTLERVDKLVKKNKRDSERTLKEVEDLVREVKKEIRRIKDKKTLKERIDKILEDLKRIADRNRRLMKKVLDELRKIIEEDRERIKEILKRLEDIVREVKDAEEVKREIKKLADRVREVSERVVREIEKLVRDIKRRNEEVIDEIRKLVEDVKREAK

SEQ ID NO: 22812 - protein, 178 aa, Artificial Sequence; identical to SEQ ID NO: 22811
  Synthetic sequence.

SEQ ID NO: 22813 - protein, 178 aa, Artificial Sequence
  Synthetic sequence.
KEVEDVLEEVKELVKELKRVSEETLRRVEKSNRENEEKSKTTLKEVEDRVERVKEEIKKTKDKETLKRLADDIVERLKAIVEKNKRILEEVERTNRELVEEDKRMVEEILRRLKKIVEEVKDAEEVKREIKKLVEEVRRVSEEVVREIKKLVDKSRRVNEKVIEDIKELAKEVEEAAR

SEQ ID NO: 22814 - protein, 178 aa, Artificial Sequence; identical to SEQ ID NO: 22813
  Synthetic sequence.

SEQ ID NO: 22815 - protein, 186 aa, Artificial Sequence
  Synthetic sequence.
SELEEILERVRKMAEDAERISEETLRRSEELIRRVKDLSRESLERVERLIRKVKKEIEEIKDDDTLRRLLEEVEKEIRKILKEDEEALEDVARKVKKINRDNERLLEELRKIAETLLKDILTKKGEESEEVLRVIKAIEDLLRRVERVSREASKTSEELLKDITRVSEKSKEDIKRLLDDVRRKVK

SEQ ID NO: 22816 - protein, 186 aa, Artificial Sequence; identical to SEQ ID NO: 22815
  Synthetic sequence.

SEQ ID NO: 22817 - protein, 186 aa, Artificial Sequence
  Synthetic sequence.
SELDEVLKTVEELVRRIKEKLKEILDRSRKLVEEARKLSEDSLREVKRVIDEIKREAERQKDDETLRKILEDVERIIRELLKRDDEVVRRVVEELRKLNDDIRRLVTEIKDRIRKIEEDIKTKKGESSEEVLKLVEDVRRLVEDVDRTVERMSRESKKLAEDIKRVSEKSKRDIERLLADVERTVR

SEQ ID NO: 22818 - protein, 186 aa, Artificial Sequence; identical to SEQ ID NO: 22817
  Synthetic sequence.

SEQ ID NO: 22819 - protein, 186 aa, Artificial Sequence
  Synthetic sequence.
DELDEVLKEVEELIKRVKRESERTLKENRDMVREIKRRSEESLREVRELIERVKDELRRTKDDDTLRRILERVRRRIKELLDRDKKLLKDARETSRKTIEDNERLLREVRRRIEEILKDIKRKKGESSERVARVVRRVEELLEDVERRSREVLKEMDKTAKEVKKASEKSEEDIKRLLEDVERTVR

SEQ ID NO: 22820 - protein, 186 aa, Artificial Sequence; identical to SEQ ID NO: 22819
  Synthetic sequence.

SEQ ID NO: 22821 - protein, 186 aa, Artificial Sequence
  Synthetic sequence.
KEAEDILKEVEDIIREAKKLSERTLDENRKVIRKAKEDSRRSLEEVRKIIEDVKEELDRIKDKETLDRILERVRKEIKELLDRDRDLLRKVEEISKKTIDEDREVLKKVTEEIDRLLKDLLRKKGESSERVLRVIREIEKLLEDVKRVSERSVKEMKKTLDDVRRASKRSEEEIERLLRDVERRVT

SEQ ID NO: 22822 - protein, 186 aa, Artificial Sequence; identical to SEQ ID NO: 22821
  Synthetic sequence.

SEQ ID NO: 22823 - protein, 186 aa, Artificial Sequence
  Synthetic sequence.
RSLEEVLKEVEELIRRAKEESKRTLDDVRKLIEEVKRESERSLRDVREMIERAKDRIRRIKDEETLRRILEEIKRIVEKLLEEDRKLLEDVTEEIKRILEENRKVLKEIKDRIARILERIKEEKGKDSEEVRKVVEDVERLLRDVERMSKEVEKRIRELLDDIRRVSERSRREIERLLEDVERTAR

SEQ ID NO: 22824 - protein, 186 aa, Artificial Sequence; identical to SEQ ID NO: 22823
  Synthetic sequence.

SEQ ID NO: 22825 - protein, 186 aa, Artificial Sequence
  Synthetic sequence.
DELEEILKRIEDRIREIKERSKKTLDDIRKVAERVEERSRESLKEVREVVEEIKDRIRRIKDDETLKRLAERARERIKELLDRDRKILEEVRKTVEKLLREDKRLLEEIAREVTELLKDILRKKGEESREVLKVIRDIEELLREVAEVSERSRREIEKLLEDVERVSREAIKRIKDLLRDVERTVK

SEQ ID NO: 22826 - protein, 186 aa, Artificial Sequence; identical to SEQ ID NO: 22825
  Synthetic sequence.

SEQ ID NO: 22827 - protein, 177 aa, Artificial Sequence
  Synthetic sequence.
KEIEELLDEIRRLMERSKENVRRSLKKSKDLIEEAKRRLEKSLEDSRELIRRIEDRIRRIKERDALKRVLDEIKKRVEEDIKRNEEILEEIRKLVEEDIKYNKDNLKRSEDLVRELEERVKSKEVLEEIRRLLEDLRRMNEKSIEDSKRLLEDVARAVKRSIDESRKLLEKIERDVD

SEQ ID NO: 22828 - protein, 177 aa, Artificial Sequence; identical to SEQ ID NO: 22827
  Synthetic sequence.

SEQ ID NO: 22829 - protein, 177 aa, Artificial Sequence
  Synthetic sequence.
KEMEDLLREAEELIRRSVENVKRSLEESEKLIRESKKNVERSLRRSEELAKEIKDEIRRIKERDEIKRVLDEAEELVRRDIDYNRRNLEETEKRVREDIKYNKDNLDESRDRVRKLEERVKSERVLREIRRLLRELEEINEKSIRDSKRLLEEIERVNRDSIRRSKELLEDVERTVR

SEQ ID NO: 22830 - protein, 177 aa, Artificial Sequence; identical to SEQ ID NO: 22829
  Synthetic sequence.

SEQ ID NO: 22831 - protein, 177 aa, Artificial Sequence
  Synthetic sequence.
SEVEDLLRRAEELIRRAKERLERSLRRVEKLIDDVRRKLERNNETVKRLVEEIKEKIKRIKERDMLKKVLEEAKKLAKESEEHLRKLLDDIRKKIEKDIEDNKKILEEIRRLVEDIRRKLDKEEMLKEIERLLEDIERVVRETIDTTRRLLEKIEREVREVIKSNRELVADLERTVT

SEQ ID NO: 22832 - protein, 177 aa, Artificial Sequence; identical to SEQ ID NO: 22831
  Synthetic sequence.

SEQ ID NO: 22833 - protein, 177 aa, Artificial Sequence
  Synthetic sequence.
DEVERLLEEVKRLIDRAREELKKSLDRVRRLVRENEEAVRKNNEDVADLIRKIKEKIEKIKEDEMIKKVLEEIKRRVEESLKHNKDLLREIRERAKKDIDDNKALLDEITELIKRVEDRVKMKKVLDDIRRLLKDIKDIVDKTIRDTKELLRDIEEKNRRATKSNKDLLEEIRETVR

SEQ ID NO: 22834 - protein, 177 aa, Artificial Sequence; identical to SEQ ID NO: 22833
  Synthetic sequence.

SEQ ID NO: 22835 - protein, 181 aa, Artificial Sequence
  Synthetic sequence.
DEVEKLLRRVEKEVDRIKRELEDNLRRVEKLVKEIHEENEKLMRKARKLVEDIKRIIDRGDKDSRVLDEVRKLIRTVEEEIKESVERAERLIRESEEHLKRVLEEAKETIRRLEEKVRRDVKSEEVKKAEKEIRRLLDELRRVVEEVTKKTKELLRRLKKSSDELRKTIKELLRELEEKVR

SEQ ID NO: 22836 - protein, 181 aa, Artificial Sequence; identical to SEQ ID NO: 22835
  Synthetic sequence.

SEQ ID NO: 22837 - protein, 181 aa, Artificial Sequence
  Synthetic sequence.
KEVDEILRELEELVKEIKKRLEELTREVKRLVDKIHKDNEDNLRDMARLVEEIKEIIRRGNKSSDVLKDIEKKAEESKKHLDESMKEARDLIRELEEKVKEILKEAERLIRRVKDLIRKTVKSKEVERVERDVERLLDELRRVVKEVLDRIRRLLEELERSSKRVKEETERLVKEVREAAK

SEQ ID NO: 22838 - protein, 181 aa, Artificial Sequence; identical to SEQ ID NO: 22837
  Synthetic sequence.

SEQ ID NO: 22839 - protein, 181 aa, Artificial Sequence
  Synthetic sequence.
SEVDKILEDLRELVERIHKKNKRIVEEDRELVKEIHRKNEENLKTMERLVEEIEKIIRRGDKSSKVLEDARRLAEESKKHLDRSMEEATKLVRESEERLDETVREAKKLIDEVREVIKRDVKSEEVKRVRKDVDRLLKELEDSSREVKERSRRTLEELERSSREVKERTERLLRKLEKAVE

SEQ ID NO: 22840 - protein, 181 aa, Artificial Sequence; identical to SEQ ID NO: 22839
  Synthetic sequence.

SEQ ID NO: 22841 - protein, 181 aa, Artificial Sequence
  Synthetic sequence.
DRLEEILKELRELVETIHRRNEEIVRKVAELVKRIHDHNEENTRRVEELVRRIKDIIRRGNKSSEVLKRAEELIKRSEEDLRRSVRDAERLIRELKEEVKKTVEDAKRLAKRVKEMLDRTVDSEDVERAKRDVDRLLKELEESSERVLRTIEKLLKELRESSKRVRDETKRLLDELREAVR

SEQ ID NO: 22842 - protein, 181 aa, Artificial Sequence; identical to SEQ ID NO: 22841
  Synthetic sequence.

SEQ ID NO: 22843 - protein, 181 aa, Artificial Sequence
  Synthetic sequence.
SELDEILKRLEKLVEDIKRKLEKLVRDLERLVKRIHDHNEENLKTVKKLVDEIKDIIRRGNKSSKVLEDARRLIEESKRDLDRSVEEVKEEAERVRREVERILREAEKLIRDVKKELDETVKSREVDRVREDVRRLLEDLKRVAERVKRDIERLLKELKESSDEVKKRTEELLEELERAVR

SEQ ID NO: 22844 - protein, 181 aa, Artificial Sequence; identical to SEQ ID NO: 22843
  Synthetic sequence.

SEQ ID NO: 22845 - protein, 181 aa, Artificial Sequence
  Synthetic sequence.
DEVDDILRRLRELVERIKKHLEDNLRELEELVKRIHDHNKRNVEEVKKLVEEIKKIIADGRKSDKVLRDARRLIKESKDDLDRSERKIERLVTESLKDLDDLLREAEKLIEDVKRELDKRVKSEEVRRVKEEVERLLEEVRRVVRKVKEESKRLLEELRRSSDRVKKETERLLEELERAVK

SEQ ID NO: 22846 - protein, 181 aa, Artificial Sequence; identical to SEQ ID NO: 22845
  Synthetic sequence.

SEQ ID NO: 22847 - protein, 174 aa, Artificial Sequence
  Synthetic sequence.
SEAEALVEEVKRIVEESKRRLEKVVEESRKLVEEVKKRLRDMLKTIEDLVKEVKELLDNGADEETVDRMIKRLKRLLEELRREVEEAIKTNEELLRRLKRESERTIKELEDLLRELKDNEEVKRKVERLLEEDRRVLEEVKESAKRTSKEVRDELREVSKRVEKLLKDVRDAAR

SEQ ID NO: 22848 - protein, 174 aa, Artificial Sequence; identical to SEQ ID NO: 22847
  Synthetic sequence.

SEQ ID NO: 22849 - protein, 174 aa, Artificial Sequence
  Synthetic sequence.
DEAEDLVRRVRDIVRKSREELKRVVEESDRLVEEVKRRLKKVVEDSKRLVDEVRKLREGGADERVVKRVIDENRRLLKELKETVKRVIETDRKLLEDLRDTSRRTIEELKELLDRLKDNEEVKREVERLLEDDERVLREVAKRSRETLETVRKVLEEVERRSRKTLEEVEKTAR

SEQ ID NO: 22850 - protein, 174 aa, Artificial Sequence; identical to SEQ ID NO: 22849
  Synthetic sequence.

SEQ ID NO: 22851 - protein, 174 aa, Artificial Sequence
  Synthetic sequence.
SEMDELVDRARRIVEESRRLLEEVVKRSKDLVKDVKKKLEDALRRVEEIVRRLDEELKGGADEERVKKIIRDLKELLKKLREEVAKVIRDNERLLRELDERSRKTLKELEDLLRSLKDNEEVKDEVRKLIEEDKKVLDDVRRKSERTLREVEDVLRRVEEEVEKLLRKVEESAK

SEQ ID NO: 22852 - protein, 174 aa, Artificial Sequence; identical to SEQ ID NO: 22851
  Synthetic sequence.

SEQ ID NO: 22853 - protein, 174 aa, Artificial Sequence
  Synthetic sequence.
DEAEKLVEDVRRIVEKIRKELEDVVEESRELVERIRRELERVVEESERLVEELRKELEKGGDEEIVKEIERLNKRLLDELKKRVEEAIREDKKLLEDLEERVRRVIERLKELLDRLKDNEEVKEEVKKLLEEVRDVLRKVKKASEETLRDVRRVLEEVKRRSEETLKRVREEAT

SEQ ID NO: 22854 - protein, 174 aa, Artificial Sequence; identical to SEQ ID NO: 22853
  Synthetic sequence.

SEQ ID NO: 22855 - protein, 182 aa, Artificial Sequence
  Synthetic sequence.
SEVEDIVRDVKRLVEENHRRNEEIVRRDEDLVRRNNELNKRILEEVEELVRRLEDVARKIRDKEELKRRVDEIERRLEDLLRKVEEANRKSLEDSKRLVRTVTELNRESVETLKKLVDDLRKDRSDVEEALRTAEELIKRLEDSLREVKDRSKRSLDEMKKSADDVRREIERLIKRVRDTTK

SEQ ID NO: 22856 - protein, 182 aa, Artificial Sequence; identical to SEQ ID NO: 22855
  Synthetic sequence.

SEQ ID NO: 22857 - protein, 177 aa, Artificial Sequence
  Synthetic sequence.
SEVEKIVREVEEVVERIRKKSEDSLREVRRLVEEIKRRSEKTVEDDEKLVKDAKDELRRIKDKETLARLVEEILDRSRKSLEKNKRLLDEIRRRLETILKRNEDLLRRAEEELKRLREELDKEDAKRRIEELMKEVRDVSRRALKEIKDLLREVEEVSKKALKRSKDTVDEVREEVR

SEQ ID NO: 22858 - protein, 177 aa, Artificial Sequence; identical to SEQ ID NO: 22857
  Synthetic sequence.

SEQ ID NO: 22859 - protein, 177 aa, Artificial Sequence
  Synthetic sequence.
DEVEEIVKEVARVVDEIRRLSKESLDRVRKLVEDIERELRKIVKTDRDLVEEAKRVLKDIKDKDTLREVLERIKRLSEESLREADRLVTEIVEDLKRILDENRRLLEEILKRAKDLLDRVEKREVEKEIRRLVEEVKEVSRKVRKEIEELMRRVEEVVKTVKEESKKTVREVEETAR

SEQ ID NO: 22860 - protein, 177 aa, Artificial Sequence; identical to SEQ ID NO: 22859
  Synthetic sequence.

SEQ ID NO: 22861 - protein, 177 aa, Artificial Sequence
  Synthetic sequence.
DEADEIVKRVEEVVRRAKETLERILKRVEEMLDRIRKESEKTVREDEKLVEEVKDRLRKIKDKDTLRKLLDEVKKRSEESLERNKRLLEEIKRIAEKLLREVRELLERIRRTLDKLLKEVDSERLLREIKRLLKEVEDEVRRVEKAIKELVDRVKEVSDRALERSKRTVREVEERVR

SEQ ID NO: 22862 - protein, 177 aa, Artificial Sequence; identical to SEQ ID NO: 22861
  Synthetic sequence.

SEQ ID NO: 22863 - protein, 181 aa, Artificial Sequence
  Synthetic sequence.
SEVEEVKEDSKRTLKELKDVAKKVDDDSKRLLEELERVARKSIEDSKRLLDELRERGVPEDILRRAEKLVEEDIRRNEEIVRRIADRIREMNEDNRRLLDEVAKEVEKSIREVDEAAKRGVDEKELRRLVEDDRRLVEEVKRDSERLLDEIRKLVEEIKERLRRSVEELRRRVEEIKKTTT

SEQ ID NO: 22864 - protein, 181 aa, Artificial Sequence; identical to SEQ ID NO: 22863
  Synthetic sequence.

SEQ ID NO: 22865 - protein, 181 aa, Artificial Sequence
  Synthetic sequence.
SSVEKVKRDSERTLREVEKVIEKVDRDSERLLRDVERVITEADERSKDLLRRLEESGVPKDIVDRARRLIEELNRRNKALAEEIRELVERVNERNKRLLETIEKLVRDSIRRVDELAKRNVDDTDLRRLVEEDRKLVTRVKEESKRLLEELRRLVETVRKRSEDLLREIKKRVDEILRRTK

SEQ ID NO: 22866 - protein, 181 aa, Artificial Sequence; identical to SEQ ID NO: 22865
  Synthetic sequence.

SEQ ID NO: 22867 - protein, 174 aa, Artificial Sequence
  Synthetic sequence.
DEIKEVIDRITKVLEDNERVVRKLSEENKKVLDDIRRRAEEIIRRNEEVLRRIKELAKRNTDRRKALEELRKISEESKKDLDRLLKEVEEISRRSEKENRRLNKESEDVARELKKRIDNEELKKALDDILRRLEESNRKNIEDSRRILEDVERIVRRVVEVSKDIVRKAEEDVR

SEQ ID NO: 22868 - protein, 174 aa, Artificial Sequence; identical to SEQ ID NO: 22867
  Synthetic sequence.

SEQ ID NO: 22869 - protein, 174 aa, Artificial Sequence
  Synthetic sequence.
SEVEEVIDELRKVLEENKRRVEELSRENDDVLRRIEERLKKIEDELEKILKDVRDLKDNNVDSKTLLERVAERVKEAATRLRELLRELEEISEKSIRENDRLNKESEDMARDLRRRVDNERLKEEITRILEELTRINEENKRRSEEILDRVRKDVERVLKRVEDILKEIEDELR

SEQ ID NO: 22870 - protein, 174 aa, Artificial Sequence; identical to SEQ ID NO: 22869
  Synthetic sequence.

SEQ ID NO: 22871 - protein, 185 aa, Artificial Sequence
  Synthetic sequence.
SSVEELEERLRRVLERSERHLRKLEKKVEEVLDESRKNLTRLLRDVERVLRDVEETVRREKSKSVADEIRKEVKRLLDKVKKILKENRDKTKRMLEEVKEVLDRNEEETKRLEERVDKALRDEIKDERKARELKRTVKRLAEESRKILREVEEKVRKVAEDSERILEEVERTVKRVVEEIDRTVR

SEQ ID NO: 22872 - protein, 185 aa, Artificial Sequence; identical to SEQ ID NO: 22871
  Synthetic sequence.

SEQ ID NO: 22873 - protein, 185 aa, Artificial Sequence
  Synthetic sequence.
SKVEKLLRELEEVLKDSERHVREDSDRLRRVLEDSERHVRKVLRDVEKVLREVEDMVRKRKDRDVIDKIRDKVERLREKVERALERNKRKLDKALEDSNRSDKKNEDKLRELKRRVDEVLRDDIKDEEKARRLEERVEEIVRESERTSRENNKKSRDIIKTSEDILREAADRVREVVERIRRTLT

SEQ ID NO: 22874 - protein, 185 aa, Artificial Sequence; identical to SEQ ID NO: 22873
  Synthetic sequence.

SEQ ID NO: 22875 - protein, 184 aa, Artificial Sequence
  Synthetic sequence.
KEVEEVIERSKKSNEENERRLRKILEEARRINEENEKLLRKILEEAKRVVEEVRRILKDNKEKKERIKELLERLEELLRKVKEDVERSVRELAKLLKKVAEEVRKSLEDNKRTADRVVERIGEEKKEELDKLREESKKILRHSERLLKEVEEEVKRILEHSEELLRRVEDKVRRLLKEIEDALR

SEQ ID NO: 22876 - protein, 184 aa, Artificial Sequence; identical to SEQ ID NO: 22875
  Synthetic sequence.

SEQ ID NO: 22877 - protein, 184 aa, Artificial Sequence
  Synthetic sequence.
DEVEEVEKKVDKIDKENEDLLRKVIRDAERINEENTRLLEDILRKAKKMVDDVREILKDRKDAKEDIDRLLKELKKLLEEVAEEVKKSLEKLKELLEKVKREVDESLKRLEDELRDVVRKIGKDLEEEVRRVAERVKEVVKHSRELLKRVEDMVRRIVEHSKRLLDEVRERVKDLLRKIAEARK

SEQ ID NO: 22878 - protein, 184 aa, Artificial Sequence; identical to SEQ ID NO: 22877
  Synthetic sequence.

SEQ ID NO: 22879 - protein, 181 aa, Artificial Sequence
  Synthetic sequence.
DEVREVVRRLEEIVRDVNKKNRESVREAERLVDRLREILEETSRRLKELVDRVKELIKGGTDSRDVRRVDRELEKIITDSDDTVRKIREELKRKVEDDLRRTAEIIKKLKDTVARVSERISNEKEARELEDAVRKLIERLKRSAEEVKKRVEELDEEIRRVVEEDRRTIKELKEEIDRADK

SEQ ID NO: 22880 - protein, 181 aa, Artificial Sequence; identical to SEQ ID NO: 22879
  Synthetic sequence.

SEQ ID NO: 22881 - protein, 181 aa, Artificial Sequence
  Synthetic sequence.
DEVEEAVKRIEDLVERLRELLEKTSREIEKILKESEDKLRESSDRIRRLLDELKKLIENGADDELVRKMLKDIKDILEESERTSKETLDRIREILKKSEDLVREVLERIERLLEDVARRITDEEKLRKAEDTVRRVIKDVRKMLEDDRRTVEEVIRRDREALEKDRKTVDDVIEDVKRVAK

SEQ ID NO: 22882 - protein, 181 aa, Artificial Sequence; identical to SEQ ID NO: 22881
  Synthetic sequence.

SEQ ID NO: 22883 - protein, 181 aa, Artificial Sequence
  Synthetic sequence.
SEVDEAVEEIKRILEESKKRLDETSEEIKRILEDSERRLRESSKRIRELVKELKKRIDGGTDDREVEKVEKEIEDILRESEEISKDTEDKIREILKRSREISETTIREIRRLLEDIERRITDKDKLTRIREVVDKVVKEDEDALREDERTVREVIKRDRDLLEEDRRTVEDVIRKVRETAR

SEQ ID NO: 22884 - protein, 181 aa, Artificial Sequence; identical to SEQ ID NO: 22883
  Synthetic sequence.

SEQ ID NO: 22885 - protein, 181 aa, Artificial Sequence
  Synthetic sequence.
SDAEKVVKRIKEIVEDSTRKVRDTSRDIRRILDESRKMLEDVVREIKDLVRRLEELIRGGVSEETVEKVLREIEELLKELKKTSERTLKEIEDILRRSEEESRRTIREIEELLRRLEERITDKDTLDKVREDAERVLEEDKKVADDDRKTVEDVIREDKRLLKRVEEEVKRVIKEVDDAAK

SEQ ID NO: 22886 - protein, 181 aa, Artificial Sequence; identical to SEQ ID NO: 22885
  Synthetic sequence.

SEQ ID NO: 22887 - protein, 181 aa, Artificial Sequence
  Synthetic sequence.
SEVDRAVETIRRILEESEKIIRKVVREIEEILDRSRRLLEKSSEEIEDLVRRLKELIEGGTDETSVEEVLRRIEEILKESERTSTETLKTIEDLLRELERISRKTLEEIRRLLEDVKRRITDERLLREAEKDVRRVVEEDEKVLRDVARRVEEVIKADKKLLREDEKTVREVIERVKETAR

SEQ ID NO: 22888 - protein, 181 aa, Artificial Sequence; identical to SEQ ID NO: 22887
  Synthetic sequence.

SEQ ID NO: 22889 - protein, 181 aa, Artificial Sequence
  Synthetic sequence.
DEFREAVRRIKEIIDDSRRKLEKNVKENEELLKRSDDELRKSSEDIKKLLEELRRLIEGGADERIVKRILEEIEDILRKSEKRSRETLEESKESLRRSEKTSRETEKRIKELLEELAKRIKDEKSLREVEERVERLLEDDRRLLEENARRVEDLIRKDKEALDRDRKTVEDVKREVEKDAR

SEQ ID NO: 22890 - protein, 181 aa, Artificial Sequence; identical to SEQ ID NO: 22889
  Synthetic sequence.

SEQ ID NO: 22891 - protein, 181 aa, Artificial Sequence
  Synthetic sequence.
SEVDEVVKRIAEIVKTSKDELREAVKRIEDIVRRSEKMVRDNLRENERLVRELDKLAKGGADERVVEEIKRRSEDSLRKSEELSKKTLDEIRKLLDDVRKRSKETLDRIRELLERIKKKIKDKEKLDRVTETVRRLIEEDKRALEDVERKVEDVIRRDREVLERNRREVERLIKEIEDKRR

SEQ ID NO: 22892 - protein, 181 aa, Artificial Sequence; identical to SEQ ID NO: 22891
  Synthetic sequence.

SEQ ID NO: 22893 - protein, 181 aa, Artificial Sequence
  Synthetic sequence.
KDAERAVEEIRKILEDSKEKMERNVRENEKLVRDSRRKLEENVERNEKLVRDLKRLKEGGADDEIVRRIKEESKKSLKESEKTSKKTLEESERSLRESEKVSKKTIDEIRRLLKEIRERITDKDTLKRVTDEVRRVVEEDKRVLEENRRRVEKLIEEDKRALDENRERVRKLIEDIDKDAT

SEQ ID NO: 22894 - protein, 181 aa, Artificial Sequence; identical to SEQ ID NO: 22893
  Synthetic sequence.

SEQ ID NO: 22895 - protein, 181 aa, Artificial Sequence
  Synthetic sequence.
DEVEDAVEKLKRLVDELERLLREAVRRIEKILEDSTRKVRKNLEENKELVKRLRELIKNGVPEDSVRKVLRESKESLRRSEETSKETLERIKRLLDEVRELVERVKRELDRLLRELEKRIKDKDLLRKVAEVVRRLEEEIRRLLEEAKRVVDEVIKKDRTVMERNREEVERLIREIEETAR

SEQ ID NO: 22896 - protein, 181 aa, Artificial Sequence; identical to SEQ ID NO: 22895
  Synthetic sequence.

SEQ ID NO: 22897 - protein, 181 aa, Artificial Sequence
  Synthetic sequence.
SEVDEVVERIRRIIKKSKEELDKAVRDIEEILRRLEKELRDNVRENEKLVEDVRRAIEGGMDRKDVKRVLKESEDSLRESEKRVEEVLRDIKRRLKEVRETSRRTIEEIERLLREIARRITDKDKLERVSREAKRVLKEDEEALRDVEKKVTDVIEAVKKMLEDNRDRVRRLIEEIKRRAT

SEQ ID NO: 22898 - protein, 181 aa, Artificial Sequence; identical to SEQ ID NO: 22897
  Synthetic sequence.

SEQ ID NO: 22899 - protein, 184 aa, Artificial Sequence
  Synthetic sequence.
DEIREAVKRIRRLLEESHRENKEIVDRLRKLVEESHRKNEKLKRELEELVKKLKEIIDKDKDKDTLTKIVEDIKRRLDEILKRADEENERINRKLREILEEVRRRNEEVNKEIKDLLDDIRRRVDSEDLKRAEEEIRKVSEDNKRSVDRVREVVKRLSDENRRSLEEVREVVKRLIREVEEARR

SEQ ID NO: 22900 - protein, 184 aa, Artificial Sequence; identical to SEQ ID NO: 22899
  Synthetic sequence.

SEQ ID NO: 22901 - protein, 184 aa, Artificial Sequence
  Synthetic sequence.
DEIRKVVKEITDLLKKSNDKNRKVVEEIRDLLRKSKKLADELVERLRKLVEDLRRRIDKLSDKRTAEDIVRRIIEELKRILKEIEDLARRINREIERLVEEVERDNRDVNRKIEELLKDIARRVDSEDLKRVEERAREVSRRNEESMRRVKEDADRVSEKNKEVLDRVREEVKRLIEEVRETLR

SEQ ID NO: 22902 - protein, 184 aa, Artificial Sequence; identical to SEQ ID NO: 22901
  Synthetic sequence.

SEQ ID NO: 22903 - protein, 184 aa, Artificial Sequence
  Synthetic sequence.
DRIRDVAREIRELLKRSNDENRKVVEEVRRLLKESNDTNKRVVDEVRELLERLKEIARRLKDKDTLKKEVDKIIRELERVMEDVKRKNDEINERLKKLLEDVKRKNDDVNRKIDELLKTIEREVDSEDLKRIRREVEKVSEDNKRSAKEVEDEARKVSEDNERSVRDVKEKADRVIKEVEDEDR

SEQ ID NO: 22904 - protein, 184 aa, Artificial Sequence; identical to SEQ ID NO: 22903
  Synthetic sequence.

SEQ ID NO: 22905 - protein, 178 aa, Artificial Sequence
  Synthetic sequence.
DEERKIKRVLDEVDKHSKRVIAEAKRVVDEVLREVEKVVRRNKEVLDEILREVKRILDEGKITEEVLKEAEKRLRDNKRRLEELLRDAERRLRDIKRELERLLEESRKVVEDVERKVRKDGAREELIKTIRKVNKEIEDRVRDLIKTVRDILRRIEEEVRKSIEDSKRLLRELEARAE

SEQ ID NO: 22906 - protein, 178 aa, Artificial Sequence; identical to SEQ ID NO: 22905
  Synthetic sequence.

SEQ ID NO: 22907 - protein, 176 aa, Artificial Sequence
  Synthetic sequence.
SVVEDLKRTVEEVVKKSEEILKEDRKTVEKVVEEVKKSDKEDRDDVDRVVKEVRKRIRDKRLEDELKKALDTNRKLVRESTEKLKKLLEDNERANKRNKEELDRLLDEVREVLRMDKKDLADKVKKDAEEVLKRSKEHVDRSIDRTREILKRLRETNEESIKRTRDILRKIAEEAR

SEQ ID NO: 22908 - protein, 176 aa, Artificial Sequence; identical to SEQ ID NO: 22907
  Synthetic sequence.

SEQ ID NO: 22909 - protein, 176 aa, Artificial Sequence
  Synthetic sequence.
SVSEELKKKVEKVARDVERSLERDATEVTKVVEEVKKSDRKDEETVKRVVKRVDELIRDERLKEELERALRDNERLVRESTKNLEDVKRKNEKILREIRKKLRELLEEVAKALRSDKREVAEKVIRDAEKVLDDIRRMNEESIRDTRRVLEENKRKNEESIRKTEEILRRIEEESR

SEQ ID NO: 22910 - protein, 176 aa, Artificial Sequence; identical to SEQ ID NO: 22909
  Synthetic sequence.

SEQ ID NO: 22911 - protein, 184 aa, Artificial Sequence
  Synthetic sequence.
SEVDEVLKELERINRENHREVEELLRRLERILRESKKHIKEVIEDLRRRLKELEDEVRRRKDEDVRRRLRELVERIEREVERVIRRNDKLVKEAEERVKEAVKRLERSAEELRKKVTRVVERLSDEKKVRELEEEARRVKRSTEEVIKRLRDSVEKLVKDSERVLRELKKEVERVVEEIDKMIK

SEQ ID NO: 22912 - protein, 184 aa, Artificial Sequence; identical to SEQ ID NO: 22911
  Synthetic sequence.

SEQ ID NO: 22913 - protein, 183 aa, Artificial Sequence
  Synthetic sequence.
DEVEKALEESKKSNEENHRKVKKVLESAKDINRRNHDLVRDVIRKLEEILRRIEKVVREGRDKREIKRIEEEIKKTVKKVVEDLRKSLDDLRKEVTKVLEDLKESLKRNEDRMRDVVEKIGRDFDKEVTELRESSRRSIESTREAVRTLEEAVREVIKSTDEAVKRLEATVKRIEEEIRKSMK

SEQ ID NO: 22914 - protein, 183 aa, Artificial Sequence; identical to SEQ ID NO: 22913
  Synthetic sequence.

SEQ ID NO: 22915 - protein, 183 aa, Artificial Sequence
  Synthetic sequence.
DDVERVLKKSRDSNRENHEKVKRVIEKSDRSNEDNHRLVEDAIRKAEEILEEVERLVTAGEDKRKAEEIVKELRDLVREVKRRLDESLKRNEEEIRKVVEELERSLDKNRKEIREVLERIGRDFKEEVDELRKSSEDSIRSTEDVVRKLEETSKRSIRSTEDVARKLEEAVRRIERRIRERTR

SEQ ID NO: 22916 - protein, 183 aa, Artificial Sequence; identical to SEQ ID NO: 22915
  Synthetic sequence.

SEQ ID NO: 22917 - protein, 183 aa, Artificial Sequence
  Synthetic sequence.
SEVEEVLKRSKESVERVDRDVRRVLRELEDLNRKNHKRVEEVIRDAERILREVEDMVRRGVEKEKLEKIVRDLRRTVEKVLKELRDSLREIKRKVDEVLERLERIIRENEELIRRALERIGRDLDKEVDELRKSSEKSVEDIKRVVDRLRDSARKIIKSTEDVVKELERRVREVIKRIKEEAT

SEQ ID NO: 22918 - protein, 183 aa, Artificial Sequence; identical to SEQ ID NO: 22917
  Synthetic sequence.

SEQ ID NO: 22919 - protein, 187 aa, Artificial Sequence
  Synthetic sequence.
SEIEEIIKRIEKLLRDDEKKIRDSIKRSEDLLREANRENKESIDRVRELLEKVKRLRERIDSEEVRERVERVLREIERLLEEDRKRNEDISRKNEKLLRETEDESRKSIETIKRLLEKVRTDSGDKKAEEEVRRLEKRVRDVLRELEKTLKRVTEVHKETTKENEKSARRVKREVEKVIEEVERTRT

SEQ ID NO: 22920 - protein, 187 aa, Artificial Sequence; identical to SEQ ID NO: 22919
  Synthetic sequence.

SEQ ID NO: 22921 - protein, 187 aa, Artificial Sequence
  Synthetic sequence.
SEIEEIIRRIEELEERLKRELDRSIRTSEKLLEDAREINKESIRRVEKLLEEIRRVVDKIDSEEVTRLVEKVLRDIERLVTEDEERNKRMTKRNEDLLKRIEEEVKRIIREIEETLRKVKEDSGDKKAEERVRALEKAVKDVLESLKRLLDEVRKRHKESSEDNERSLKRSKEEAEKVIKAVEDERR

SEQ ID NO: 22922 - protein, 187 aa, Artificial Sequence; identical to SEQ ID NO: 22921
  Synthetic sequence.

SEQ ID NO: 22923 - protein, 187 aa, Artificial Sequence
  Synthetic sequence.
SEIEDIIRRIRKLLEEDKEKIERSIRESRRLLEEAKRINEKSIEDVKRLLREIEDVVDKIDSREVEDLVRKIEEEVKRLVDEDRKRNEDMTRKNEELLKDVTEKSKKSIRDIEKLLEEAARRSGDEKMREKVERLREDVDRVRKELEKTLETVTRSHKRSSEENKRSLEESERTARKVIEDIRRRDR

SEQ ID NO: 22924 - protein, 187 aa, Artificial Sequence; identical to SEQ ID NO: 22923
  Synthetic sequence.

SEQ ID NO: 22925 - protein, 187 aa, Artificial Sequence
  Synthetic sequence.
KDIEEVLKRIKDLLEDIRRRLKESEERSRKLLEEAREINERSIERVRRLLEEIRRLKEEIDSKDVRELIEKVLKEIEDLLRDDKRKNEDMTRKNEELLKKLKKEIEDVLREIKELLDRARKRSGREEMERKVRELERAVREVIKEVEKLLTDVARKHKKVSRDNKESLRRSEEEARRVIRAVEETDR

SEQ ID NO: 22926 - protein, 187 aa, Artificial Sequence; identical to SEQ ID NO: 22925
  Synthetic sequence.

SEQ ID NO: 22927 - protein, 176 aa, Artificial Sequence
  Synthetic sequence.
STLETVEKKVEEVIRENEKSMRESEEKVDRSTKRIEDVLRRLEETIRKTSDDIAKDVKGERVKEVLEENRRLLEEAKKLVDEVLETNKKLLEDDKRLNEEVSKTLKKLLEEIKRVDTREDATRVIEEAKRILDEARKLNEETIRRSEELVRRIERVIEEIIKRSEKLLEDVRRESK

SEQ ID NO: 22928 - protein, 176 aa, Artificial Sequence; identical to SEQ ID NO: 22927
  Synthetic sequence.

SEQ ID NO: 22929 - protein, 176 aa, Artificial Sequence
  Synthetic sequence.
SVLDDVRKKVEEVLDRNRELADRSRRTVEEVLRENERVMEESKRTVDEVIKRVAEKLKGEKVEEVIRRLEKLAEEDRRRNKEVTEELKRLLEELRRKNEEVTERLKRLEEEIKRVDVREDAERMIERLKRILDRVEEENRRAIEELREVLERVRDDNRRTIEELERILKRVEEESR

SEQ ID NO: 22930 - protein, 176 aa, Artificial Sequence; identical to SEQ ID NO: 22929
  Synthetic sequence.

SEQ ID NO: 22931 - protein, 176 aa, Artificial Sequence
  Synthetic sequence.
STVETVREEVERVLKHSDDLIKEVEDVNRRVEEEIKRVIRELEEENERLVREVRKKVKGEILKEIEKRLRDNSEKVREVAERAKKLLEENTRRVKDILRESRKLVKDLLDEVERVTREEEAREIIKRLREVNKRTKEKLDELIKHSEEVLERVKRLIDELRKHSEEVLEDLRRRAK

SEQ ID NO: 22932 - protein, 176 aa, Artificial Sequence; identical to SEQ ID NO: 22931
  Synthetic sequence.

SEQ ID NO: 22933 - protein, 176 aa, Artificial Sequence
  Synthetic sequence.
DEVERVAKEVEDVLREVEKLIRDVRRKVEEVLKHSEEVAKRVRDTNRELVKEVERDIKSEELKEARKALEDNSRKVKEILDESEKLVRELLRRVEELLKKVRKEIEDLLRKVKDVKDEKELRDIIRRLKEVLDKLKKDLEDIIRRLEEVNRESERLAREAIRHSEEVLDKLRKDSK

SEQ ID NO: 22934 - protein, 176 aa, Artificial Sequence; identical to SEQ ID NO: 22933
  Synthetic sequence.

SEQ ID NO: 22935 - protein, 175 aa, Artificial Sequence
  Synthetic sequence.
REVEEVKKRIREALEESERVIRENKKKNEELLDRVRKEIERNKKKNEEVLKRAKEVTKAGRPKSRVLEEIRRIVEESRRHLDKVLEDVERILRDSKRHVDEVNRKSETIARELKKKVKDVEDVKRKIDRMVEESRKLVEDLKRESDRVEEEVRKLVKTIKDEITRSLDEVRKDAE

SEQ ID NO: 22936 - protein, 175 aa, Artificial Sequence; identical to SEQ ID NO: 22935
  Synthetic sequence.

SEQ ID NO: 22937 - protein, 175 aa, Artificial Sequence
  Synthetic sequence.
SEVDEVRKDIERILRKSERDIRRNKEENKRLLDEVRRRIEENRKENEDLLKRIEELRRAGRPESEVDEEVRKIIEKSKEHVDRVLEEIEEELRRSKEHLKRVNEESEEIAKELKKRVKDVEEVKKEIDKAVEDSKRLVEDAERVSDEVRERVRRLVERLKEESDRVEREVEKRTT

SEQ ID NO: 22938 - protein, 175 aa, Artificial Sequence; identical to SEQ ID NO: 22937
  Synthetic sequence.

SEQ ID NO: 22939 - protein, 185 aa, Artificial Sequence
  Synthetic sequence.
SEVEEVLRRAEKLSEDNKRENDESLERLRRIVEKVREENEESVKTLEKILKEVEEVVRRNKEVQEELRKIVEELRDLIDKDLRRTDDIIRELRKRIEEDLKRSKDIVKEIRDTIREVVERLKKDDKKEVIKRLEDEVRRLEEDNKRSIKKSEDEIRKLVERLKRSAERSDEVIRKLEKDAEDLIR

SEQ ID NO: 22940 - protein, 185 aa, Artificial Sequence; identical to SEQ ID NO: 22939
  Synthetic sequence.

SEQ ID NO: 22941 - protein, 181 aa, Artificial Sequence
  Synthetic sequence.
DEVERILEDSKRLVDELRERVERVIEESKRLLDDLRRKVEEVVRRLEKIVEDLKRMIEGGVDREVVRKVERDLKELVREVERRIEKVSKENTELLDRVEKEIRKVVRTNSELAKEALRRIGDEDKVRELKETADRSNEEIKRVLEKIKRMIEDTNRKIKKLLEEIRDVARRVLEEVREVAR

SEQ ID NO: 22942 - protein, 181 aa, Artificial Sequence; identical to SEQ ID NO: 22941
  Synthetic sequence.

SEQ ID NO: 22943 - protein, 181 aa, Artificial Sequence
  Synthetic sequence.
KEVEDVLRESKRLVEDLERRSERSIEESKRLLKELEDLVEEVIRRSEESIDRLRELIKGGTSEEAIKEVKKTNERLIKEVERLIREVSKRNTDLVEENRKLVEKVVRDNSRLLEELARRIGDEKKVRDAEREARDSNDKIRRSLEKVERVVRETNRRIKELLEKIERVIRDTDRKIAEEAK

SEQ ID NO: 22944 - protein, 181 aa, Artificial Sequence; identical to SEQ ID NO: 22943
  Synthetic sequence.

SEQ ID NO: 22945 - protein, 181 aa, Artificial Sequence
  Synthetic sequence.
SEVEKIVRDSEKLLEDLKRELEKVIKDSDDLVRELKKRVTEVLERLRRIVEELRKLIEGGASEEVLERVLRRLEELIRRVEEEIRRVVEENSKLVEELKRRIEEVSRRNTELVKDAARKIGDEEKVRRLEKEARRTNEEIRKLLEKVDEVARRSNERIKAVLEEIKREIEKLKREVEKDAK

SEQ ID NO: 22946 - protein, 181 aa, Artificial Sequence; identical to SEQ ID NO: 22945
  Synthetic sequence.

SEQ ID NO: 22947 - protein, 181 aa, Artificial Sequence
  Synthetic sequence.
SEIEEVLKKSKKLVDDLRKEVEETIRESKKTVDDLDKEIKEVVRRSEESLDRLKKLIDGGSSEETIKKVVRDNERLVKEVLKSIEEVLKRNKKLNDDSNERAKRVSDTNTRLVEEVVRRIGDERKVDEIRRAVEETNEEIKRVVDEDNKAVKRSLEEIERVAEEIKRVAEETLKAIEDARR

SEQ ID NO: 22948 - protein, 181 aa, Artificial Sequence; identical to SEQ ID NO: 22947
  Synthetic sequence.

SEQ ID NO: 22949 - protein, 182 aa, Artificial Sequence
  Synthetic sequence.
DEVEELVRRLEELVKRSRDTNRKIIKEIRELSERLKRELEKIARELEKLVEDLKEEVKRLKDKDTLRKMIRDVEEKIRRLLEKVERLVRESLRRHEKLLDDVRRTNKEISDRLKTLLDEIRRRNVDVEKIEDVVRRLLEENERVLRRTEEEARRVLETNRDLLRKIREVVDRLEKEIREAEK

SEQ ID NO: 22950 - protein, 182 aa, Artificial Sequence; identical to SEQ ID NO: 22949
  Synthetic sequence.

SEQ ID NO: 22951 - protein, 182 aa, Artificial Sequence
  Synthetic sequence.
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 22952 - protein, 182 aa, Artificial Sequence; identical to SEQ ID NO: 22951
  Synthetic sequence.

SEQ ID NO: 22953 - protein, 182 aa, Artificial Sequence
  Synthetic sequence.
SEADEMLRRLKELVDRSRDTNRKILKRSEDLVRDSKKKNDDIIRELRRLLEELRELARRLKDKDTLRKIVEEVKERIRRLLEEVERTNREVTERNRELLREVEERNRRISKELKDLLREAEERNVKTDDVRREVERLLRDNKRVLDETRKAAEESTRRNKKVLEESREVVKDVLKKIEDTDR

SEQ ID NO: 22954 - protein, 182 aa, Artificial Sequence; identical to SEQ ID NO: 22953
  Synthetic sequence.

SEQ ID NO: 22955 - protein, 182 aa, Artificial Sequence
  Synthetic sequence.
DEVREVAERLRRLVDESRKRNEEVIKESEALVDRVRKTNEEVMKRLRELIDKLEKDIRRLKDKKTVEKIIREVLKKIDELLKRVERTNREISKENKRLLDEVRKTNEEISRRLKKLLEDIRRRNVDVETIERVVRELLEENKEVLRKTEEMVKRSTETNKRLLERSKEVADRLRERIKEAAK

SEQ ID NO: 22956 - protein, 182 aa, Artificial Sequence; identical to SEQ ID NO: 22955
  Synthetic sequence.

SEQ ID NO: 22957 - protein, 182 aa, Artificial Sequence
  Synthetic sequence.
DEVDELLKRLRKLVDEVRKENDKMVKESKRLVEDLKRKIDEIIERIERLLEELEKILKDTEDKDTLRKIVEEIKRRLRRLLEELKRIIEKALRDNKKLLDEVRKRNKEISDELRRLLEEIRRRNVRVEDIEREAERLLRENEELLRRSEEVIRRSTEKIKKVLRDAEERAREILKRVEDAAK

SEQ ID NO: 22958 - protein, 182 aa, Artificial Sequence; identical to SEQ ID NO: 22957
  Synthetic sequence.

SEQ ID NO: 22959 - protein, 184 aa, Artificial Sequence
  Synthetic sequence.
DEVEEVKKKLREIVKRDRDLIERVREELKEILDRNREINRRAIEDLKRILEEVDELVKRGTDKKDLEKILRDIERLVEEVRRRSRELVERAKRLIEKVVTDSKKTVERIRRDVEKVLDDLRRKNKEELIRDVERVVREVLRRIEKSIRDLDRVIRDVLDKSRELIKRSEDVAKRVVDTLREKAR

SEQ ID NO: 22960 - protein, 184 aa, Artificial Sequence; identical to SEQ ID NO: 22959
  Synthetic sequence.

SEQ ID NO: 22961 - protein, 186 aa, Artificial Sequence
  Synthetic sequence.
DEVETVKKELKELADEVKERNERSIRDSERLLEEVKRRNEKSIRDLERLVEELEDVLRKRGSEDEDVKRKVEEVDRRIDKLAEDDKRINEKVLKENSDLVKRDEDINRKILEDVRRLVEKVRREIGDEKKVKEVTDEVKKVLDEIRELDKRSRDAVRRTNEEIKRLDKESKDVVDRVKKKVEDAVR

SEQ ID NO: 22962 - protein, 186 aa, Artificial Sequence; identical to SEQ ID NO: 22961
  Synthetic sequence.

SEQ ID NO: 22963 - protein, 186 aa, Artificial Sequence
  Synthetic sequence.
REVEEIIERLKKLLKEIAERNTESIKELEELVRRIAEDNKRIIEELRRLLEELADVVRKKGSESREVEEKVREVLRRLEKLLEDVRRINEDALRKIEELVKRDADENRTVLKRLEELVRDVARRIGDEKKVREVRKVAEEVLRAIEELDKRSRDAVRRVTKRVKDLDEETKRVVEDVLRRIEELMK

SEQ ID NO: 22964 - protein, 186 aa, Artificial Sequence; identical to SEQ ID NO: 22963
  Synthetic sequence.

SEQ ID NO: 22965 - protein, 186 aa, Artificial Sequence
  Synthetic sequence.
SRVEEIIEDLRRLLEEIRKENEDSIRRSKELLDRVKEINDTIIKELERLLKDIEKEVREKGSESEEVKKALRRVLEELEKLLRRVAEINEEVLRRNSKLVEEDERRNREVLKELKRLVEELMREIGDEDKVRKVREVAEKVLRDIDKLDRESKEAFRRTNEEIRKLDEDTRRVAERVKKAIEDLAK

SEQ ID NO: 22966 - protein, 186 aa, Artificial Sequence; identical to SEQ ID NO: 22965
  Synthetic sequence.

SEQ ID NO: 22967 - protein, 186 aa, Artificial Sequence
  Synthetic sequence.
SEVEEIIRRLEELVREVAKRNEDIIKRSRDLIRKVKEDNRRSEEELRDLSRRIADIVRKKGSESEEVKRELDKALRRLEELIKRDAEINEKVLRENSTLARRVEEINERILRELKKLVDDIARKIGDERKVREVRRVAKKVLEDVKTLDDKTREVARRTNEDIKRLDEKSRKVIEEVRREIEELKR

SEQ ID NO: 22968 - protein, 186 aa, Artificial Sequence; identical to SEQ ID NO: 22967
  Synthetic sequence.

SEQ ID NO: 22969 - protein, 186 aa, Artificial Sequence
  Synthetic sequence.
SEVDEIIKELERLLREIARENERIIRESRKLADEVRKRNEDAIRKLEELVRRLADMVRRKGSESEEVKKLIEDVLREIERLLKRIEEENREVVKRNSELVERVRRINEEILRRVKELVEKIARDIGDKDKVTKVKKVADDVLREIKKLDDETRRVIEDTNKKIKDLDKKTRDVVRKVLEEVKKLEK

SEQ ID NO: 22970 - protein, 186 aa, Artificial Sequence; identical to SEQ ID NO: 22969
  Synthetic sequence.

SEQ ID NO: 22971 - protein, 186 aa, Artificial Sequence
  Synthetic sequence.
SDVEDVIRKLETLVDDLRRKVERIKERSRELIKRIAEENRKVIEELERLLEELADVVRRKGSESEEVDRTAEEVRKKVKELLDRVARSNEEILKENSKLLDDIRREIEEVERRIKELAKDIARKIGDEKKVRDVRRVAEKVLREVRRLMEEVERVARKTNRDIERLDEETRRVVEKVRKEIEDLRR

SEQ ID NO: 22972 - protein, 186 aa, Artificial Sequence; identical to SEQ ID NO: 22971
  Synthetic sequence.

SEQ ID NO: 22973 - protein, 176 aa, Artificial Sequence
  Synthetic sequence.
SAKDKIAEVAKRVLTENKKLLEESEEVARRTSEESKRLLKESEDVVRRVLDEIRREIKGEKAKKVLDTLKEILDRDRKLNEESHERNKRLLDEVRRMNEEVSKELRRLLEEVREIRDERLIEEVIRRLEELLKEVKKKNEEVIRRSKELIDRDRDLNRRSIEELERLIREVRKESK

SEQ ID NO: 22974 - protein, 176 aa, Artificial Sequence; identical to SEQ ID NO: 22973
  Synthetic sequence.

SEQ ID NO: 22975 - protein, 176 aa, Artificial Sequence
  Synthetic sequence.
SAKEKIKEVAERVEKRNKELLEESERVIKEVSERSERLLDESRKVVKRSTEEIRDKIKGEEAEKVLRDNEDLLREDEELNKTSHERNKRLLDEVRKRNKRVSDELRKLLEEVSRIDDEELIREVIERLKELVDRVEKENRKAIETSRRLLKEDEDLNRESIKRSEELVKDVRRRST

SEQ ID NO: 22976 - protein, 176 aa, Artificial Sequence; identical to SEQ ID NO: 22975
  Synthetic sequence.

SEQ ID NO: 22977 - protein, 176 aa, Artificial Sequence
  Synthetic sequence.
DARKELEEVVRRVEEEIRRLLKDIEDVAREVNRRSEKLLRETEEVIRRSTEEIKRDVKSELVKEILERNEELLRRVKKLNEEVNEELRRILDEIRRLVEEVEERIKKLLEEAKRVNERERVKEIIERLRRLVEELKKLVDEVRKRLEDVVRELKERNKKVIDDSKDLVRRAREESR

SEQ ID NO: 22978 - protein, 176 aa, Artificial Sequence; identical to SEQ ID NO: 22977
  Synthetic sequence.

SEQ ID NO: 22979 - protein, 182 aa, Artificial Sequence
  Synthetic sequence.
DFSERLDEVLRKVRTDIKKLVEKVRRVVEDSRRRVEKLVEDVRRSSEEVLKTVKELLDRGLIEERVVEDVKRIIEETKEKLDRALEKAERDLRDSERHLDEVLKEIEKIIEEIREEVERLGGTDEVVRRLEKRLRDALKEAEDKVRRDEERNREVLERLEKIVRDLHRENEKAVEDVADRAR

SEQ ID NO: 22980 - protein, 182 aa, Artificial Sequence; identical to SEQ ID NO: 22979
  Synthetic sequence.

SEQ ID NO: 22981 - protein, 182 aa, Artificial Sequence
  Synthetic sequence.
DLSEEVKRVIEEVRKRIEELVDEVRKSTEEVIKRVRRLVEEVERVVEDSRRKVDKLLKEGRITEEVVKRAEKILRDSKKHLEEVERKVRDDLRRSEEEIRRVLKEIEDRLRELKKKIDKLGGTEEVVRRLKEELEKALRDAERIVKELHEENRKVLEDVKRMVDEDKKKNERVVDEVRRDAK

SEQ ID NO: 22982 - protein, 182 aa, Artificial Sequence; identical to SEQ ID NO: 22981
  Synthetic sequence.

SEQ ID NO: 22983 - protein, 182 aa, Artificial Sequence
  Synthetic sequence.
SLSEEVKKVIREVEEDVKRLVRELRESSERVLKEIKKLVDEVRRVLEESKERVKKLEREGKITDEVVREVEEEVKKSKENLDRVLEEIRKILERTKEKVDRVLEEIRKILKDIEDRIEELGGTDEVVRRLKKRLKEALDRLRDIARKLDKENKEALDEARRIVEENKRRNEKVVEDVERRAE

SEQ ID NO: 22984 - protein, 182 aa, Artificial Sequence; identical to SEQ ID NO: 22983
  Synthetic sequence.

SEQ ID NO: 22985 - protein, 185 aa, Artificial Sequence
  Synthetic sequence.
DEVEELKKDLKRVLEEVRKIVEDIHRTNEEVLREVEKIVEDIHRENKEVLEKVEKIMRELKDVDEALRRLKEEVERVLKRSEDKIKDLLDKVEKVLEESERRVRRLLREVERALRRVAEEVRKIDDEELVREVKRVVDELEKEVRDLLRRLKESTDKLREDVRRLAERLRDSLREMERDVREKTR

SEQ ID NO: 22986 - protein, 185 aa, Artificial Sequence; identical to SEQ ID NO: 22985
  Synthetic sequence.

SEQ ID NO: 22987 - protein, 185 aa, Artificial Sequence
  Synthetic sequence.
DEVERLKRELETVLRDVERIVEEIHRENKKNLDKVKKIVEEIHKENREVLEKVRKIMEELKDDDETLRRLLEEVDEMLDRSRRKIEELLRESKESADRSRKKVRDLLERVKEVADRVREEVKRIDDKKLVEEVEEVVKRVEEAVEELARRLEKSTRDVVEESKKLARELEKSLEEVKEEVRKLIT

SEQ ID NO: 22988 - protein, 185 aa, Artificial Sequence; identical to SEQ ID NO: 22987
  Synthetic sequence.

SEQ ID NO: 22989 - protein, 185 aa, Artificial Sequence
  Synthetic sequence.
KELEELIKRLKRVLEENRDIVRKIHEDNERNLDELRKIVERIHKENKRVLEEVKKIFEELKDDDKVLRELLEKVKRVADESRERVKRALERSKESVRESEERVKEALERSKKMLDDVREDVRRIDDERVVREVERVIKKLEDDSRKTVRDLEESTKEVEKRSKELADELEKSIEDLERRVDEDTK

SEQ ID NO: 22990 - protein, 185 aa, Artificial Sequence; identical to SEQ ID NO: 22989
  Synthetic sequence.

SEQ ID NO: 22991 - protein, 185 aa, Artificial Sequence
  Synthetic sequence.
REVEELKKELERVLKKVADLVEENERRNRKNLEDLRRIAEEIHRRNEEVVKRVRDTLERLRDVDEVLKRLLDEVEEVLKESEKRVRDALRRSEESVKKSEEDVKRILDEVKERLDRVREKLKRIDDEKLVRDVERVVEKVERDVKRLADRVREVLKESSDRSRELVERLRESLRKAREEVRKAIE

SEQ ID NO: 22992 - protein, 185 aa, Artificial Sequence; identical to SEQ ID NO: 22991
  Synthetic sequence.

SEQ ID NO: 22993 - protein, 186 aa, Artificial Sequence
  Synthetic sequence.
KDVDEVLKRLRELIDELRKTNERVKRELKKLVEDLERKNKDVERRLRELIRTLEEIARKTKDKETLRKILKEILDRIEKLLREAEETNRRAKEEIERLLKKAHDKNRKIEKEIDKLLKDITRRAKDDKDMVKKVRDVIEDLKREVERLDRETKEVVERVKRKIEKTNRDSKKVIDDLRREVERLRK

SEQ ID NO: 22994 - protein, 186 aa, Artificial Sequence; identical to SEQ ID NO: 22993
  Synthetic sequence.

SEQ ID NO: 22995 - protein, 186 aa, Artificial Sequence
  Synthetic sequence.
SEAERIVEELRKLIEDLRRKNEEVKERLKRLVREDEKRNEEVLKELEDRADELRKLVEKLSDKDTLKKILERAREEIKRLVKEIREENKRSVEKIEELLKRARDTNETILRRIEEEVRKAEKDLKDDKDVVDRLRRVIEDLKRTVEKSNEDSDRVIKEVKKRIDDSLKRVEDVIRRVKETIDRLEK

SEQ ID NO: 22996 - protein, 186 aa, Artificial Sequence; identical to SEQ ID NO: 22995
  Synthetic sequence.

SEQ ID NO: 22997 - protein, 186 aa, Artificial Sequence
  Synthetic sequence.
SDVDRVAKDLEKLIRDLEKINRDVSRENKELIEKDKKINEDVLRELDRLVEELERLVRELSDKETLKKILEDAVKEIRRLLEEIKERNDRSLERSKELLRRAEETNRDIERKIKDLLKRITDRIKDKKEMLEKIRKVAERLRREVERSNEESKKSADEAEKTIRKSLKEVEERIREVEKKIRDLKR

SEQ ID NO: 22998 - protein, 186 aa, Artificial Sequence; identical to SEQ ID NO: 22997
  Synthetic sequence.

SEQ ID NO: 22999 - protein, 186 aa, Artificial Sequence
  Synthetic sequence.
SEVDRVLKELDELIRTLEELNKKVSRENRELIKEDKKRNDEVVKRLEDLIRELKERVDKLKDKKTLKDMLRRMKEEIDKLLKEIRERNEESLKESDRLLREVHKLNRDIKKEIEDLLRDIERKIKDDKDALKKVREVIERLKEEVERLDRETKKSADEAKEAIKRSLEEVEDVVRKIREKIKKAEE

SEQ ID NO: 23000 - protein, 186 aa, Artificial Sequence; identical to SEQ ID NO: 22999
  Synthetic sequence.

SEQ ID NO: 23001 - protein, 186 aa, Artificial Sequence
  Synthetic sequence.
DEVERAKEELEKLVRKDEEDNDRVRKRLEELIRRLKEENDRVLEELRRLSEELDRLAKELKDKDTLRRRLEEARKEIEKLMREAHEENKRILEEIEKLLRDIEERNRESVERIERLLKKIEKDIKDDKEALDEVRRVIEEVKREIERSLRESREVIKELKERVKELDERTREVVRKVKEEIDELER

SEQ ID NO: 23002 - protein, 186 aa, Artificial Sequence; identical to SEQ ID NO: 23001
  Synthetic sequence.

SEQ ID NO: 23003 - protein, 186 aa, Artificial Sequence
  Synthetic sequence.
SEVDDVLRRLDKLVKDDKRTNDRIVTRDRETVKRVKEVNREIVERLERLVDRVREIVERLKDKDTLKKLVDEARKDIERLLKEAHDMNRESIERNRESVREVREINEDSVRKIRKLLREIETRVKDDEDALRKVREVIRRVEEDIKRSLRDSERVIEEVVTRNEKVDRETKKVVDEAKREIDERAK

SEQ ID NO: 23004 - protein, 186 aa, Artificial Sequence; identical to SEQ ID NO: 23003
  Synthetic sequence.

SEQ ID NO: 23005 - protein, 185 aa, Artificial Sequence
  Synthetic sequence.
SELEKLIEELERVLKRIEEVSRELDKELETVLDEIRRASKRLNDELRRALEEIARAATENKDIKELLEKLLREAKRVLDEVRKRSEELLRKLEEVLERVRKKSDDLLKELEEVLDRVKRTIERDIKSKLLERAEDVIRRVREALEELVRTNRESLERVERAARELNRRNEESLERARREVEKLRR

SEQ ID NO: 23006 - protein, 185 aa, Artificial Sequence; identical to SEQ ID NO: 23005
  Synthetic sequence.

SEQ ID NO: 23007 - protein, 185 aa, Artificial Sequence
  Synthetic sequence.
DEVRELIDRLRKALEEITRESRRLDEELRKVLEEVERRVEELSRRNKEMLDRVREKVTRRKDDTELLKEIERELKEILKRSDDEAKRILREVEEILRRVEEDSRRLLEKVRRVLKEVEERARRDVKSRLLEELKRVIDEVRREVERLNKKNKESLDRARRRVEDLLRRLEESVRRVEEELKKLST

SEQ ID NO: 23008 - protein, 185 aa, Artificial Sequence; identical to SEQ ID NO: 23007
  Synthetic sequence.

SEQ ID NO: 23009 - protein, 181 aa, Artificial Sequence
  Synthetic sequence.
SELERVIRESERTVEESHKHVREVIRKLRDIVRRSHEHVREVIERSKESVERVRDLVRRGVPREELKRILDEDKKRVDDVLRTNEELVRRIKEDVKRVLDENRKLLDEDRKRVKEVIDRITDEELVRRLKKVLDESEKAVTRNIEEIKKVLEDVVRKAEKNIREIAEVLERSTRAAKKDTD

SEQ ID NO: 23010 - protein, 181 aa, Artificial Sequence; identical to SEQ ID NO: 23009
  Synthetic sequence.

SEQ ID NO: 23011 - protein, 185 aa, Artificial Sequence
  Synthetic sequence.
ELEKRIDEVLKRVEDEIRKSIRENEEVLKDVERAVKELIKENERVLEEVREEVRKIIERVKEDKDLVRRLEEVAERIKRRVERTSRELDRMLKEVRKEVRRSSEESKRSLEEIRRKVEEAKRRIRSEDIVREVEKELEDILRDNRRLVRESIESLKDVVRRVAELVERSIRELKKMVDEIRKEAE

SEQ ID NO: 23012 - protein, 185 aa, Artificial Sequence; identical to SEQ ID NO: 23011
  Synthetic sequence.

SEQ ID NO: 23013 - protein, 185 aa, Artificial Sequence
  Synthetic sequence.
KLEERIEKVLEDAERDVRRSEEEIRRVLKEVEDRVRRLLRENEDALRRVEEEVKKIIDRVKDDERLVRDLKRTLDEIRERVKESNKRLEELLRRVEKTVREVLKRSRDSLRKVRTLVEEAKKRVRDEKIVKRVIETLRELLKENRKLVKDVIEDLKRIVKEVEELVRESIERLKDMVRRISEKAK

SEQ ID NO: 23014 - protein, 185 aa, Artificial Sequence; identical to SEQ ID NO: 23013
  Synthetic sequence.

SEQ ID NO: 23015 - protein, 180 aa, Artificial Sequence
  Synthetic sequence.
KEVEEIIETLKRLSEDLERKVREIIERLKRLSERLERENKEVIKELERLIDELRKLVEDGEDSSMVRRVEKKLEELLRRVKKLNEDVKEESKRLVEEARKVIEKVLRESKELADDARKKVDSEDLRKLDRVVKESERTIRDLLRKLDEVAKRSDDTIERVNDETAKVIERVKRKIEELEK

SEQ ID NO: 23016 - protein, 180 aa, Artificial Sequence; identical to SEQ ID NO: 23015
  Synthetic sequence.

SEQ ID NO: 23017 - protein, 180 aa, Artificial Sequence
  Synthetic sequence.
REVEEMIKELEELLKDLKEKNERASKRNRELVRRLEEENKRVIEELKKLVKELEDLVRSGEDEKVLREVLKRLEEVLERVRKLNERVLEKIEKSLEEVKRSNERVKRRLKELLEEAERRVDSEKLKELRDVIKEVKKRIDELDEYTRESIRRAKKEIERLNRETKKVIEEVVKRIEEERK

SEQ ID NO: 23018 - protein, 180 aa, Artificial Sequence; identical to SEQ ID NO: 23017
  Synthetic sequence.

SEQ ID NO: 23019 - protein, 174 aa, Artificial Sequence
  Synthetic sequence.
SEKEEVRRVIEELRRILKRVLEDLRRVVKENEDRLRELKKENEKSLRELEERARRIDIDEKVLRRIEKMIKDSEENVRESVRRNERLLEESKKHMKEVADRVEKILRELRDLVEKGVDVEDLKREIDRVAKEVEEVLEENRRRNEKSVEELRRDSKRNHERNEEVVKEAEDAAR

SEQ ID NO: 23020 - protein, 174 aa, Artificial Sequence; identical to SEQ ID NO: 23019
  Synthetic sequence.

SEQ ID NO: 23021 - protein, 174 aa, Artificial Sequence
  Synthetic sequence.
SEEERVRKALEELKRELDKVHENNKRSLRENEETLKKLLEDNERSLRELEEEMRRVDIDEKVLREAKRKLDESRKNVERSAKENKDLVDESRKHSDKVRREVEKILRDLEELVRRGVDVEELIKTLRRVAKEVRERSEENDRRNKKSVDELREDSKRNHDENDKVLKKLEKAAE

SEQ ID NO: 23022 - protein, 174 aa, Artificial Sequence; identical to SEQ ID NO: 23021
  Synthetic sequence.

SEQ ID NO: 23023 - protein, 178 aa, Artificial Sequence
  Synthetic sequence.
DEVEKLEEDSERSLEELRKTVEEVKKRSEDSLRDLERKSRENEKESRRTLRELREKDQDKRLIEELMRRDVEHIKRSLREHERILEEDLRRLKKVLEDLERRIREDLRRLEEVLKRQTDERVRKRVKDAAEKSRRVIEDLLREIKRVADDSRREAKRLLDRNKEVLERSKETADREKK

SEQ ID NO: 23024 - protein, 178 aa, Artificial Sequence; identical to SEQ ID NO: 23023
  Synthetic sequence.

SEQ ID NO: 23025 - protein, 178 aa, Artificial Sequence
  Synthetic sequence.
DEVEKLAEDSKRSLEKLRREVEKVKRESRESLKRLKEESEKNVRDLRRLLEELRRRPEDKKIIREEVEKALRHLEDSLRRHEEEMRKDVRRLEKVLEKLKKIITEDLRRLEEVLKRLTDERLLKRVKDVMDESRKVIRELLELIKEVIRESKETVKRLLDENKRVADEVRKVVDELRK

SEQ ID NO: 23026 - protein, 178 aa, Artificial Sequence; identical to SEQ ID NO: 23025
  Synthetic sequence.

SEQ ID NO: 23027 - protein, 184 aa, Artificial Sequence
  Synthetic sequence.
SEVEEVEREVKEVIEELDEIVKRVKEENDDSVRKSKRSLDEIEAEVRRVLKELTDRVTKRKTEDVRRELEKEIDRVRRKLEKILEDNRKKAEEDLTRTRKIAEELRKKIEDVVRRLEEIVKRLDKEEVLERLTRLIEKLKDVIRRLRERLKKSADDSRDVIRRTLEAIKEIIERLKEVIDRLDK

SEQ ID NO: 23028 - protein, 184 aa, Artificial Sequence; identical to SEQ ID NO: 23027
  Synthetic sequence.

SEQ ID NO: 23029 - protein, 181 aa, Artificial Sequence
  Synthetic sequence.
DEIEKLREDVKKTLEESRKSVEDLERRSEDSIRRSRESVERLKREVKEVIDRLRDARRRGTPEEKIEELLKRVRDRIEEVLRRNERLVEENKKEITRVLDTNRRLNEESNRELKRVLDKTRDKRVLDEIKKLADEDNKTVTDSLKRIRDSAKKVDEVVRESLERIRKVAEEITKVVEDVKR

SEQ ID NO: 23030 - protein, 181 aa, Artificial Sequence; identical to SEQ ID NO: 23029
  Synthetic sequence.

SEQ ID NO: 23031 - protein, 181 aa, Artificial Sequence
  Synthetic sequence.
SELETLEKSLRDVLKESRDSVEKLRKEVEDTIKESEDSVTKLLKEIEDVIRRLEDLRRRGVPEEAIKKLVREVAEAVKEVLRRNRELNKRSNERAKEVVDRNRKLAEDLLDEIRKVLAKVTDEDVLRRIRRAAEEVRKVAKESVDRIRDLAARDNEVVERSLKKIEEVLRRIKKVADDVAR

SEQ ID NO: 23032 - protein, 181 aa, Artificial Sequence; identical to SEQ ID NO: 23031
  Synthetic sequence.

SEQ ID NO: 23033 - protein, 181 aa, Artificial Sequence
  Synthetic sequence.
SEIERLEREVREVIKESEESVRRLKKRVDDTVRENEELVKRLEDRVRRMKERLEDARRRGRPEKDIEELLKTIAKEIKDVLEESRESNERSNTDIKRVLEENTKLVKDVLRRIERVLDKSTDDDVKRKIRKVMEEIKKRADDSRRKIEDVARKDNKAVERSLRRIERLLEEITRVVEEIKK

SEQ ID NO: 23034 - protein, 181 aa, Artificial Sequence; identical to SEQ ID NO: 23033
  Synthetic sequence.

SEQ ID NO: 23035 - protein, 181 aa, Artificial Sequence
  Synthetic sequence.
SELEKLDKESRDSIRKSEDSVRRLEEESEESIERSKRLVEELKRLADEVIRRLEDMARRGTDKTKIRELIKRLKELAEEVVKRNSELVERNRRRIEEVERTNEELVRRNEETIKEVLKKTRDEDVLRAIEESMKRARKAVEDSLRRIRESLEKVKEEVRRSNEKIKKIVKEVREVVERIAD

SEQ ID NO: 23036 - protein, 181 aa, Artificial Sequence; identical to SEQ ID NO: 23035
  Synthetic sequence.

SEQ ID NO: 23037 - protein, 181 aa, Artificial Sequence
  Synthetic sequence.
DELEDLEREVREVIEESKRLLEELEKRVKEVIKTSRDSVRRLKERVDRVIKELRDAKRRGEPREKIRELVERLKREVEKVERENDDLLRRVAEEIERVVEENSRLLEEVKRRIEEVLARTRDEDVLRKIRELLEEIRRVIEETNRRIKKLLEEIKRVADDSRRRIRKVAREVEEEAKEIEK

SEQ ID NO: 23038 - protein, 181 aa, Artificial Sequence; identical to SEQ ID NO: 23037
  Synthetic sequence.

SEQ ID NO: 23039 - protein, 181 aa, Artificial Sequence
  Synthetic sequence.
SVRERIDELEKKIKRVVEKVLKENKDSLKRVEERVRRLLEENKRSLDEVREAVERVLSEVRDKRELLEKLRRILRENEKRNTESLREHERILEENKRRNEESLKRHKDLLDEVKELIDRARDLEDVEKLERDVEKVIEDARRTSEEVKRENDKALKDLDRLSEEVEKENRKALEDLKRTSD

SEQ ID NO: 23040 - protein, 181 aa, Artificial Sequence; identical to SEQ ID NO: 23039
  Synthetic sequence.

SEQ ID NO: 23041 - protein, 181 aa, Artificial Sequence
  Synthetic sequence.
SVRETIDKALKKIRDVAEDLKRRNDELLKEIEEVARDSSEKIRRALEEVERRVREVLKRVKDRRELLRTIEELLKEIRKEVEDVHRRNKRLLEEIRKIVKRSKDEHERLLKEVKETVDRMRDLEDVEKLKKDIERIIRELEELSDRLKKIIEEVIKKSEDLVRRLRESLERVLREIDKTTK

SEQ ID NO: 23042 - protein, 181 aa, Artificial Sequence; identical to SEQ ID NO: 23041
  Synthetic sequence.

SEQ ID NO: 23043 - protein, 181 aa, Artificial Sequence
  Synthetic sequence.
SVREEIDRILREIEEVVKTSSERIKRLLEKIEEVVKRLIEENRRVLKRTDEEADRLLKEVKDDKDLLRELRDLLKKARELNTEITERLKRLLDRIRELIEKVHRENEKLLREIRERIKEARELEDVDTLRKEVKEVIDTSEDLVRRLEEEVRKAAKRLKDLVDDSRRLNTEILRTLRERRR

SEQ ID NO: 23044 - protein, 181 aa, Artificial Sequence; identical to SEQ ID NO: 23043
  Synthetic sequence.

SEQ ID NO: 23045 - protein, 177 aa, Artificial Sequence
  Synthetic sequence.
DDLKRLEEDVRRIIEENDRIVKDIAEKSKKSIEDNRRLLKRLRDESERTIDDIRRLKEEGQDRRRLEEVLEEDHRLVKEINERSKKILDEDHKLIEEINKRSKDLLDRIRRLAEKAAEKRDVEEIRRLLKEITDVVRESNRRIKRINETAHEVVRRSNTETTKVNKKAHDVVEEVKR

SEQ ID NO: 23046 - protein, 177 aa, Artificial Sequence; identical to SEQ ID NO: 23045
  Synthetic sequence.

SEQ ID NO: 23047 - protein, 181 aa, Artificial Sequence
  Synthetic sequence.
SLIEKIREIVKEIIKRSDDSVEEVKRRNEESIRRSEESVKDNRRRIEDIIRKLKRLKEEGRDRRDVEDLVRRIVEESKKTLRENEKLLEDDRRINEKILEDNKRLLKKAREDLKRVLEKTTDDDMLRKIEALAREVTEVSKRALEEIRKLMEESTEVSKRALERIEASVEEVRRVAEEVKR

SEQ ID NO: 23048 - protein, 181 aa, Artificial Sequence; identical to SEQ ID NO: 23047
  Synthetic sequence.

SEQ ID NO: 23049 - protein, 181 aa, Artificial Sequence
  Synthetic sequence.
SLLEEIEKEVREIIKRSRKSLEEVKRRNDDSIRKSEKLVEDNKREIEEVKERARKLKEDGTDRKRIRELMERIERSSEETLKENSRLVTRDREINEEVLRRNRKLLEEIRRRLEEVLRRTTDKRVLEEIDRLAKDVKRVSDEVLEEIKRLAKESKEMADRSNEEIKKSVEEVRRVVEEVEK

SEQ ID NO: 23050 - protein, 181 aa, Artificial Sequence; identical to SEQ ID NO: 23049
  Synthetic sequence.

SEQ ID NO: 23051 - protein, 181 aa, Artificial Sequence
  Synthetic sequence.
DEIEELEKLIRKAIKDSRDLVRKLEEENKRSIDTSRELLKELERMLDEVRRRLEDLKRKNGSSEELRDLLRRIKERAKRVHEKNEELLRRDDKRNRDVHRRNEELLREVEKLVRDVARKIDKEELLREIKKLLDTIRRVIEESSERIKKLAEDSREVVKESSTEIKRLLETITEVVDRVTK

SEQ ID NO: 23052 - protein, 181 aa, Artificial Sequence; identical to SEQ ID NO: 23051
  Synthetic sequence.

SEQ ID NO: 23053 - protein, 181 aa, Artificial Sequence
  Synthetic sequence.
DEVEEAEKLIRKVIKDSEKLLRDLADLNRKSIRRSEKLVEDDRRANEDVIRKLEELRRNNGSEEELRRLLKEVEDTNRRSHETNKRLLDEDRRLNKEVHDRNEKLLRDIKRLVEEVEKRIDKEELLRRIKKLLDEIKKAIEDSSREIKRLLEESERVAKRSSEDIKRTLDDTRRVVEEVRR

SEQ ID NO: 23054 - protein, 181 aa, Artificial Sequence; identical to SEQ ID NO: 23053
  Synthetic sequence.

SEQ ID NO: 23055 - protein, 183 aa, Artificial Sequence
  Synthetic sequence.
DVEETVRKLIEDVKRVMERVRKSNTDLIRRSKEVLKDARRLHEELTKEVKDVLRRLEEEVKDEDTLREIRKKITELLKENERVLRDVERNVREDVKRLKENLDDNKRKAEEVIKDLERVMSSDKREVVKRVEEDVRKKLEESTKDSKRVERESEENLRRAKEKSKRVLKKLKDDLRRLEEESR

SEQ ID NO: 23056 - protein, 183 aa, Artificial Sequence; identical to SEQ ID NO: 23055
  Synthetic sequence.

SEQ ID NO: 23057 - protein, 183 aa, Artificial Sequence
  Synthetic sequence.
SVKETVKDLEREVREVLKKLRDDVRKLIEESDKALKRLKKIHDDLSRDVRRVLEDLRRRVKDEDTVREIERKARELDKKNRDVARDVERNVREDIKRLEDELRKLEDEIRRLEEELREVSKIEDKKMIDDVVRRVRKKLKEIDEKVKDVERKSRENLKRLKEKSDRVAEDLKKILDELREEVR

SEQ ID NO: 23058 - protein, 183 aa, Artificial Sequence; identical to SEQ ID NO: 23057
  Synthetic sequence.

SEQ ID NO: 23059 - protein, 183 aa, Artificial Sequence
  Synthetic sequence.
SVEETITELIKEVRKVAEEVKKSNKEVIEESEEALKELERTHTELSEEVRKVLRELEEEVKDEDTLRRIRKAIRDLDEENKRVLERVRKNVKEDIERLRENLKRNEELARRVIRELEKVMRVDKKEVVTEVVKEVKKRLEESKDDSRRVMEESRRNLKKLREESKRVVEELRRELRRLKEEVR

SEQ ID NO: 23060 - protein, 183 aa, Artificial Sequence; identical to SEQ ID NO: 23059
  Synthetic sequence.

SEQ ID NO: 23061 - protein, 183 aa, Artificial Sequence
  Synthetic sequence.
DVEETVRKLIEKVKRVLERLEEEHKRLSDDSRRVVKKLKDDVEDLIRRVEEVLKELERRVKDEKTLKDIRKKIEELIRELREVAKRLEDNAREDDKENREVLKRVREEIRRLIEKLKDMMRVEDRKAVDEVRKEVDRRLEELKRDSERVVKKSEENLRRLEEEVRKVEEKVRRTLKRLKEEAK

SEQ ID NO: 23062 - protein, 183 aa, Artificial Sequence; identical to SEQ ID NO: 23061
  Synthetic sequence.

SEQ ID NO: 23063 - protein, 178 aa, Artificial Sequence
  Synthetic sequence.
DKLEKVLEEIKRRLEENERLLRKVERDLKRLSKENEDRLRKMLEDLRKLSEDLLRSVEKDKDLKEEIRDVIEKLRRLNDELRKDTERSLKRLRELNEEARKRSEDSARRLRELIKELKRDRDVEKVDELLKEVEEIIDRSRKEIDRTRKDNERSVKRSEDAIRKTLDENEKSLREATR

SEQ ID NO: 23064 - protein, 178 aa, Artificial Sequence; identical to SEQ ID NO: 23063
  Synthetic sequence.

SEQ ID NO: 23065 - protein, 178 aa, Artificial Sequence
  Synthetic sequence.
SDVEEMEKRIRDRLRENRRIVEDVAKKLRDLSRRLEEEVKKVAEELRRLSDELRKRVTRRKELRRDIEEVLKRLRELNKRLREDVDRAMRELRELNKELDKRSEESLKRLEELARDLARRKDVERVKDLLREVKRVIDESKKTIRDTLEENEDSIRRLRERIDETLKENEKSIKELKD

SEQ ID NO: 23066 - protein, 178 aa, Artificial Sequence; identical to SEQ ID NO: 23065
  Synthetic sequence.

SEQ ID NO: 23067 - protein, 178 aa, Artificial Sequence
  Synthetic sequence.
SSVEEVKKELDKILEELKEKSERSKEEVERVLKKLREKSDRVEREVRKAEERLRRKVKDIREDELKEELTKEVKEVLEKNEEIAKELTREVKEVNRKNEKILDELRREVERVEEKIRRRLEDDETVERLLKKLKDVLEELRRRHEEVSKRLEKVLKELVDRHKKVTEDLKRVLDELRK

SEQ ID NO: 23068 - protein, 178 aa, Artificial Sequence; identical to SEQ ID NO: 23067
  Synthetic sequence.

SEQ ID NO: 23069 - protein, 184 aa, Artificial Sequence
  Synthetic sequence.
SLEETLKKLIEEVEEVLRRSEEIAREAIRRSERVLEELERRHKKVTDEIKEMLRELRERIDDKDTLKKVTDKIRELLRENEDVLRRVREEVRRDVEELRRALEDNKRKVERVIEELEEVLKKLKREELVERVLDKVRRDLEDSRRHLEEVKRKSEESLKKLKKETKDALDTIREKLKRIADELR

SEQ ID NO: 23070 - protein, 184 aa, Artificial Sequence; identical to SEQ ID NO: 23069
  Synthetic sequence.

SEQ ID NO: 23071 - protein, 184 aa, Artificial Sequence
  Synthetic sequence.
SMEEKVKRIIKKVDDVLKDSERRITELIKKSRDVLRELEKRHEELTKRVKDVLDDLRRKIRDKDTAKKVEDDVRRLLEENKRVLEEVRESVKRDIERLEEVLRRSRKHIEEVKERLDRVLKKVTDDRAVDTVRKEVEKALEENRKTVRDVEEESDRSLRRLREKTDEVRRRVEEILKRLKERVD

SEQ ID NO: 23072 - protein, 184 aa, Artificial Sequence; identical to SEQ ID NO: 23071
  Synthetic sequence.

SEQ ID NO: 23073 - protein, 184 aa, Artificial Sequence
  Synthetic sequence.
ELEERIKELIKKVRDVLRKSKEEVDKVIRKSEEVVRETEKLVEDIIRRVEKVLDEVRKRIKDKDTLKEVKELAETVIRKLEKILRDNKELVDRDIERLKKVARESEKHIREVERELEEVLKKLKTKELVRTLERRVEEVLRRNEELVKRVREESDRSIDRSRRSLERAEEDVDRVLKEVKDRTT

SEQ ID NO: 23074 - protein, 184 aa, Artificial Sequence; identical to SEQ ID NO: 23073
  Synthetic sequence.

SEQ ID NO: 23075 - protein, 184 aa, Artificial Sequence
  Synthetic sequence.
DLEKKVEDVIREVEKVLRELRRRHEELTKRSEDAVKETKDRVKEIEDEVRRVVDKVRKDIKDKDTLERVERKAEEVIRRLRRILEENKKSADRDVRRNEDMLRRVEKTVRDVKRKLERVLKDLKTDELVKELKRDVERVLKRLKERSDEVRKESEKSIKKSKDSLEKAEREVREMLRDLDRETK

SEQ ID NO: 23076 - protein, 184 aa, Artificial Sequence; identical to SEQ ID NO: 23075
  Synthetic sequence.

SEQ ID NO: 23077 - protein, 184 aa, Artificial Sequence
  Synthetic sequence.
SMEERVKELIRRVRKVLEDTERRAKEIIEDVERVLEELKKRHEDLTRKVDKVLKELKKEIRDEDTLREVEKTVRDVLRKNETVLREVEETVRRVIKRLEEILRRNRKKIEDVERELDKVLKKVTDEKLVTKVEEDAERALRESEESLRKVEREVKRVLEELKRKTEKVARELDKILKELKDRTR

SEQ ID NO: 23078 - protein, 184 aa, Artificial Sequence; identical to SEQ ID NO: 23077
  Synthetic sequence.

SEQ ID NO: 23079 - protein, 184 aa, Artificial Sequence
  Synthetic sequence.
SLEDELRKLIEDVKRVAKETEDRVREILKRSKDVLDELKKEHDKLTREVERVLDELAKEIKDKDTLREVKKRVDDLLKRNEDVVREVEKIVEEDLDRLRRILEENKRLAEEVIRRLEEVMKKLKTEELVKKVKKEVEDVLRRSKESLKKAEEDSRKSLEELKKKTEDLKREVKEILDRLKERVR

SEQ ID NO: 23080 - protein, 184 aa, Artificial Sequence; identical to SEQ ID NO: 23079
  Synthetic sequence.

SEQ ID NO: 23081 - protein, 184 aa, Artificial Sequence
  Synthetic sequence.
SELEKLKREVDEVLKRNKELVDELRKRVRKALEESRRSVEEVERRVEEVLKRLEDDLRREKSKEVIDKLRKLVEDLIRELEDLLRKNKEKAERLLEELKKLLDESRRHIEELEKELKKLLDRLDKEELKEKVRRILKEVRRVLDESRRDVERVLREVEKVMRESIKKARDAIRKVEEVLRELER

SEQ ID NO: 23082 - protein, 184 aa, Artificial Sequence; identical to SEQ ID NO: 23081
  Synthetic sequence.

SEQ ID NO: 23083 - protein, 184 aa, Artificial Sequence
  Synthetic sequence.
RELDDARRKVEEVLKTNKDLVDKIRKEVEETLERLDRSSRKVREIVRRVLEELTRRATERKTEDVERELAEVVDRVIKELRRIVEENRKLSEKSIKELRELLERSERHIKRVIDELKSLLDRIRTEELKRLVEKLIKEVEDVLEESRKAVEDVIREDKRRMEESKREADELIREVKKVLDDLRK

SEQ ID NO: 23084 - protein, 184 aa, Artificial Sequence; identical to SEQ ID NO: 23083
  Synthetic sequence.

SEQ ID NO: 23085 - protein, 184 aa, Artificial Sequence
  Synthetic sequence.
KELEDLEREVREVLKRSDESLKRLEEEVRRVLDENDKEVKRVKEKVKKVLDELREIVTRRKTEDVKRKVKEDVTRLLDELEKELRRSEDHIRRLIERLEKELRKNRERIKELKERLKSLLSRLDKEELKREVERLIREVEEVLKKSEEAVRRLIEEVDRALKRSREEFTKAREEVKKVLEDART

SEQ ID NO: 23086 - protein, 184 aa, Artificial Sequence; identical to SEQ ID NO: 23085
  Synthetic sequence.

SEQ ID NO: 23087 - protein, 182 aa, Artificial Sequence
  Synthetic sequence.
DEIDKARKDIEDMLRRLRDLVRKLEDLNRKVVEELKDLVRKDRKLNEDIVRRLERLVRERPDVQEDIERLLKEVRKMNKDTLRKIRELLEKIKDLNRRIEEEIKRLLKEARELVRDVEKRIDDEEVKRRIEELLRRVDKVADEVRREVERTNRESEEVVREVEEDVRRSLEEIDKVIKDVRT

SEQ ID NO: 23088 - protein, 182 aa, Artificial Sequence; identical to SEQ ID NO: 23087
  Synthetic sequence.

SEQ ID NO: 23089 - protein, 182 aa, Artificial Sequence
  Synthetic sequence.
SEIDELRKRVEEVLRRLDELVKRLKEENDRVVKKAEDLIRRLEETNREILKKLRKLVKDDKDNQEAIDKLAKDAHKTNRDILREIRELLKRIHEKNREMVERIRKLLRDVERMLRKVEKEIDDRDVLEKIKDLLRRVKEVADEVEKKIRELNKKTEDVVRELEERVRKLDEDVKRVIEEVKR

SEQ ID NO: 23090 - protein, 182 aa, Artificial Sequence; identical to SEQ ID NO: 23089
  Synthetic sequence.

SEQ ID NO: 23091 - protein, 182 aa, Artificial Sequence
  Synthetic sequence.
SELDEIRERIERIEKDLERLVEEVKRVNDTIVERIKKLIDEVRKENEKVIKTLRDLVREVPELKEKIRELLKRAHEVNRRVEKTIEDLLREVEKVNDEIRREIEKLLETATRLLDEIRRRIDDEKVEREIRRLLERVKEVIERVKDRVRRVDKKSRDVVREARRAIEEVDRRVRKVVREAEK

SEQ ID NO: 23092 - protein, 182 aa, Artificial Sequence; identical to SEQ ID NO: 23091
  Synthetic sequence.

SEQ ID NO: 23093 - protein, 182 aa, Artificial Sequence
  Synthetic sequence.
DEIKKLEDEVKKILDDLRELIRKLEETNRDVERRLRELIAELRKRNDEVVKRLRDLVRRSKDSKEEIDRLAEEIKKENEDILRKIEKLLEEARETNERILRRIDELLKEAKRLIDDVLRKIDDEDVKRKIEEILRRVEEEIRRLKKEVERLDRESKRVIRELREDVKRTNTDVKRVVDEVRK

SEQ ID NO: 23094 - protein, 182 aa, Artificial Sequence; identical to SEQ ID NO: 23093
  Synthetic sequence.

SEQ ID NO: 23095 - protein, 181 aa, Artificial Sequence
  Synthetic sequence.
SLVERLEERVKRIIDELRRILEENRRRVKKVSDENRDLLRRLEEENKKIIEDLRDLKRKGRDRKEVKRLVDRVRKTNERVLETVDRTATRLREKSKESLERLRKTVREVVEEIRDVMRKVDDEKAKDKLRRLEEEIRKVAKEVEDELRRSTEYVKKSLEDAKRKLEELTKRTEDVAEEVER

SEQ ID NO: 23096 - protein, 181 aa, Artificial Sequence; identical to SEQ ID NO: 23095
  Synthetic sequence.

SEQ ID NO: 23097 - protein, 181 aa, Artificial Sequence
  Synthetic sequence.
DLVERVEEKVEDIKRKLRRILEEVDRRNKEVSKENKELLDRLEEENERIIRELEKAKRDGTDRRKLKELIDRLRRINEDVRRKVDRTVKELKKINKKILEELEELVRRVKEEIKRVMDEVQDDRAREKLKRLVEDIDRVAEEVKRTLEELSRYTDKSLEDAERSLERLTKETDEVLKRVTT

SEQ ID NO: 23098 - protein, 181 aa, Artificial Sequence; identical to SEQ ID NO: 23097
  Synthetic sequence.

SEQ ID NO: 23099 - protein, 178 aa, Artificial Sequence
  Synthetic sequence.
SIVERLKKLAEDVIRRLERLSKELAKRNKEVIERLKELSKRLEDKNRRVIEELRRTKDEEEIKRLLEEARRTNKKVLDDSKKLLDEVRETNRTVAETSKDILREIEEVVKRVLDEVRELEEVKRAIEELRDRIRKVIEDSERTIRKLNDDTRKVVEDSRRTIEELNRTTDKVIEEVRR

SEQ ID NO: 23100 - protein, 178 aa, Artificial Sequence; identical to SEQ ID NO: 23099
  Synthetic sequence.

SEQ ID NO: 23101 - protein, 178 aa, Artificial Sequence
  Synthetic sequence.
RKVDELRKEVKRVIDELRELSERLRKENERVIKTLEDLVRRLEKLLERVERELERTKGKEEVRKIMKRIEDVARKVLRELEELLRRAEKINKDVLDRSREIAKRARDILKKVLDDVKDLEEVKKEIDRLRRELDRVIKESEDTIRRLNDETRKVIEKVRRAIEELLRRIEEVIKKVEK

SEQ ID NO: 23102 - protein, 178 aa, Artificial Sequence; identical to SEQ ID NO: 23101
  Synthetic sequence.

SEQ ID NO: 23103 - protein, 178 aa, Artificial Sequence
  Synthetic sequence.
SIVEELRELVKEAIKRLKKLSDDLRRKNEEVIRTLKELLDRLKRKNEEVIKRLEDTKGKEEVDRLMEEAKELNKRVEDTLRELMDRARRTNEEVERRSKELLKEIEKVLRDVLRRVSTLEEVKREIEKLKRDVERVIEDSRRTIEELNRKTEEVIERVRRTIERLNEETKKVIDRVRT

SEQ ID NO: 23104 - protein, 178 aa, Artificial Sequence; identical to SEQ ID NO: 23103
  Synthetic sequence.

SEQ ID NO: 23105 - protein, 178 aa, Artificial Sequence
  Synthetic sequence.
REVDELRKRVEEVIRELEKLSEDLAERNRRVSERNKELVETLARLNKRVIDELRRTKDKEEVDKLLKEVRELNKRVEEEIDKSLEEARRVNEEVVERSKRILERAEKILEDVLRKVKDLEEVKKAIDDLRRELEEVIKRSKKTIDDLNRYTKKSIEDVREAIKKLNKETDDVAREVKK

SEQ ID NO: 23106 - protein, 178 aa, Artificial Sequence; identical to SEQ ID NO: 23105
  Synthetic sequence.

SEQ ID NO: 23107 - protein, 178 aa, Artificial Sequence
  Synthetic sequence.
SIVEELKKLVEEAIRKLEKLLEELEEKNRDAIRRLKELSDELRKKNEEVIERLKRTKDKRELERLADEARRTNEEVVRRSDKLLEEIKRTNEKVKRELDELLRRIEKIVKDVLDRVRELEEVKRMIEKLRRDVEKVIREVRDEIRRLNDTTRRVIDKSRKTIEELNRTTEEVIERVKR

SEQ ID NO: 23108 - protein, 178 aa, Artificial Sequence; identical to SEQ ID NO: 23107
  Synthetic sequence.

SEQ ID NO: 23109 - protein, 176 aa, Artificial Sequence
  Synthetic sequence.
DEEEVMRELKKEIDEALERSKEINDRLRKEIRDVLEKLERIVREVKERSERVLEDVRRKVDSKKLERVEKIIRESEKHVDEARKEIEKRIKELEDRVRENTERVKRIIEELRDRVRKLGGVKEAVDEIRRILREALEEDKKSVEDIRRDLDKIEKDVKKVLEDNERLLKRLREEVK

SEQ ID NO: 23110 - protein, 176 aa, Artificial Sequence; identical to SEQ ID NO: 23109
  Synthetic sequence.

SEQ ID NO: 23111 - protein, 176 aa, Artificial Sequence
  Synthetic sequence.
DEEEVMKELEDRIREVDKKIEDRLRELKERSDRVLDRSRRINKKLKDEIEDALRRVRRDVDSKDARDVDRIIEELKRRVEENSRRVEEIIRRSRKHVEDLLRRAKEIIKKLEDEVRKLGGIKEAVDTIERKLRKLEEDLKKVERDNKKLLDDMERDDRRSLEEIKRILDELLEKVR

SEQ ID NO: 23112 - protein, 176 aa, Artificial Sequence; identical to SEQ ID NO: 23111
  Synthetic sequence.

SEQ ID NO: 23113 - protein, 176 aa, Artificial Sequence
  Synthetic sequence.
REEEVMKELDREIEEVLERSREIVERLRREIEEVLKENKKIVETLKREIKKVLREVREKVDSKDARRAEEIIERLERRVEENEKRVKEIIDELRKLVKRALEESEKSIRELKDRVRKLGGSEEAVKRIRDILEKDERDVREVVRRIREILKASLEDSERSVEEIRRILDELRKEVE

SEQ ID NO: 23114 - protein, 176 aa, Artificial Sequence; identical to SEQ ID NO: 23113
  Synthetic sequence.

SEQ ID NO: 23115 - protein, 176 aa, Artificial Sequence
  Synthetic sequence.
REEEVMERLRREIEKALRESHEIDDRLRKRIEDVLRDSERKLEELRRRIKKVMDDVRRDVDSERLREVEKIIKELEERVDDLRKKSRDSARRLKELVDESNKRSRDIARRLKEEVDRLGGSEEAVRKIREELERMKEENDRVLKEIDKDLKDDDRKIEEVVERIERILRELRERVR

SEQ ID NO: 23116 - protein, 176 aa, Artificial Sequence; identical to SEQ ID NO: 23115
  Synthetic sequence.

SEQ ID NO: 23117 - protein, 176 aa, Artificial Sequence
  Synthetic sequence.
DEKEVADELERKIDEALKESHEIDKRSDDHDKEVLKKSEKRLRELDEEIKDVLRKLEKKVDSELLKRVRDIITKLEKEVRDLLEESRKSIEDLHKHNRESNKDSRDIIRELRDRVRKLGGSREAVETIERILKRMIERNRAVVETNKKLNKEDEDKIREVVKRIREKLRKADEEVR

SEQ ID NO: 23118 - protein, 176 aa, Artificial Sequence; identical to SEQ ID NO: 23117
  Synthetic sequence.

SEQ ID NO: 23119 - protein, 181 aa, Artificial Sequence
  Synthetic sequence.
ETEDKVRELLKRIRDVAEKAREKVEELVRRNEEVLKRARETVERLVRKNEEVLREVAERARSRKLDEIRREIEKTIRDHKRIVEEVRKEIKRSIEEHRRKVEKVIRELEEVLKTIERIMRRKERDKKELEDTVRKVLEDLERKLERLEEESREVERRVKKVLDELKRKSEESEKRLEEAAR

SEQ ID NO: 23120 - protein, 181 aa, Artificial Sequence; identical to SEQ ID NO: 23119
  Synthetic sequence.

SEQ ID NO: 23121 - protein, 181 aa, Artificial Sequence
  Synthetic sequence.
DAEEVVRKLEEELKRLIDKLRKVMEESLKRVKESMDRSRKRIEELVRRLEKILRDLKRDREEIEEVIRELREIIERLKDKIKKDLDTSRRIADENRKDIEDVVRDLERIAEELRRIAARDGREDVLRKLKETVERVRRKVEEVIKKSRESVKRVEETNTRSLRELEETVREVEKRVREESR

SEQ ID NO: 23122 - protein, 181 aa, Artificial Sequence; identical to SEQ ID NO: 23121
  Synthetic sequence.

SEQ ID NO: 23123 - protein, 182 aa, Artificial Sequence
  Synthetic sequence.
SEVEKLLKDLKELLEEVKRRAEESHRDLRRLLEEVRKRVEDSNRELERELRRAEDLVRRGNKSSDLVEELRKIIEEMEKKHKDLVDELRELIKKVIDDHEKLIRDLERLIRRVEEELERKTRDRKMERVVEEIRREVKKVLEDLRRILKESEDAARKVLRDLERLVKHSKDTAREVLKRLKK

SEQ ID NO: 23124 - protein, 182 aa, Artificial Sequence; identical to SEQ ID NO: 23123
  Synthetic sequence.

SEQ ID NO: 23125 - protein, 182 aa, Artificial Sequence
  Synthetic sequence.
SEIEKLLRDLERLLEEVKRKAEKTNRDLEKLLEEVKRKVEDSHRKLKKVLDEVKDLVRRGDKSSELVRRLEEIVRRAREEHERLVRELEELIKEVERRHEEIIRELEELIREVDDRMRRTTKDERVKRLVEDVRRRVKEVLDDLRRIIEHSRRRAEKVLRELEKLVRESETKAREVLKDLKK

SEQ ID NO: 23126 - protein, 182 aa, Artificial Sequence; identical to SEQ ID NO: 23125
  Synthetic sequence.

SEQ ID NO: 23127 - protein, 176 aa, Artificial Sequence
  Synthetic sequence.
SEAERLLEDSKRVLDEIREDLKRLLKESEDVMREIEKTLEKLVRDVERVLDEVRKSRDDKKKVLDELRKILEEVEKRAKDLNEENKRIMDKVRREVEELIKRNEDIMREVEERAKRDNVDERVLRTIKDLHRRLSEEVKRVLDEAEELHRRLSERVREVLEDIRRLVEELIEEVRK

SEQ ID NO: 23128 - protein, 176 aa, Artificial Sequence; identical to SEQ ID NO: 23127
  Synthetic sequence.

SEQ ID NO: 23129 - protein, 176 aa, Artificial Sequence
  Synthetic sequence.
SEAEDLLRRSKERLDEVRKRLDELRRRSERVVEEIRRLLKELLDDVERVRKEVKEARDDKKKVLEELRRILKRVEDEVRDILRKNEDAAREVAKEVKRIDDDNERILRRVADKARKDKIDDRVLRTIEDTHRRLSEDVKRVLKEAEELHRRVTEEVKDVLRKIRETAERLEEEVKK

SEQ ID NO: 23130 - protein, 176 aa, Artificial Sequence; identical to SEQ ID NO: 23129
  Synthetic sequence.

SEQ ID NO: 23131 - protein, 176 aa, Artificial Sequence
  Synthetic sequence.
KEAEELLDTSRRVSEEVEKRLEKLLRESERVAEEIRKRLEELLRRVEKVLDELRKARDDKRKVLEEVTRALEDVERRVEEINRENKEEADRVRRDVERIDEENKRAAEEVKERARKRGIDEKVLKTIEDEHRRLSESVERVLRTAKRLHDEVSKEVRDVLEEIRRTVEKIIREVRT

SEQ ID NO: 23132 - protein, 176 aa, Artificial Sequence; identical to SEQ ID NO: 23131
  Synthetic sequence.

SEQ ID NO: 23133 - protein, 184 aa, Artificial Sequence
  Synthetic sequence.
SVEEVLKTLEDLARESSEEVRRVAEEIERSNRRVVKEVEKVLREIEELNRKILEEVERDLDSKDVDRLRREIERSLDESRKIIEKLRRDIEEVNKKSRKTIKDLEKENRDVVRKVRDIARKEDKMEEVLRELLKEVAKVVEDTRRKLEELLKENEEMDRDLKRKLDELLERNREVLERLKRKVD

SEQ ID NO: 23134 - protein, 184 aa, Artificial Sequence; identical to SEQ ID NO: 23133
  Synthetic sequence.

SEQ ID NO: 23135 - protein, 184 aa, Artificial Sequence
  Synthetic sequence.
SVEEVLKELEKLVRDSSREIKKVLEEIDKSNTDLLREVEDALRRIEERVKEALESVDRTVRSEDARRLKEELEELLKRVREIIERIKREIERVNERSREIIERLREDNDRVRKEVKKIIDKEDRVREMLERLLDTLRRRLEETRKELERLLTENKKKDDEVKEKLKRAEEELEDVRRRLEEKLR

SEQ ID NO: 23136 - protein, 184 aa, Artificial Sequence; identical to SEQ ID NO: 23135
  Synthetic sequence.

SEQ ID NO: 23137 - protein, 185 aa, Artificial Sequence
  Synthetic sequence.
SAEEVLRRLKEAIKRLIRDSERVLEEIRRTNEELIKRTEEVLRRVREKAERLIDDVRRRLSDDKRVKEVIDELKEMLERLEKKIREDIEELERNLRRNEKRVRDDIRRLEEMLKELERKISEVRGIDEALRRIEKEVRDVEKRSKETLEDSKRDSERVRKKSEDTLREIETRVEDVRRKAEEEVR

SEQ ID NO: 23138 - protein, 185 aa, Artificial Sequence; identical to SEQ ID NO: 23137
  Synthetic sequence.

SEQ ID NO: 23139 - protein, 176 aa, Artificial Sequence
  Synthetic sequence.
SESDRIRAIVKKVVDESKESLKRLKEETERVKRELDRVLKENKDKVRRLKEKAEEMKKLEDRKALKKVVDELRDALRESEEHIRKVLEDNERVLRRVEKEVKDDIRRLEKILEDIERELRSDVLREVAERVTRLIRDSERVLEELAREHEKASRKVKKVLDESKKIVDDVIRRVDR

SEQ ID NO: 23140 - protein, 176 aa, Artificial Sequence; identical to SEQ ID NO: 23139
  Synthetic sequence.

SEQ ID NO: 23141 - protein, 176 aa, Artificial Sequence
  Synthetic sequence.
SESEEIERTVEDVKRKSDKSLEESRRNVERLKEESEESLERNKDLVRRVAEKVEEVKRDSREEALRKVVRELEEALKRSEDHVRTDIKRLKDNLDRNRKKIEDDIDRLRRILEDIERRIRSEAADRVREEVTKVIKKSEDVLRDSERLHREVIKTSRDVLDKSRRLVEEIIRRVRR

SEQ ID NO: 23142 - protein, 176 aa, Artificial Sequence; identical to SEQ ID NO: 23141
  Synthetic sequence.

SEQ ID NO: 23143 - protein, 181 aa, Artificial Sequence
  Synthetic sequence.
SDVERVLREVEEIIRKARDRSREWLERVKKIIEKVKEDSKRWLDEVRKLIRDVEDIRRRGKADDKTVEKITREARKRDEEHKREVEKVAKTIEDLNRKHEEEVKDILRRVKELLEDLRRRSDTERVREVIDRIRKLLKDIIDEARDVNKKVRDLLKRIVEEVTEVNKRVKELVEEIVRRIK

SEQ ID NO: 23144 - protein, 181 aa, Artificial Sequence; identical to SEQ ID NO: 23143
  Synthetic sequence.

SEQ ID NO: 23145 - protein, 181 aa, Artificial Sequence
  Synthetic sequence.
DELREALKRVADIVRTIEEAVRKSLEDSKRIVDDIRRASKEALEEVEKIVRTLVEIVRNGRADEKVVRKIATDAEDLSRKHKEALDRILDELKKLNEENRRALEEILRRVKRLLEELKKDVDRKEVRDVIREVEKLLREVEKIVRDVNRESERLAKEVRDDATEVNERVKELLKRAEAAVR

SEQ ID NO: 23146 - protein, 181 aa, Artificial Sequence; identical to SEQ ID NO: 23145
  Synthetic sequence.

SEQ ID NO: 23147 - protein, 179 aa, Artificial Sequence
  Synthetic sequence.
SVVEELRRTVKELLDEIKRRDDRLLKEVEEVAREVERKDDELRKKVEEILRRIKELRDRGRVDKRDIDRIVEELRRISEEHKKEVERLKDDIRRRSREHEKEVRRLLEEAKEVLKRAKEENRVDDRVLKELKELMDEAKKNSERVNKKVEDLLRRLDESSRRVNEEIEKRLTELLKAVE

SEQ ID NO: 23148 - protein, 179 aa, Artificial Sequence; identical to SEQ ID NO: 23147
  Synthetic sequence.

SEQ ID NO: 23149 - protein, 179 aa, Artificial Sequence
  Synthetic sequence.
SVVEELLKRVRERLEDVDRVLRTWLEEVERLAEEVKRLDRELEKDVKRILDTIEELKRQGRVREEDIKRILTEAEKRSREHEKRVRDLLERLKREDDRVNEELKRLLEELKDELRKAKEENNVDDKALEDIKRLLEELRKRVEDVSRRVNKLLRDLEENSKRVNDELRKRVETLVERVR

SEQ ID NO: 23150 - protein, 179 aa, Artificial Sequence; identical to SEQ ID NO: 23149
  Synthetic sequence.

SEQ ID NO: 23151 - protein, 175 aa, Artificial Sequence
  Synthetic sequence.
REIEKVLKELRDIVRELEKLLEDVVRKIRKIVEETRKLLEDVVRESDKIHRDAKELMERAGVDERLVRRLDKHAKDHKKDVEDIIRENEENLKKLDKEVRDIIRELRELLKELEKANIREDELRKRIAELAERVKRMVKKLDEHAKRDFRRVEEEVRRLRENVKRVKDEVDEAVR

SEQ ID NO: 23152 - protein, 175 aa, Artificial Sequence; identical to SEQ ID NO: 23151
  Synthetic sequence.

SEQ ID NO: 23153 - protein, 175 aa, Artificial Sequence
  Synthetic sequence.
SEIEKVLEELRRRVEELEERLKTVVDELKKIARRTEEKLDKVREEIERIYREAKDLLRRAGVDERLLKRLDEDLKRLEKKVRDVKKENRDNLKRLEDRIREIIEELRRRAKRLEEANVRSDELRKAIAELERRVDKMLKELRDHITRDEDRVRRILEELRRHVERSLKRVREEVN

SEQ ID NO: 23154 - protein, 175 aa, Artificial Sequence; identical to SEQ ID NO: 23153
  Synthetic sequence.

SEQ ID NO: 23155 - protein, 181 aa, Artificial Sequence
  Synthetic sequence.
SELEKVLEDVERRLRELKERNDRVLEEITKIHEDAKRENDEVLKEISRAHKEATEELERKIGDKKRLEELKKELEKHNKEIEDSVRELKKKLRKHNEDLRKSVEEMKEELERALKEVREVIRDSSLEELRRKLKELEERSERHLEELRRSAETVLRESREHLRRLEDSLRRVRKKVKEETD

SEQ ID NO: 23156 - protein, 181 aa, Artificial Sequence; identical to SEQ ID NO: 23155
  Synthetic sequence.

SEQ ID NO: 23157 - protein, 181 aa, Artificial Sequence
  Synthetic sequence.
SEIETVLRDVKDKLEKLKRDNDKVLDEITKIHEEAMRRNDKVLEDIRRALEELKKRLEEKIGDKEELKELKKELDDALRRLKESVDKVKKELRDHNKTLEESVRRVKEKLDRVLEEVRKVAETARLEELKKELKKLEDESRKHLEELRRSLEEVTRRSDKHLKELKDRLEELRRKVEAATD

SEQ ID NO: 23158 - protein, 181 aa, Artificial Sequence; identical to SEQ ID NO: 23157
  Synthetic sequence.

SEQ ID NO: 23159 - protein, 181 aa, Artificial Sequence
  Synthetic sequence.
SELEKVLEEIRRELEKLERANKKVLDDAKRIHDKAKEDLRRVLEEIKRRLEELEKRLEEAIGDDKRLEELRKKLRKVLEELEKRARDVERELDEHNDRLRDSVRRMKRRLEEALKRIARVIETSRVEELRKELEDLRRESEEHLERLRDSARRVLEKVRRILKELRDRLRELAEEVKRATD

SEQ ID NO: 23160 - protein, 181 aa, Artificial Sequence; identical to SEQ ID NO: 23159
  Synthetic sequence.

SEQ ID NO: 23161 - protein, 181 aa, Artificial Sequence
  Synthetic sequence.
DELETVLKRVEDLLRRLAEELRRVLEEARETLERLKAANEKVLEEITRTHEEAKRRLDRDIGDKKELEELKKKLDRHNEEIRRSVEEVKKRNEEMLDTIRRKVETVKRKLDEALKRVAELIKTSRVEELDKEAKDLVKEVDEILKRIREELKKLKEDNDKHLEELKESLKRVKDEVDEARR

SEQ ID NO: 23162 - protein, 181 aa, Artificial Sequence; identical to SEQ ID NO: 23161
  Synthetic sequence.

SEQ ID NO: 23163 - protein, 181 aa, Artificial Sequence
  Synthetic sequence.
SELEDVLRDAERIIREAKEDNERVLRRLKETVEKLIKDNDEVLKKLTESHKKLTKELKDAIGDKKRLEELKKKLDEHNRRLKESVERVKRKNKKVLDELRRSVEEAKKENDRALDRLRRAIETSRVEELKEEIKDILRRNREHLEELKRRIDELRKENEKHLRDLEESIKEVEKEVRESRR

SEQ ID NO: 23164 - protein, 181 aa, Artificial Sequence; identical to SEQ ID NO: 23163
  Synthetic sequence.

SEQ ID NO: 23165 - protein, 181 aa, Artificial Sequence
  Synthetic sequence.
SEIETVLEDAERKIRELKKRLEDVLRRLAEIYTRAKELLKRVLDELRKIYEDLKKKLEEKVRDEKRLRELKRKLDEALRRHEKNIRDISKRLDDELRRHEEHIKDIMRKLDEILEELRRLAEKVRVEELKKRLDEVARRVEKVLRENEEEIKESLKEVEKMLRRNRKEIKDSEKEVDDEVK

SEQ ID NO: 23166 - protein, 181 aa, Artificial Sequence; identical to SEQ ID NO: 23165
  Synthetic sequence.

SEQ ID NO: 23167 - protein, 181 aa, Artificial Sequence
  Synthetic sequence.
DELERVLEDAETKIRDLKRKLKEVLDKLRRIYEELEERLKRVLEEIEEIYRRAAEALRRKVKDEDKLRELVKELKRMLDEHRDNIRRIKEDLRRRLKEHEDDIERAKEELDRILERLRRLIDKVRVEELKRELEEVAKRVEEILRRNEEEIKKSEEKIRKVLRDNREKAKRSLDRVREALK

SEQ ID NO: 23168 - protein, 181 aa, Artificial Sequence; identical to SEQ ID NO: 23167
  Synthetic sequence.

SEQ ID NO: 23169 - protein, 181 aa, Artificial Sequence
  Synthetic sequence.
DELKKVLDDARETSDRLKKENETVFRELEEIYRRLEKELRRVLRELEEIYRRAEDKLTKSVRDEDKLRDLRRRLKEELDRHRDNARRIVEKLKEMLDRHREDLERIREENDRLLEELERLIDDVDVSELDKRIRELERRNRESVKENRDRLKESADDVKRALDRNREELEESERRVKKAVD

SEQ ID NO: 23170 - protein, 181 aa, Artificial Sequence; identical to SEQ ID NO: 23169
  Synthetic sequence.

SEQ ID NO: 23171 - protein, 181 aa, Artificial Sequence
  Synthetic sequence.
SELEKALRDAEEIIKKAKKLLKEALDEAEKIYREAAKLLDDALREAEKIYREAADALDKKVKDEKRAREAKEELKRALKEHRDDAKRAKDELRKALEDHRRNIDKARRELDEIAKELRKLIKDADAKELRDRAKEAADRAKRAAEENRKKARESLERAKRAAEDNRKKAEESLKRAEETAR

SEQ ID NO: 23172 - protein, 181 aa, Artificial Sequence; identical to SEQ ID NO: 23171
  Synthetic sequence.

SEQ ID NO: 23173 - protein, 181 aa, Artificial Sequence
  Synthetic sequence.
SEIEDVLRRAKEISDRLKRENDRVLDELRRSYEDLERELEEVLRKLEETYRRAKEELRKKVRDKDKLKEIMKRLDEELKRHEEDIRRIVEELRERLDRHRRNIDKLKKENDDMLRELEKLVDKVDVSELRERIERLKERNRKSLEKNKRDIARSEEEVRKALERNEDEIRRSEEEVKKALK

SEQ ID NO: 23174 - protein, 181 aa, Artificial Sequence; identical to SEQ ID NO: 23173
  Synthetic sequence.

SEQ ID NO: 23175 - protein, 181 aa, Artificial Sequence
  Synthetic sequence.
RELEKVLEDIREISERLEKRNRDVLKELEDIYREAKKRLDDVLRKLKETYDRAEEELRRKVRDEKKLRDIVRELRDLLRRHEEDIRRIKKELDDELRRHEEDIERIRRRNEEALRELTKLIDKVDVSELRKDLRKLAEDNRRSLEENKKEITESLKEVEKVLERNKDEIRKSKERVDKALE

SEQ ID NO: 23176 - protein, 181 aa, Artificial Sequence; identical to SEQ ID NO: 23175
  Synthetic sequence.

SEQ ID NO: 23177 - protein, 181 aa, Artificial Sequence
  Synthetic sequence.
SELERVLDEMRKIIERLEEELRKVLEDLRRIYEELKRKLDDSLRESERRVRELKEELDRKVRDKDKLREVKERIDDALRRSRKRIEDIKRKLDDALRRHAEDIERIIKELRDILEELRKLIDKVRVEELKDTIDKVKKRVEDALEKNRRDIDESRKEVDDELRKDEEKAERLAREVEKAKE

SEQ ID NO: 23178 - protein, 181 aa, Artificial Sequence; identical to SEQ ID NO: 23177
  Synthetic sequence.

SEQ ID NO: 23179 - protein, 178 aa, Artificial Sequence
  Synthetic sequence.
SSDETVKEKVKKVARDVDRHVEKLRKALEEMEREVREHVKRLEDELRRMDEEVKRVREEPVDEERLKRITDRLREELRKLHEDSKDTIRKLREKLEKLKKETEDTKRRLRKKLEDLRREKGADEKVLRDAERIVRELERKLDKVDTEIAETVKRLEDTIRDVNRKIKDRVDKLRKELE

SEQ ID NO: 23180 - protein, 178 aa, Artificial Sequence; identical to SEQ ID NO: 23179
  Synthetic sequence.

SEQ ID NO: 23181 - protein, 178 aa, Artificial Sequence
  Synthetic sequence.
DSDEKVKRVLEELRKEVKEHVERLRARAEDMSREVKDHVRKLKEDLERMERDVERVKRKPTDEKTLKEIADRLRKILEDLERETEETKKRLEEKLRKLHKETEESKKRLEDKVDTIRKEKGASEEVLERVRTEVERLKRELDKVNEDIRKRVEELKKELDEVDDEIRKEVDRLEEALK

SEQ ID NO: 23182 - protein, 178 aa, Artificial Sequence; identical to SEQ ID NO: 23181
  Synthetic sequence.

SEQ ID NO: 23183 - protein, 178 aa, Artificial Sequence
  Synthetic sequence.
SSDEEVKKKLEEVKEEVKRHVERLKRALEKADRDVKDHVRRLKEVLKRMADEVEKVRREPVDEDRLEKVVRDLERKAEKLKRETEETAKRLRDILKELKDRTEKTKKRLRDKVREIRKEKGADEKVLKDVEEKIRRLEKELDEVNEDIERKVRELEKELRAVDEEIKRIVDRLRKELE

SEQ ID NO: 23184 - protein, 178 aa, Artificial Sequence; identical to SEQ ID NO: 23183
  Synthetic sequence.

SEQ ID NO: 23185 - protein, 178 aa, Artificial Sequence
  Synthetic sequence.
SSSERVKTELDRMRKEVKRHVEELEKELKRLTEKVKRHVEESKKNAEEITRKVEDVRRKPTSEEDLKRIIEDLRRNLKENRDRTERTKEDLRREVERLKKETEDTKRELERKLKRLREEKGASEEVLREVTREVTRLREELDEVNKRVEKRLEELERELDRSDEEVTRIVEELVDELR

SEQ ID NO: 23186 - protein, 178 aa, Artificial Sequence; identical to SEQ ID NO: 23185
  Synthetic sequence.

SEQ ID NO: 23187 - protein, 178 aa, Artificial Sequence
  Synthetic sequence.
SSEEDVRRKLEKMRKEVDEHVRKLEEDLKRLAEEVKRHVEDLERVAKEVADRVEEVRRQPTDKDELRKIVEELRDTLKKLRDRTEESKKRLEKLLRDLKKETEETKKRLRESLRKLEEDKGADKKVLDTARDILRKLEKKLDDVDEKIERIVEKLKRELDEVNKRATETVERLIRELK

SEQ ID NO: 23188 - protein, 178 aa, Artificial Sequence; identical to SEQ ID NO: 23187
  Synthetic sequence.

SEQ ID NO: 23189 - protein, 178 aa, Artificial Sequence
  Synthetic sequence.
RSDEELEKKLKELKEEVDEHVKRLEETARRLDKEVRRHVEESKRNLEEMDREVKEVRRRPTSEDELREIVKKLEDNLRRNRERTERSKERLERELDRLRRETEETKKRLRDKVKEIRDEKGADDKLLERAERTVRELERRLDEVNDRIRRIVEELKRKLDRSNEEVTRKVRELSKELE

SEQ ID NO: 23190 - protein, 178 aa, Artificial Sequence; identical to SEQ ID NO: 23189
  Synthetic sequence.

SEQ ID NO: 23191 - protein, 178 aa, Artificial Sequence
  Synthetic sequence.
DELERVVEEVRKRIERLKEELRRVHERSREIVDRLRKELEKSLEEVRRIVEDLKRKLRERGVPEEMLTRLERKLEEDEKRVKDIIRELERKLEEIAKTDKEIIDRLDEKLRELEERLKRGLREEDLERMADKLRKDVERAVRKNETDADKLRREVEEVVRRNKKTAKELEDEVRKELT

SEQ ID NO: 23192 - protein, 178 aa, Artificial Sequence; identical to SEQ ID NO: 23191
  Synthetic sequence.

SEQ ID NO: 23193 - protein, 178 aa, Artificial Sequence
  Synthetic sequence.
SEREKVAKEATDIVEELKKTLKDVHRRSKEIVERLVKKLADVNKDSRDKAEELKKRLDDRGVDKRVKKELEDRLRKLHRDDERIIKRLRDELKRIEKEDRDIIRRLDKELKDLARLLDKGLREEDVKRIAKKLEEDVRRVVRKNEEEIKKLAEEVDRVVEDNKRLVEELKRRVDEALK

SEQ ID NO: 23194 - protein, 178 aa, Artificial Sequence; identical to SEQ ID NO: 23193
  Synthetic sequence.

SEQ ID NO: 23195 - protein, 181 aa, Artificial Sequence
  Synthetic sequence.
DADDELRKIVEEADRRSKESVREIEELLRKLEREVEDIVRRIKKLSDDTRKRIDDLRKEGKTEELKKRVEKELRDNKEELKKILEEVRDRARRAREVLKEMEDRSREVVERIRKVLEDLRRKGVVSEEVLKRVEEIIKRLEEENRKVLEELERSVRKLEEDIRKVLEDNDRVVKELARRID

SEQ ID NO: 23196 - protein, 181 aa, Artificial Sequence; identical to SEQ ID NO: 23195
  Synthetic sequence.

SEQ ID NO: 23197 - protein, 181 aa, Artificial Sequence
  Synthetic sequence.
SAVEKLEELVERVARRIDELVKKIKELLDDVERKSEKTVRDLERLSEETKRSIDDLRREGKTEELLERVRREAKKNREKVKRVEERSRDLVRRVREMLKKIKREVDELLREAEESLKELKDRGVVSEEVLKRVRETLERLERKIKKVLDELKKRVEELRKKNEDVVRRNEEVVKKLVEDIR

SEQ ID NO: 23198 - protein, 181 aa, Artificial Sequence; identical to SEQ ID NO: 23197
  Synthetic sequence.

SEQ ID NO: 23199 - protein, 184 aa, Artificial Sequence
  Synthetic sequence.
SVEDVIRDLRRVITESRELSERVLERIEETTRRSKEESKRVADKVKKSSDDLREAVERIRTPEEEKDRLEKELRKLVEENRKSLEESKRDLDDLLRRNRKTVEESRRELDELRDRVEKVLKRGVSDEKAKELLRRVKEVVDRNKEKLDRDLERNKRRIDENRRKLEEDLRRNRKVVEELRKRLE

SEQ ID NO: 23200 - protein, 184 aa, Artificial Sequence; identical to SEQ ID NO: 23199
  Synthetic sequence.

SEQ ID NO: 23201 - protein, 184 aa, Artificial Sequence
  Synthetic sequence.
SVEDVAREIREVLRRLEESVRKVAEDNRRNNEELRRLVEEVLKRIRDSSDRLRKVVEDIDVPEEKKKELDKRLKKLIEDNEDSIRRLREKIERSIRENEERLKRITDRLRKLRKEVEDVLRRGVSDEVLERLLRRVREAVKELEDELERSSREDNRRSRELEEELKKDLKRNEDEIRDVERALK

SEQ ID NO: 23202 - protein, 184 aa, Artificial Sequence; identical to SEQ ID NO: 23201
  Synthetic sequence.

SEQ ID NO: 23203 - protein, 184 aa, Artificial Sequence
  Synthetic sequence.
SVEEVLRRAEEILTRSKEESRRVFEEIRETTERSKEVSKDVARRNKEILDDLKRKIEEVDVPKKDLERLEKRLRELEEHLERFLRESKRELDELLRKNEDTLRKSKRKLDELRKEVKEMADRGVSDDVLRRLLEKIEEVVRDNERELKEDLDRNRKVIEENRKKLEDHLRRTEEEVDDIRRKLK

SEQ ID NO: 23204 - protein, 184 aa, Artificial Sequence; identical to SEQ ID NO: 23203
  Synthetic sequence.

SEQ ID NO: 23205 - protein, 184 aa, Artificial Sequence
  Synthetic sequence.
KVEEVSKKLKDVLRELEELVERVLERNRENNERLRDKVRKVLEENKEVLDRLKKEVDDIDVEERKLRKIKRELEELERHLRETARRLEKKIRDSIEKNERDAERLRRDLKRLDEELKEVEARGVDEEDLRRLLEKIKREIDRLAKELEDSSRDDNRISRELDEELKRHLEETRRAVREISEKLR

SEQ ID NO: 23206 - protein, 184 aa, Artificial Sequence; identical to SEQ ID NO: 23205
  Synthetic sequence.

SEQ ID NO: 23207 - protein, 172 aa, Artificial Sequence
  Synthetic sequence.
SRAEEVLKKVEEEVKKLEDELRRSSERNNRESRRLEDELKKVLDKNRKLVEDLRRARLDEEDVRRTLEESEEENREIDKRARDELRKMEEENKDVLRKAREKLERIRKEIEEANLPKEVVDELRRVLERLRRVIEDVIRRNKEDTDRLEREIERVRKELKDINKKLEEDVRR

SEQ ID NO: 23208 - protein, 172 aa, Artificial Sequence; identical to SEQ ID NO: 23207
  Synthetic sequence.

SEQ ID NO: 23209 - protein, 179 aa, Artificial Sequence
  Synthetic sequence.
DEAETLLRDVERKVEELKRRSEKLLRDVEELVRRLLRSNEESLKKVKEDLKRLKDLVRRGDVDEETVKEVKKRLKEILDEDKKELREVIERAKEISKRHKEEVEKAVEDLKRILEDMARKGVRDEVLREVDRVIDDVRRALKKVNEEIEEVIRRLKRESERVNKEAEEIIRTLEDALRK

SEQ ID NO: 23210 - protein, 179 aa, Artificial Sequence; identical to SEQ ID NO: 23209
  Synthetic sequence.

SEQ ID NO: 23211 - protein, 172 aa, Artificial Sequence
  Synthetic sequence.
DDLERVLEEIRREIERIRRELEESNEENKDIVRRIEEELKELLKDNKRIVETVTKANLDRDDVRRVLEESKRKNRRVLERLERLIRESERRNKELLDRAREKIDRLRKRLEEANLDREVLERLEKELDRLRKDIERVADENRKINDTLRKRIEEVMARLDEINTDLKDRVET

SEQ ID NO: 23212 - protein, 172 aa, Artificial Sequence; identical to SEQ ID NO: 23211
  Synthetic sequence.

SEQ ID NO: 23213 - protein, 177 aa, Artificial Sequence
  Synthetic sequence.
SSDEVLKEIEEIIRRLEEEVRRVNKEVNKSTEDLRREVEEVLRRTNELIEELERRVTRTEELKRVIDELRDRDRKVRRRVERVIEESKKRDDESRKRLTRAVEKLRKDLKKLADDNVPEEALRKAIKDVRDIVKKVKDELKEWRDRNKELVDRLSEELKEWLKDVERVLKELTDKDR

SEQ ID NO: 23214 - protein, 177 aa, Artificial Sequence; identical to SEQ ID NO: 23213
  Synthetic sequence.

SEQ ID NO: 23215 - protein, 177 aa, Artificial Sequence
  Synthetic sequence.
SLEEVLERIKRIIDELKREAKRVLDETNTLIREVKKRLEDVNRDVNRLIEELRERVTDTEELKRVIERLRREDEKSKREIEREVETLKKRDDEVRKKLDDVAKKLRDDLKEAAERNVPEDMVRDLERRIREVVKRLKEDLERWKKEVEDEIKRLEDRLKEWLDRVREMLEKLREEDR

SEQ ID NO: 23216 - protein, 177 aa, Artificial Sequence; identical to SEQ ID NO: 23215
  Synthetic sequence.

SEQ ID NO: 23217 - protein, 177 aa, Artificial Sequence
  Synthetic sequence.
SSEEVLKTIKDIIDELRKEAEEVLRRTNESTKELEERAEEVNKRVNDSTRELAKKVTDTEELKRIIEESKKKDEDSRREVKKVLDESRKRDEEVRRSLKKIIEDLEKELRDLARKNVPEEMLDEVKKRAEKVVEDLRRELRKWLEDNKRLVEKLEKELRDWLKENKELVKELEDRDR

SEQ ID NO: 23218 - protein, 177 aa, Artificial Sequence; identical to SEQ ID NO: 23217
  Synthetic sequence.

SEQ ID NO: 23219 - protein, 177 aa, Artificial Sequence
  Synthetic sequence.
SSEEVLDTLRKLIEDLRRRAEEVLERTNRSTDELRKRVEKVLEETNRLIKKVEDDITRTEEAKTIIDKLREDDERVKRRIERVLEESKRKDEEVRKRVKDVLDRLREELKRLREENVPEDMLREALERIKEIIDRLERELEEWIKTNEDLVRRLTEDLERWLRTVAEILKRLKDEDD

SEQ ID NO: 23220 - protein, 177 aa, Artificial Sequence; identical to SEQ ID NO: 23219
  Synthetic sequence.

SEQ ID NO: 23221 - protein, 181 aa, Artificial Sequence
  Synthetic sequence.
DELERVEEEIKKLSDDSRRVIEEVRRRLEESNKDLERRLREVEKRLKELTDDIKRTAERNNVDKTLEKKLRELNERNRKSKEDLKRRSDETRERNDETIRESRKENDELERRVEEASRRGLDRELLRKLLDDVRRVVERNKRKLRKDLEDNKREIERVKREADKDLEDHERVIRKLKEDIR

SEQ ID NO: 23222 - protein, 181 aa, Artificial Sequence; identical to SEQ ID NO: 23221
  Synthetic sequence.

SEQ ID NO: 23223 - protein, 181 aa, Artificial Sequence
  Synthetic sequence.
DELERVVEEIRELSRDSERAIEEVRRELKRTNDENRESAKRVAEELKKLTDKIKEEADRNNVREDLDRELRRLNEDNKRSIRENEERLKKTKRENERTIEESKKRNKELEDEVEKAIKDGLDRELLRELLKEVRRVVEENKRRLEEDLKKNRKKIDDSNKELRKDLEDHRRVIEKLEREIR

SEQ ID NO: 23224 - protein, 181 aa, Artificial Sequence; identical to SEQ ID NO: 23223
  Synthetic sequence.

SEQ ID NO: 23225 - protein, 175 aa, Artificial Sequence
  Synthetic sequence.
DELEKVKEDIKRLLDDVRREVEKVNRDSRRLLEDLRRVVKEVSDRSKELAEDLERKVGRDEDVERVKRELEKLNRELERILEEAAREVKRLNKEHDDKLKKAEDDVRKLLEELERDNLPVEDVLREVKRLAEEVKKETKRVLDEIKKLVEDVARELERILEDSERLIREVEKRAT

SEQ ID NO: 23226 - protein, 175 aa, Artificial Sequence; identical to SEQ ID NO: 23225
  Synthetic sequence.

SEQ ID NO: 23227 - protein, 175 aa, Artificial Sequence
  Synthetic sequence.
DEIEDVLRRAKKLLDDLRRVVKKANDDSRRLLKKLKDKVEEVSRRSRRLAEDLERTVGRDEDVERVARELERLNRKLEDELRRVATEVRDLNDKHRRLLEKAEREVKRLIDELRERKLPVEDVLREVRKIIEDVKRASEKILEESRKLIEDVERRLEEILKRSEDLIRTVKERKR

SEQ ID NO: 23228 - protein, 175 aa, Artificial Sequence; identical to SEQ ID NO: 23227
  Synthetic sequence.

SEQ ID NO: 23229 - protein, 185 aa, Artificial Sequence
  Synthetic sequence.
DELERVLEEIKRLLDDVHRESKRVNEESERLVKKLHDDSRRVLTEIKKLLDDVRRVVEELPKTDELRRKLEEAERRIRELLEELKRRDKELEERAKRLNEKTKEDDKDAARKVEDLLRRLKDENGTREKVEEILRRVRELVKKWKTELERALEENEREVERWKRDLDRILEEVRRVVERVEREIR

SEQ ID NO: 23230 - protein, 185 aa, Artificial Sequence; identical to SEQ ID NO: 23229
  Synthetic sequence.

SEQ ID NO: 23231 - protein, 180 aa, Artificial Sequence
  Synthetic sequence.
DELEKLLEDIRRELKRVREDDKRHNDKVKETLDRVRELIKRLLELIKKVADEIRSLKRRVPREEIRKRLKELEKRLEDLRRTIDKLLKDLEDTSRRWNEESKKRLEELRRRLEKAERDVPRTREVEEVKRRIEEILKEAEETNRRSHEKAKRVLEELKDIVRKVLEELRRLLRELEEEVR

SEQ ID NO: 23232 - protein, 180 aa, Artificial Sequence; identical to SEQ ID NO: 23231
  Synthetic sequence.

SEQ ID NO: 23233 - protein, 180 aa, Artificial Sequence
  Synthetic sequence.
EELERLREEIKKILDEARERDETLLREIRREHEKNKRADEEHNRRVEETLERIERLAERVPREEIKKRLEELKRRSEKWNRDSERSLDEIRRRLKKWNDESRERLERAKRRLEKARRDVPDTEEVRAVERELRKILDEIRKTNKEVHDRIRELLERSKRSNDESHKKVEDVLRELKKRVD

SEQ ID NO: 23234 - protein, 180 aa, Artificial Sequence; identical to SEQ ID NO: 23233
  Synthetic sequence.

SEQ ID NO: 23235 - protein, 181 aa, Artificial Sequence
  Synthetic sequence.
SETDEVRKELRKLLEDSRRAVEEVKKKLDDSNKEVRDRVRRIREELKKLEKEVREIKRKNSDEKELADVVRRIREKAKELKKELRKILEDLDKKYKDLKKENKDILDDLDRRAEELKDRLRKNNVEEELLKELEEVLKRLRELHKRTIDEVEKSAREVKDEIRRLEEELDRVLKKLEDALR

SEQ ID NO: 23236 - protein, 181 aa, Artificial Sequence; identical to SEQ ID NO: 23235
  Synthetic sequence.

SEQ ID NO: 23237 - protein, 181 aa, Artificial Sequence
  Synthetic sequence.
SLDEDVERLIKELKDEARKLNEEMKEYVRDSERKVRRLNEEIRRLIEELKRKAEELKRGNLRRDDLKRRLDELREEVKEIKRRIEKVSEDLKKENDEAKRRLEEVSEELKKKVEEIKEELERRNVDDRVKERLERVLDEAEKSNEETLRELDDVSRRIEESNRRTLAELEKVLRDIEKDVT

SEQ ID NO: 23238 - protein, 181 aa, Artificial Sequence; identical to SEQ ID NO: 23237
  Synthetic sequence.

SEQ ID NO: 23239 - protein, 173 aa, Artificial Sequence
  Synthetic sequence.
SELEKLVEDLRRAAKESHERNEKLLDESRKTVEDVKRKLEEILRRSEEVVREIKKKKKDIDKEKVKRDLDELHKRTRDLLEKLKRELDELHKRSKEELEDNKRRLEELLEKVERDGADEEVRRRVEKLIEENRRSSRRVEEEDKRLLKELKDAIKRVEEEDKKLVEELRRSEK

SEQ ID NO: 23240 - protein, 173 aa, Artificial Sequence; identical to SEQ ID NO: 23239
  Synthetic sequence.

SEQ ID NO: 23241 - protein, 173 aa, Artificial Sequence
  Synthetic sequence.
KEVEDLVKEVKERIEESHKENKRILDKARRVVERVETDLRRILEESKRTVEDIERRKERIDEREVEKRLEELHRETKKLADKLRDELRKLLEDIERELRENEERLRRLLEKVERDGVDEEMKKAVDELIERNKRSSDRVREEAKKLIDRLEEVIEKVERDDEKLVRDLEEELR

SEQ ID NO: 23242 - protein, 173 aa, Artificial Sequence; identical to SEQ ID NO: 23241
  Synthetic sequence.

SEQ ID NO: 23243 - protein, 185 aa, Artificial Sequence
  Synthetic sequence.
SSLETLEKIARDLLREVKETLDRVREESRRLLEEVRRVAEESRKEVERLLKELEEVIRREVRDEKKVEELKRKLEELKRRVDEEHKKSDKRLKEILEENERTLKEVEDRLRELEKRVEDDLRRGLDDELLRELAERVRRVVKKIKDELRDDLRRTREEVERLKERHKELVKRVKEAVDKIREEIR

SEQ ID NO: 23244 - protein, 185 aa, Artificial Sequence; identical to SEQ ID NO: 23243
  Synthetic sequence.

SEQ ID NO: 23245 - protein, 179 aa, Artificial Sequence
  Synthetic sequence.
KEVEEILRDVARLVEDNRRVLERILREVEKLIRDNEERLKEILERSKDLVRRIEELIRRGEVDEDTVREIIERSEELNRRLEKHARDSERRLEKLAEDLRRHAKRSLDELKRLLDELEKRRSDVEEVRRAIEELLKDVERAYEEVVRRIEKLLDDLRRKYEEVKKENERLNRRVEEAAR

SEQ ID NO: 23246 - protein, 179 aa, Artificial Sequence; identical to SEQ ID NO: 23245
  Synthetic sequence.

SEQ ID NO: 23247 - protein, 179 aa, Artificial Sequence
  Synthetic sequence.
DDVEDILRDVERLVEENRRRLEEIVRESEDKVRKNDETLKKILEDVKREVERVERAIERGEVDEETVERIKKKLEELLEELRKHMRKSREESKDLNRRLREHAERSLRTLEELVRDLKRRRSDVKDVVRAIEELLKDVEEKYRRVSERNKELNKRVEDTYREVMKEIRRLLERVDRRAR

SEQ ID NO: 23248 - protein, 179 aa, Artificial Sequence; identical to SEQ ID NO: 23247
  Synthetic sequence.

SEQ ID NO: 23249 - protein, 175 aa, Artificial Sequence
  Synthetic sequence.
TEVERLVERVKEIVEEHRKKLEELARRSEELVERHEKKLRDLLRESRELVERAKKENSKDRTVLKELRDLVRELNKRSKELSEETRRRVAKTNDDSRKTSKRTREEIERLLRELERDDARDEIKERLKELLREAEEVSRRVNKRNEDLLRRLEKVSREVNERNEDLLEELDRTVN

SEQ ID NO: 23250 - protein, 175 aa, Artificial Sequence; identical to SEQ ID NO: 23249
  Synthetic sequence.

SEQ ID NO: 23251 - protein, 175 aa, Artificial Sequence
  Synthetic sequence.
DEVERLVEEVEKLVEEWIRDLERILDESRRTVEEWKKELKRLLDRSKRLVEDAKRKNSKDERVLRELDERVRRINEESKRRNDEAKKESERSLREIEKRNKEVADRVRDILEELRRKDAKKDIERRLERLMEELHRVSKEVLDADRELLKELHDVSREVNKRNEELLDELRKTVT

SEQ ID NO: 23252 - protein, 175 aa, Artificial Sequence; identical to SEQ ID NO: 23251
  Synthetic sequence.

SEQ ID NO: 23253 - protein, 175 aa, Artificial Sequence
  Synthetic sequence.
DEVEETVKRVREEVERWKEELKRIADEVRRLVEKVKDDLRRLLDESRKLVEEVRRENSRDDTVLKRVRDEVRKINEDSKRLLEEAKRRVEKIRREIKKRNDELEERARRILRELDRRDAKSEIKRRLEELLKELHKVSKDLDKILEELLREVEEVVRRVNETNKKLLKELDETVR

SEQ ID NO: 23254 - protein, 175 aa, Artificial Sequence; identical to SEQ ID NO: 23253
  Synthetic sequence.

SEQ ID NO: 23255 - protein, 175 aa, Artificial Sequence
  Synthetic sequence.
SEVEELVKRAAELADEARKRLERIMEEVKRLVDEWEKELKKLLDESKELVEKVRRENSKDERVLREVKKKIEEINKRSREENKKVAEKVREIEERIERLLEELKELIKRIEDKARREDLKEKVREDLRRLLDTLRKVVEELKRRLRELLKKLHDVSRKVNEENERLLRELEETVR

SEQ ID NO: 23256 - protein, 175 aa, Artificial Sequence; identical to SEQ ID NO: 23255
  Synthetic sequence.

SEQ ID NO: 23257 - protein, 175 aa, Artificial Sequence
  Synthetic sequence.
DEAEKLVDEVRELVRRHKETLKEILERVKELVKRWKDTLDKLLRDSEELVRRVKEENSKDERVLRKARKEVRDINEESKERNKELEKRMRRLEREIERVDRETEERIRRILDDARRKDLRDRVKEELKRLLKELKEMSKRLTEELRRLLKELHDRSREVNERNKRLLEEVDRTVK

SEQ ID NO: 23258 - protein, 175 aa, Artificial Sequence; identical to SEQ ID NO: 23257
  Synthetic sequence.

SEQ ID NO: 23259 - protein, 181 aa, Artificial Sequence
  Synthetic sequence.
DEIREVEERNRRSNEEMKKAVREVEKDIERVAREIRKRAEEVSKRNEDINREIRKTLRDKKKLTDILRESKELNRKLEELVKRIKDELDKLLEDLRREVRKIEEESKRTNEDLKKKAKDGTSDETLRRVIRKSEELLKRLKDRLDEVRKRVEEILKRAEERLREVIKRSEELLEEVKRESD

SEQ ID NO: 23260 - protein, 181 aa, Artificial Sequence; identical to SEQ ID NO: 23259
  Synthetic sequence.

SEQ ID NO: 23261 - protein, 177 aa, Artificial Sequence
  Synthetic sequence.
SLLEEVEKTLRKIVEDSDREIKRVSKKNKETVKRLEELMREVNRRSTEIVKRIRDSDLRTEELKRLEEEARKLNDESREILERVTRESERLDRELKKHADESRERAKDLIRRLKKLGDKEMLDRIIEEAKRLHEENKRKLEEVERRSEELLKELKRRLEELIKRNDDLLREVEERKR

SEQ ID NO: 23262 - protein, 177 aa, Artificial Sequence; identical to SEQ ID NO: 23261
  Synthetic sequence.

SEQ ID NO: 23263 - protein, 181 aa, Artificial Sequence
  Synthetic sequence.
DEVEEVIRRAEELVKEVKKRLEELIRESEALLERVKRRLERLIEESRRRLEEVKKKVSSGLDEKTLKEVLDRLRRDVERINEESKRVLDEVEKEIRRTNKKIKEILDRIRKKVEDLEKELRDRGAKDEIKKRLRKLLEEIKKVVDDVRETNKRTLERLEELARRVNEENKKILDDLEEAVR

SEQ ID NO: 23264 - protein, 181 aa, Artificial Sequence; identical to SEQ ID NO: 23263
  Synthetic sequence.

SEQ ID NO: 23265 - protein, 181 aa, Artificial Sequence
  Synthetic sequence.
KEVDEVVKRAEDLLREVKKRLDEVIEDSERLLREVRKRLEEIIRESEKLLEDVRKVVERGLREDELKKLLDDIRKKIRETDEKLKKTLEDLRRAADEINRRTEDILRRIEEKVKRLRDELRTRGAKKEIEKRLEEILREIKKLVEEVNRRNEDILRRLEREVEKVRRVNEKTLERIEETVR

SEQ ID NO: 23266 - protein, 181 aa, Artificial Sequence; identical to SEQ ID NO: 23265
  Synthetic sequence.

SEQ ID NO: 23267 - protein, 185 aa, Artificial Sequence
  Synthetic sequence.
SLVEDIRRDVKRILKEIDKLVKDIEEENRRASRESERLVETIRREVKEVLDRIRKLVRDVPLDEKTLRRIEERIERLRDSIEKMERRMEELNKEHERRVEKILREIEKLLRELDKELEDVAKEPGDRKLIEEIRRRLKKALEDIRRLIEESRKRVEESLTRSRKLAEDIRRELEDVLRKVDEDAK

SEQ ID NO: 23268 - protein, 185 aa, Artificial Sequence; identical to SEQ ID NO: 23267
  Synthetic sequence.

SEQ ID NO: 23269 - protein, 177 aa, Artificial Sequence
  Synthetic sequence.
SRVKEVADRVRDIVRRIKDEIKEHVDRLRDVIRRIKEKLEEHSRRLREIVERIRASNLDKDEVKDKLDKMKKNAEEVHEDIKRKLEDAKRRTEKTKRDIERKLEKLERDVRRAADTVDEELLKRLEDIIRKLLEDIKRVVKELEEVSRTLLREIEELLEENRKSMEKLLRDIEEEAR

SEQ ID NO: 23270 - protein, 177 aa, Artificial Sequence; identical to SEQ ID NO: 23269
  Synthetic sequence.

SEQ ID NO: 23271 - protein, 177 aa, Artificial Sequence
  Synthetic sequence.
SKVDEVVKRLEDAVREIKKEIDKHSKELADEVEKIKKELKDVSDRNREVVRRIREANLSEKDVTETVKEAEKRNRDIEKRIREELKRLEDNVRDMHRKLDKKLKELKRTVEEMRRSVDEKKAEELRKRVDDLLEEIRRLLEENKRTVDKLLDEIKRVLEDHRRSVEELLREIDKDAK

SEQ ID NO: 23272 - protein, 177 aa, Artificial Sequence; identical to SEQ ID NO: 23271
  Synthetic sequence.

SEQ ID NO: 23273 - protein, 175 aa, Artificial Sequence
  Synthetic sequence.
SEVDEVLREAKRIVDEVHKDNERATEESRRLVKKVHEENEEMVKDIERIVKEVKDANIDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 23274 - protein, 175 aa, Artificial Sequence; identical to SEQ ID NO: 23273
  Synthetic sequence.

SEQ ID NO: 23275 - protein, 175 aa, Artificial Sequence
  Synthetic sequence.
SEIEDAVRRIEKRVEEVHRENKKLTDESRKLVREVDEENKKVSRESKKLVEDARRRNADEDIIRELLKELKRRSEEVSKRNEKILKELDDKSKEVAKRNKRVLDEIKRTLKEVLDRRKDARELSEKVREVLEKIKKSLEDHRKANEDLLREIRDSLKKHRDENRRLLKELEETRK

SEQ ID NO: 23276 - protein, 175 aa, Artificial Sequence; identical to SEQ ID NO: 23275
  Synthetic sequence.

SEQ ID NO: 23277 - protein, 175 aa, Artificial Sequence
  Synthetic sequence.
SDLDRVAKELTEIVERIIRELERLTEKSRDIVRKVHKENEDAVRKIRKIVEEVKRKKIDEDTVREILRRIREELKRLKERNEEILERIKEESERVERTIRKVLEEMKRKLDRVRERRPDARELEKRVRDLLRRVEEALRRHKEENRKLLEDIKRSLEEVAKEVERVLKEIKDTAR

SEQ ID NO: 23278 - protein, 175 aa, Artificial Sequence; identical to SEQ ID NO: 23277
  Synthetic sequence.

SEQ ID NO: 23279 - protein, 175 aa, Artificial Sequence
  Synthetic sequence.
SEMDDVLKKLAETVKRIIERLKKLTDDSRRLVEEVHRRNDKLSKESREAVRKAEERNIDEKDVRKLLEDLKKKSEEVAERNKRILDTLREISKRAEDEVRKVLKELEKTLKELEDRRPDVRELSEEVKKLLDEVRKALKRHKDENDKLLKEIEDSLRRHKEENDRLLEKLKESTR

SEQ ID NO: 23280 - protein, 175 aa, Artificial Sequence; identical to SEQ ID NO: 23279
  Synthetic sequence.

SEQ ID NO: 23281 - protein, 175 aa, Artificial Sequence
  Synthetic sequence.
DEAREILKEIRDIADELRKRLERLTERSERIVREVDKENRRVVEEIREIVERVKKAKIDEDTVRKILREIEEKLDRVAKRNEKILKKIEDDSRRVAKEVREILKKIEDILDDARRKRKDVRELKKEVERVLEEIRRLLEEHERANRKLLKEIRDSLRELKKRVEEVLREIKEATK

SEQ ID NO: 23282 - protein, 175 aa, Artificial Sequence; identical to SEQ ID NO: 23281
  Synthetic sequence.

SEQ ID NO: 23283 - protein, 175 aa, Artificial Sequence
  Synthetic sequence.
SEAEEMLERIKRRVEEVNKENKKMTDESKKIAEDVDRDNREVLREIKRIVDEVRKRNIDEDTVRKIEREIEKTLEDVRRRNDEILKDIRRLSEEASRRNKEILDTIRETLKRVRERRKDVKELEKEVERVLKEIKDSLRRHRKENEDILREIKESLDELDKEVKRVLKEIRDTAR

SEQ ID NO: 23284 - protein, 175 aa, Artificial Sequence; identical to SEQ ID NO: 23283
  Synthetic sequence.

SEQ ID NO: 23285 - protein, 175 aa, Artificial Sequence
  Synthetic sequence.
SELEEVAKELRKTLEDSTRENKKHTDDVRRIVDEVDKRNRKAVEDIRKIVDEVRKRKIDEDLVREILRRIAEKLRRLREENRRILEEIKKSLRDMERRNEKINRETKEKLDRVKERRKDARELEEIVKRLNERDKEVLEKDAEDVKRVLEEIKESLERVARDVERVLEDIKRATD

SEQ ID NO: 23286 - protein, 175 aa, Artificial Sequence; identical to SEQ ID NO: 23285
  Synthetic sequence.

SEQ ID NO: 23287 - protein, 181 aa, Artificial Sequence
  Synthetic sequence.
SALEDLERKVEELIRRLDELLREHRETLERLIRELDKLLTDHHRRNRELLERIKDVVRKAGRELEDIREILERLKKLNEESADIVRRVKEELKRILEKSEKEVRELKETLRRTVEEVKRVKDEDKLRKIVEELERLVDEVRRSLEKASKRLKDLVKEVKKRLEDITRESEELVRRVEERTR

SEQ ID NO: 23288 - protein, 181 aa, Artificial Sequence; identical to SEQ ID NO: 23287
  Synthetic sequence.

SEQ ID NO: 23289 - protein, 181 aa, Artificial Sequence
  Synthetic sequence.
SALEELKKEIKRVIEELKRALERHHKENEELRKRIDEVLKEHHDANRRLLEEIKELVRRAGRDLEEIRRIEEELKELDKESEERVRKIKEELKKLNEDSRKKVEDLKKELEDDLKRVDKVKDEEKLKEIVKEIRKKVEELKDDLRRMSEESRRLVEELEERLRRLTERSKRLVEDVRRRVT

SEQ ID NO: 23290 - protein, 181 aa, Artificial Sequence; identical to SEQ ID NO: 23289
  Synthetic sequence.

SEQ ID NO: 23291 - protein, 172 aa, Artificial Sequence
  Synthetic sequence.
SEKEELDRKIEDVRKKVEETSRKLKRVNDESKKEVKRTSDELRKKSKEVNEAVEREGVREEILKEITDLSREMEERSEKLNREVDRLVKESRKRSKELNDEAERLLRDLARKKELDVEEAIRRLKETLDRHREEVEDLIRKSREVLKRHEERVRELIKRHEDTLRELKKRAK

SEQ ID NO: 23292 - protein, 172 aa, Artificial Sequence; identical to SEQ ID NO: 23291
  Synthetic sequence.

SEQ ID NO: 23293 - protein, 178 aa, Artificial Sequence
  Synthetic sequence.
SEVDELMKRLKDEAEDIKEKVERLIREWEEAARKIAERVEKLVRDWERVIETLRDLKKRVDKEELKKRLKDLEEEVKREDKKSKDDLRRLEERVERENKKSEDRLEELRKRVKDNENEDKDLAERLRRVLREVERLVRTVNKKHREVLEEIRKEVERVNDEHRRVLEEIKRRVEKDVK

SEQ ID NO: 23294 - protein, 178 aa, Artificial Sequence; identical to SEQ ID NO: 23293
  Synthetic sequence.

SEQ ID NO: 23295 - protein, 184 aa, Artificial Sequence
  Synthetic sequence.
SAEEKLDTEVRRIAEEVKRIIDELRKVTEEVEKRIREINKTSEDTSREVKKTIREVLKRLTDEETVRRVEEKLRKLDKESRDTLRRSEETLRELKRRSDETIRRLERILEKLEEEVEDMKRKPLDEDTVEEVLERLRRALEKADKLVKDHIKRLKDVLRAIEEDHRRHLERLRRMLEEIKKEVT

SEQ ID NO: 23296 - protein, 184 aa, Artificial Sequence; identical to SEQ ID NO: 23295
  Synthetic sequence.

SEQ ID NO: 23297 - protein, 184 aa, Artificial Sequence
  Synthetic sequence.
SVEEKLTREAERLLKRIEEVIRRLRDANRRSADRIRRIDEKTRREVEKLKKKIRELAKRVKDEEVLRRIEKLLRDLKREVEEVSRRNEEILRESNKRLREVEEKLREILRRLKERLDRVREKGIREDLVEKVIKTMRKIVEDLERDVRKVIRDDEELVERLRRENEEVIKKLREIVKRLEDETR

SEQ ID NO: 23298 - protein, 184 aa, Artificial Sequence; identical to SEQ ID NO: 23297
  Synthetic sequence.

SEQ ID NO: 23299 - protein, 184 aa, Artificial Sequence
  Synthetic sequence.
SLIERLREVAEDLKRRIRKVLEDLRRANEESAKRIRDIDRRTREANRESNERIKEIAKRVDDKRVLDELKKIVEDSNDEVRRVSERNEEILKRSNEDLKRVEDDIKRVLDELEKTLEEVDRKDIKEEKVKKVIDDMERIVREIEEKIKRVIERDKKLVKKLEEDNRRVIKKDKDLVRRLEERTR

SEQ ID NO: 23300 - protein, 184 aa, Artificial Sequence; identical to SEQ ID NO: 23299
  Synthetic sequence.

SEQ ID NO: 23301 - protein, 177 aa, Artificial Sequence
  Synthetic sequence.
SLKERLRDDAKRLLDEDRKVLEDLERRAKEINDRNEEIVKKLRDKVREILERIDREVRDKDEVTRVKRKIEEILRTLEDRIKKVNDRTREILDRVRKKSEDSLRELKRLLDEVRRVDKEEVIRRILEELRELVERSERTVRDIERELDELIDKSRRDVEEIIKDLERELEELKRKTK

SEQ ID NO: 23302 - protein, 177 aa, Artificial Sequence; identical to SEQ ID NO: 23301
  Synthetic sequence.

SEQ ID NO: 23303 - protein, 177 aa, Artificial Sequence
  Synthetic sequence.
RVREELEKAAEEVRRRDRRVLEELEKEVRRINEDNKRVHETSREVVERILETIDRRVRDKDKVREVKRDVERILEELEEINKKVNEDTKRIRDTVEKISEESERRLKRLTDEVRRVTDEDVIRKIVRELEELVRESKETVDDIIRRLEELIRKSREDNRKIVEELKKLLDDLTREEK

SEQ ID NO: 23304 - protein, 177 aa, Artificial Sequence; identical to SEQ ID NO: 23303
  Synthetic sequence.

SEQ ID NO: 23305 - protein, 177 aa, Artificial Sequence
  Synthetic sequence.
SLKETLEEVVKRVLETDKRLLEKNDRTVREVNERNRRVHEESRRAVERILEEIDREVRDDKRVREAKTRVREILRRLEEENREVNKRTKRSLEESRKTSKKSLDDLKRLLDEVRRVTDEDTIRRIAKEADDLLEDSRRKVEDNSRRLKRLLEESKKSNEEIVRRLEDLLRRLKKESE

SEQ ID NO: 23306 - protein, 177 aa, Artificial Sequence; identical to SEQ ID NO: 23305
  Synthetic sequence.

SEQ ID NO: 23307 - protein, 177 aa, Artificial Sequence
  Synthetic sequence.
SLKEELEEDVKRINDRNEEVLKRLREVAKKLLDDDRKLLKELKKVVEDVLRDVDREVRDKDKVKEVKERIKKILKEAEEMSRRSLEELKRILAEVERRVAELNKETKRILDEARRVKDAEVIKKILEELEKLIKDSEDTAREIIKELKELVERSKRKVEEILKELEDLLEELKRRAD

SEQ ID NO: 23308 - protein, 177 aa, Artificial Sequence; identical to SEQ ID NO: 23307
  Synthetic sequence.

SEQ ID NO: 23309 - protein, 178 aa, Artificial Sequence
  Synthetic sequence.
SMEEKAEEVIKEVDEENKRLIEEAEKVIEDVEREDRRLVDELRKVIEKVERTIERDLKDLKELLEEARKRLREVEDRLRRLHERTRREVEEVRKRLKELLDESKRNLDKVREDLERTGDKDVIEEIIERLRRHVEDSEEKIRRIIRRLEEVLKRSKEDIERIIEELERLLDEMRERAR

SEQ ID NO: 23310 - protein, 178 aa, Artificial Sequence; identical to SEQ ID NO: 23309
  Synthetic sequence.

SEQ ID NO: 23311 - protein, 178 aa, Artificial Sequence
  Synthetic sequence.
DMDRKLKEEIKRAERRDKELVKDIERVIEEVLRANKELIERIEKVIDDVRREIEKRLKDLKELLKRAKDELDKVRKDLKRLLEESKKNADRVREELKKLHEKSKEDMERIKRELDETGDKDVIEEIIERIKDILRESEREIRRIIKELREHLKKSADRIEKIRRELERLLEKLEDDAR

SEQ ID NO: 23312 - protein, 178 aa, Artificial Sequence; identical to SEQ ID NO: 23311
  Synthetic sequence.

SEQ ID NO: 23313 - protein, 182 aa, Artificial Sequence
  Synthetic sequence.
SEIEKILRELEEHIKDSEREHRELVERLRDHIRRSKEEHRDLIRKLEERIREVERRVRKDGKADERLREDVERLLRDIRRELKRNEDNVKEVNDRIRKRVEDNERDVDRENKRIKDELARSDNKELKDRLKRVSEEHKRRIEDLLRRTKRVSERHREEIRKLLETTERAIKKARETIERLRK

SEQ ID NO: 23314 - protein, 182 aa, Artificial Sequence; identical to SEQ ID NO: 23313
  Synthetic sequence.

SEQ ID NO: 23315 - protein, 182 aa, Artificial Sequence
  Synthetic sequence.
SEIDRLLERLEDHIRKSAKRHRDLVEELREHAERLKRDIERLLEELEKTVRDIEKEVRERGKVDKRIEDRMREVLKRLEDRLRELREDVRRVNEEIKREVRDNEEDVKRVNRELRERLKDSDDEDMKRKLEKVSEEHERKIKELLDRTKRASEEHDERVKRLLDELRRVLKEAEERLRELKR

SEQ ID NO: 23316 - protein, 182 aa, Artificial Sequence; identical to SEQ ID NO: 23315
  Synthetic sequence.

SEQ ID NO: 23317 - protein, 182 aa, Artificial Sequence
  Synthetic sequence.
ERIDRIIKELEDLVDESRKRNDDLVRELKKHIKESKDEHDRLVEELDRFVEEVRKRVEKDGKLDDRMEKEVEELLREVEDRLRRNKKNVDEVNTKIKEDLERNREEAERALKRLEDDLKDSDDEDAIRKLEDVLRKVRETHERLLDKSRDVSRKHREDIKELLKKTKTVIDRVRKRIKELRK

SEQ ID NO: 23318 - protein, 182 aa, Artificial Sequence; identical to SEQ ID NO: 23317
  Synthetic sequence.

SEQ ID NO: 23319 - protein, 182 aa, Artificial Sequence
  Synthetic sequence.
SEVERIEEELRREIEKVDRDNKKIVDEARRSIDELRKDVEDILRDLRRLVDEVEKMARRGEVDEETVKEIERRLEKLLREIEEKSRRHLERLEERLRKVHKENREVEKRLKERLEEVRRRGLSEELLKRVEDVVDEVRKRLERIDEKTRKAVKEVTDRNDELLKRVREVVKEVRARLEEIRR

SEQ ID NO: 23320 - protein, 182 aa, Artificial Sequence; identical to SEQ ID NO: 23319
  Synthetic sequence.

SEQ ID NO: 23321 - protein, 173 aa, Artificial Sequence
  Synthetic sequence.
SEKEKVDKVVKKVAKRIKDLLDEIKRVADESNERLERLLRRLEEASKRSKKKLKDDNLPEDLLKEVTERNERLLREARKVIKRVKEENKRLADEVKEEIDRVRETLKTLRDLVDERDVDTLIKELEDRIDEVEKRIRELIERDKRLVEEVERRIAELIRRDERLVEELKKREE

SEQ ID NO: 23322 - protein, 173 aa, Artificial Sequence; identical to SEQ ID NO: 23321
  Synthetic sequence.

SEQ ID NO: 23323 - protein, 173 aa, Artificial Sequence
  Synthetic sequence.
SEKEKLKDVVRDVERLIKELMERLERVHERTNREITRLLEDARRAMERSNKKLTDLNLDEDELREARKRNKELLREVERIIEEVRRRDEELRRRNKKTIDDVRRELKRIEEEADEKDVDDLLRRLKELIERVRKLIEDSIKELRDIVKEVKDRIKTLIERDKELVKRLEDRAR

SEQ ID NO: 23324 - protein, 173 aa, Artificial Sequence; identical to SEQ ID NO: 23323
  Synthetic sequence.

SEQ ID NO: 23325 - protein, 180 aa, Artificial Sequence
  Synthetic sequence.
SEVDKLVRDLERHIEEAKRRVEELLKEIKKLVEDTKREAKKLLDTLRKKVEDVERENSKDRKDVKKVEEDLARVREEIEKLLRDDERLLREIEERAKKEVDKVRKDNERLREDVERRLKDLEEMLRKMREVSERHKKTIDELRKELKKVLDEWRRRSEKIFEELDEVLKRVEERVKEVER

SEQ ID NO: 23326 - protein, 180 aa, Artificial Sequence; identical to SEQ ID NO: 23325
  Synthetic sequence.

SEQ ID NO: 23327 - protein, 180 aa, Artificial Sequence
  Synthetic sequence.
SEVDELVRRLREHIRRAKERVEELIKRIKTLAKETTDRARKLIEDLKRHIDDARRKNSKDERVLARVREDNDRLEEEIKRLLKEDRDRLEEIKREIDKDVKKVKDDNDELEKRVRKDLKDLREVLKKIKEVSDEHRKEIERLRKRLEEVLREWEDTSREVLERLKEVSKRHRDEIREVAR

SEQ ID NO: 23328 - protein, 180 aa, Artificial Sequence; identical to SEQ ID NO: 23327
  Synthetic sequence.

SEQ ID NO: 23329 - protein, 180 aa, Artificial Sequence
  Synthetic sequence.
SEMEDLIRRLREHIEDVRRKVEELIRELEDHIRRAEESVKKREDDLRRHIEEVRKRNSKDEDDRKKVEEDNRRLDEDIKREVRKVEEDNRRLMKRVEDLVREVEKNNEELRKRVEDRLKDLKEVLDEARRVSKEHKDTLEKLLRKAEEASERHKREIERLLKELKEVSEEHRRRIDEVRR

SEQ ID NO: 23330 - protein, 180 aa, Artificial Sequence; identical to SEQ ID NO: 23329
  Synthetic sequence.

SEQ ID NO: 23331 - protein, 178 aa, Artificial Sequence
  Synthetic sequence.
SEVEELIEDLKRHLKEVADRVEELERELRKHLEEHHRRVREIIRRLEDLLRKAEETRTDEKLKEDLERMLREVEREVRDSERHAKEVNKRVREKVRRIEEHVKRRNKDVEEKVERDVRREDLKRRIEKVSRDHERTVEKLVRDLERVSREHERTVKENKERIKKVLDDARKRVDEVKK

SEQ ID NO: 23332 - protein, 178 aa, Artificial Sequence; identical to SEQ ID NO: 23331
  Synthetic sequence.

SEQ ID NO: 23333 - protein, 173 aa, Artificial Sequence
  Synthetic sequence.
SEVEKLVRELEDVLRKIERKVRELSKDNKRVLDENKKRVEDVSRDNERAMREIEELRRKVDAKDIRERLKEIRDKNRRINEESKRLLRELEKKNEKMLREIEEDLRRLADEARKKTRDEELKKVLEDVKREVEKLLEEIKRSLEEARKTVKESNDEIRESLERLEEKVRRIEK

SEQ ID NO: 23334 - protein, 173 aa, Artificial Sequence; identical to SEQ ID NO: 23333
  Synthetic sequence.

SEQ ID NO: 23335 - protein, 173 aa, Artificial Sequence
  Synthetic sequence.
DEVKDLVKRLEEVIKRIDEVVKEVDRRNREVLERNRELVERSIRELREVLDRIRRRKKDVDRKDIEKILKELEDKSRKINEESKELLDRLRKENEKILREIEERLRELEDEARKKRRDSELDKVLEDVKRKVEEILRRIKRSLDEVERDVRRSNEENKKVTKEVREAAEEIKR

SEQ ID NO: 23336 - protein, 173 aa, Artificial Sequence; identical to SEQ ID NO: 23335
  Synthetic sequence.

SEQ ID NO: 23337 - protein, 173 aa, Artificial Sequence
  Synthetic sequence.
DEVEELVRRLREVLEEIRELVERVNDRNRRVLEENRELVTRSIEELRRALERIERLSKDVRREEIRKILEELEKRSRDINRESEELLRRLAKENKEILDRIKKILDDLREEAKRKTRDEKLKKVLEEVERRAKKLLRDIEESLRRVAREVERSNEENKKVTKEVADAVREIER

SEQ ID NO: 23338 - protein, 173 aa, Artificial Sequence; identical to SEQ ID NO: 23337
  Synthetic sequence.

SEQ ID NO: 23339 - protein, 174 aa, Artificial Sequence
  Synthetic sequence.
DEEKKARDVLERWRKRSEDLLRKAEDVLREWRERSERSFKRLRDVLEEARKRVEELNVPEEILREIRRRLEEMKREIEKLLKEDRDALKELADRIRKIVEDDRRKLRRIEKIVRETKIDDELVREIEEVVKETEKRVEELIKEIREMVKKNEREVREIERRLEETLEKIDRDRK

SEQ ID NO: 23340 - protein, 174 aa, Artificial Sequence; identical to SEQ ID NO: 23339
  Synthetic sequence.

SEQ ID NO: 23341 - protein, 171 aa, Artificial Sequence
  Synthetic sequence.
SEEEEIEKALRDWREELKRLLETIERLLREWKRRVEELKKRIEEALKELKKILDDKGVPEEVRKEIEERIRRLRRRVEEDEETVDREIRKIEEHVKRDATEVDKLIRELKKRREDVEEVKKKLEKEIKKNRENVDRLRRRLEEEVKRNERSVEEIKRRLDEIARELDERKK

SEQ ID NO: 23342 - protein, 171 aa, Artificial Sequence; identical to SEQ ID NO: 23341
  Synthetic sequence.

SEQ ID NO: 23343 - protein, 171 aa, Artificial Sequence
  Synthetic sequence.
SEDEEIKEALKEWRDEVRRLEEKIRRVLEKWERDVRRLKEEIKKSNEDLRRRLEEKGVPEEVRERIKERSERDKKKVKEDEEEVRRRKREIEEHLERDKRRVEKLIDDLRKRRDDVEEVKKRLKRLIEENRKNVKRLEERIREAVKKNEKSVEDSERENRDIARELDEKRK

SEQ ID NO: 23344 - protein, 171 aa, Artificial Sequence; identical to SEQ ID NO: 23343
  Synthetic sequence.

SEQ ID NO: 23345 - protein, 182 aa, Artificial Sequence
  Synthetic sequence.
EEVERLKERLERLSERSKEIAKRVHEENKKLSEESRKLVEDVHRENEEAAKRLEDVARRNELPEEVLRKELDDVRKRNKEILDTLREISKEVEKRNRKILEEIRKRSEEVRREVEEVERRLRGRELLERLRRVLEEHREVNERILEEIKRSLDEHKDTNRKLLEEIEKSLRDLEEIVRRLEK

SEQ ID NO: 23346 - protein, 182 aa, Artificial Sequence; identical to SEQ ID NO: 23345
  Synthetic sequence.

SEQ ID NO: 23347 - protein, 182 aa, Artificial Sequence
  Synthetic sequence.
REIEEIEKEVRDVSKESEDIVRTVHDENRRASERSRELVKRVDEENRKAVEDLERVARENREPKEALDKRLEDLKRRNEEIEKRLEEISREVSRRNEEIKKTIEKLSREVAKRLKEAEDRLKGDELLRRVRKLLEDHKRVNERLLEEIEKSLKRHREENERLLEEIRKSLEDVERVVEEIKR

SEQ ID NO: 23348 - protein, 182 aa, Artificial Sequence; identical to SEQ ID NO: 23347
  Synthetic sequence.

SEQ ID NO: 23349 - protein, 182 aa, Artificial Sequence
  Synthetic sequence.
SELEELEKRLRKAVRDLEEIVDRVRKDLERASDDSRRIVEEVHRENRKVAKELKEVRDRNEEDRTVLRDKLRRVAKRNEDILRKIKEDSKDVKRRARKILKEMADLLDTVRKEIEEVAKDLKGEELLEALERLLRELEKIVRKLLRELEEMLRRHEKTNRELLERIRRSLEELAKIVEDLET

SEQ ID NO: 23350 - protein, 182 aa, Artificial Sequence; identical to SEQ ID NO: 23349
  Synthetic sequence.

SEQ ID NO: 23351 - protein, 182 aa, Artificial Sequence
  Synthetic sequence.
DEIEEIKKELDELSKRSEKIVRDLERELREASKESERLVRKVHDDNRKALEELRDVRRRNDEDDKVLEDRLRKVEEENKRIKDELKKRSEDVAKRIEDILRDIERRSKEVAERAKEMEDRLKGDELLKEVRRALEEHERVNRELLERIRRVLEEHKRVNEELMREIDRSLKELAEIVKRLKD

SEQ ID NO: 23352 - protein, 182 aa, Artificial Sequence; identical to SEQ ID NO: 23351
  Synthetic sequence.

SEQ ID NO: 23353 - protein, 182 aa, Artificial Sequence
  Synthetic sequence.
DELEELRKELKKMVDEIEEIVRRVDKENRDASRESEELVERIVEEVRKAVTELKELKKRNESDRKELEKKLKEVAKRIKDLLRRLKEISDRVAEKNKRILEEIEKRLRDVEERIKRIEDELEGDELLKEVRKALERLKEEVKRVLEDIRRSLEEHRKVNERALRRIEEVLRDLERIVEEVKT

SEQ ID NO: 23354 - protein, 182 aa, Artificial Sequence; identical to SEQ ID NO: 23353
  Synthetic sequence.

SEQ ID NO: 23355 - protein, 182 aa, Artificial Sequence
  Synthetic sequence.
SEVERLKDELRKASEELKKEVEEIEKRLREMSERSRKLVEELKRTLKEIEKELKDIVRKDKEKKEELKRIVEEADRLVKEIEDRLRRLNEKSEEDAKEVDDRLKRKLDESRKRIKEVEKDLKGDRLKEEVERVLREHEKSLERLRERLKELLERHHKTNEELLREIKEALERLEKIVKDLTD

SEQ ID NO: 23356 - protein, 182 aa, Artificial Sequence; identical to SEQ ID NO: 23355
  Synthetic sequence.

SEQ ID NO: 23357 - protein, 182 aa, Artificial Sequence
  Synthetic sequence.
DEVEDAERRLREMSERIEDLVRRVEERLRRMSEESKKLVEDVKRENDKSVEELDRIVRRDKEKKEALRKIVEDDERRVKEVKERLEELNRRSEEDVRRVKEEAKRLLEESDRIAKKLRDDLKGDRLKERLEKLLRDHRRSVEEVIKKLDRLLKEHHKVNEKLLRDIDKSAKEVKKVVEDKTR

SEQ ID NO: 23358 - protein, 182 aa, Artificial Sequence; identical to SEQ ID NO: 23357
  Synthetic sequence.

SEQ ID NO: 23359 - protein, 182 aa, Artificial Sequence
  Synthetic sequence.
SEVEEAEKELREMSKTSTRLVEELEERLRRASETLKKLVDDVKRELDKRLEDIDRRVARNKEKKEELDKELEEVDDRARKVKRTLEDILRESKRLVEKIEEDLKKLDEDSRRSVDDVRRRLKGDRLKERVDRLLEEHHKVNKRLLERIEEVLRRHETTLRELIKEIDKLLRDLKKRIDDVKK

SEQ ID NO: 23360 - protein, 182 aa, Artificial Sequence; identical to SEQ ID NO: 23359
  Synthetic sequence.

SEQ ID NO: 23361 - protein, 182 aa, Artificial Sequence
  Synthetic sequence.
DEVREVKKELKKIAEELRKLIEEVREELRKMSKRSEELVRELKKRNEKSVRDLERIVRKDKEKKEELDKIVKEDKDDVRRIKKELKDLNDESRKRAEEAKRELERIVDRVRERVEDVRRKLEGDKLKEELKEALKDLERELKELIEELKRLLDEHHKRNEDLLREIDKSVRKVEEDVRRLKK

SEQ ID NO: 23362 - protein, 182 aa, Artificial Sequence; identical to SEQ ID NO: 23361
  Synthetic sequence.

SEQ ID NO: 23363 - protein, 185 aa, Artificial Sequence
  Synthetic sequence.
SEVDEVRKELERLVREIKKLVEDSKRNLDRLSKELEERVRDLERDARRLVKELRDLLKENRDEKTVKELIETLKDRVRRTLERIKREVDENRRYLERNKRELERLIRELKKRLEKLLRDVEREIKDKEVRDDVRRLIREVDEELKKAKEDLDRAHEEHEKSTERLRERIKEVVDRVREDIERTKN

SEQ ID NO: 23364 - protein, 185 aa, Artificial Sequence; identical to SEQ ID NO: 23363
  Synthetic sequence.

SEQ ID NO: 23365 - protein, 171 aa, Artificial Sequence
  Synthetic sequence.
DEERRIEKVLKEWEKRTRDLARELERVNREHKKTSEDVLKKLEEINREVRRVVKEENLPEDALRELEKRLEEDHERIEREFRKDKKRLEEDHRRVREEVERSRKKLEELRRRVKDVEKLRRLIEEVIREDERRVERVKRNNKRLSEETEKLVEDVRRNNERLVKEVRDRSR

SEQ ID NO: 23366 - protein, 171 aa, Artificial Sequence; identical to SEQ ID NO: 23365
  Synthetic sequence.

SEQ ID NO: 23367 - protein, 171 aa, Artificial Sequence
  Synthetic sequence.
SEEEEIKKVLDEWRRRTEELRKDLDRVLEEDRRSVEEVKRRLDKVNEELRRRIDELNLPEEEVRRLRDTLKKDHDRIREEIKRSRDNTRRLREEVEREVKKSRDRLEELRKRVTDVERAKEEIKKVIKEDEDLVRRVRKYIEENSDELRRLVEEARKNNTRIAKEAEDTSR

SEQ ID NO: 23368 - protein, 171 aa, Artificial Sequence; identical to SEQ ID NO: 23367
  Synthetic sequence.

SEQ ID NO: 23369 - protein, 171 aa, Artificial Sequence
  Synthetic sequence.
SEKEEIDKVLKEWEEMTRRLVEELKKSHDEDRESVKRLLERLRDVNRELKEIIDRANLPEESVRRLEEKLRRDHKRVERAVDESRKNTERSEEEVRRAVERSKEKLEDLRRRVTDVEKAKETVRKVIKEDRDLVREFKKYNEENSDRMRKLVKDIKENNRRIVEEARERSR

SEQ ID NO: 23370 - protein, 171 aa, Artificial Sequence; identical to SEQ ID NO: 23369
  Synthetic sequence.

SEQ ID NO: 23371 - protein, 174 aa, Artificial Sequence
  Synthetic sequence.
SKEEKLREALKKVRKDVKDLERHIDRSVKRNKEEVDKAKRELERSLEELRRRLEELRRTEELDRELKRLEEKNKEMLKRIDESLKESKKRNDKVKRELREELKRLEEEIRDAERKGLPVEELLERLERTLRRMREKVRKLDKENKDHTEKVKEDVKRVHDENDKVREDVDRKDK

SEQ ID NO: 23372 - protein, 174 aa, Artificial Sequence; identical to SEQ ID NO: 23371
  Synthetic sequence.

SEQ ID NO: 23373 - protein, 185 aa, Artificial Sequence
  Synthetic sequence.
REVEELVKEIERVLEETKKRSEDTKREVEKVLEDTKRLVERLRKTLEELLRELDKRVRSGLDEETLERVLREVRKKLKELADEARRVSEEDEKRLRKLEEDSKRLSDEDRKKLEKLEDEARKKVDGEELRRTLEKVLREWRDVNRKVNDTDRKVLEDWERVNRTVNEELKEVLERAKEDIDRVAT

SEQ ID NO: 23374 - protein, 185 aa, Artificial Sequence; identical to SEQ ID NO: 23373
  Synthetic sequence.

SEQ ID NO: 23375 - protein, 185 aa, Artificial Sequence
  Synthetic sequence.
DEVERLVEEIKKRIDETRKLLEELKKRIRKVLEETKDLVRRLLKRLRELLKELEERRRRGLREDELKRVLDDARRKIRKIEEDAKKMSREDRKKLRDLAEEAKDINRKDEEDLRRTEEELRRRVDGEELRRELKRVLDEWKKANDEVRRAMEEILKEWEEVNRKVNKDLRDVLEEVKERLREVAK

SEQ ID NO: 23376 - protein, 185 aa, Artificial Sequence; identical to SEQ ID NO: 23375
  Synthetic sequence.

SEQ ID NO: 23377 - protein, 185 aa, Artificial Sequence
  Synthetic sequence.
SEVEKLKKRLRDLLEELKRLSRRTKEDVRRVIKETRDRSKKTKEELEKLLREIRELRKRGLREKELKEVLDDARRKIEELARRSEELNRRDEDKLRKLAKESEELLRRAEERLRRLKKEVEEKVKGEDLRTEIKKILEEVKREIDRVRETDEKVLRDWKKANDEVRETDREVLRKIREDLKEVAR

SEQ ID NO: 23378 - protein, 185 aa, Artificial Sequence; identical to SEQ ID NO: 23377
  Synthetic sequence.

SEQ ID NO: 23379 - protein, 174 aa, Artificial Sequence
  Synthetic sequence.
RERETIEKVLDENRKSLEEVTETVKRVLDRWDETLKRLEEEVRRVNDKTRKVLEDLLREDKDLARRVKEELEKNLREVEDDKRRAEERMRELKRDVERVRKENEEELKKLRELLEKIDVKELKKRVKELSEKLREVLEELERRVREIVKRNKETVDESRKRNEELIKRAEDAAK

SEQ ID NO: 23380 - protein, 174 aa, Artificial Sequence; identical to SEQ ID NO: 23379
  Synthetic sequence.

SEQ ID NO: 23381 - protein, 182 aa, Artificial Sequence
  Synthetic sequence.
SEIDEVRKRVEKHSRDAKRLVDELREKNDRAIKTLERLLRELEKRNKKVIRDLEDVRTKNTEPEESLRRILKTVHDENRKVEEELRDILRRVEEENRRVIEELDRSLRESRKDLAEIEKRITDEDMVRELRRVLKENDESVRRLKREIEEVHKETERVVKEVLEEIRRVDEELKDVARKVET

SEQ ID NO: 23382 - protein, 182 aa, Artificial Sequence; identical to SEQ ID NO: 23381
  Synthetic sequence.

SEQ ID NO: 23383 - protein, 182 aa, Artificial Sequence
  Synthetic sequence.
REIEEVIKELKRHSEELEKELDRLRRENKEAIRTSKKLVEDLRRENTRAKEELEDVKRENRRDRTELRKLLERVHKRNEEVRETNRRLTERVARRNEEVKERLKRSLDESRRRVREVERRITDERALERLRRVVRENEESVERVLKKIDDIHEETKRVSDRSEKEIEDVDRDLKRKVEEVEK

SEQ ID NO: 23384 - protein, 182 aa, Artificial Sequence; identical to SEQ ID NO: 23383
  Synthetic sequence.

SEQ ID NO: 23385 - protein, 184 aa, Artificial Sequence
  Synthetic sequence.
REREKIKRILDELRKRVEELNRRNEELLRRLDKVVRDVNRTNKRLLEKLRKVADDVRRKLKDEPEEVLRTLDEILKKVEKEIKDTNDKTRKILEDARRLAEEVNRTSKKILEEVEREVKEVERENDREVDKVERTVEEIEKELTRLVEESEKEVKRIIEELKELLERSRKSVEDIIREVRKLAE

SEQ ID NO: 23386 - protein, 184 aa, Artificial Sequence; identical to SEQ ID NO: 23385
  Synthetic sequence.

SEQ ID NO: 23387 - protein, 184 aa, Artificial Sequence
  Synthetic sequence.
SEEEKLDRLLEELKKVAEEVNRENEKLLEDLERVVRDLNEKNKAALKKLEDAVRRLKEAIKDKPEDVLRTLEDDLRKVRKKVEDVNRESKEILDRVRKEIKETNEESKRILDRVEREADRIRRDKDDSVDRVEERLREIIKTLRKLLEDSKESVRKIIEELKRLVDRSIEDLERIIKELEDKVR

SEQ ID NO: 23388 - protein, 184 aa, Artificial Sequence; identical to SEQ ID NO: 23387
  Synthetic sequence.

SEQ ID NO: 23389 - protein, 184 aa, Artificial Sequence
  Synthetic sequence.
DRERRIETVLRKLKKVVEEVNRRNEKLLDDLRKVVTRLLEEDRRLLEKLRRAAERLKEELKDGPEEVLRTLEKILRDVERRSRESLKRLKEILDRAEREVREVNRTSREILERVKKEAERVKRDQDDDVTRVKEKIEKIIEELKKLLKDSKKRVEEIIRELEKLVDDSRREVEEIIKELKDRSR

SEQ ID NO: 23390 - protein, 184 aa, Artificial Sequence; identical to SEQ ID NO: 23389
  Synthetic sequence.

SEQ ID NO: 23391 - protein, 185 aa, Artificial Sequence
  Synthetic sequence.
DMREELERILKTLRDVSRESRRELKRLLDENEKTIREVKKRVDEILEKLRKVIDDVRRQGNDERAEDELRKILERVKKIADELKDRLRDSLKKSKEDIDRVARENEKLLRDAEDRIRRVAEADSRSKKVVDEVDKEIRELIRKDEEIVKEVAERVKKNSEDLRRLLEKARREIEEIIKELEERRR

SEQ ID NO: 23392 - protein, 185 aa, Artificial Sequence; identical to SEQ ID NO: 23391
  Synthetic sequence.

SEQ ID NO: 23393 - protein, 181 aa, Artificial Sequence
  Synthetic sequence.
DEDEIVRDVIRRLDEVLKKLEKTNTELDEELKRVVEELRKVNRTVDEELKRVLDELAKRIEDEDKVRRLEDRATKLIKKNEDHLRELEKAVEELEERNKRHLDRLREEAEKLKEEVRKVREDGRANDKLVKDLKRVLDKLEESSRRMLKKLSDALRELEKSSDKVVKDLRKVLKELREEVK

SEQ ID NO: 23394 - protein, 181 aa, Artificial Sequence; identical to SEQ ID NO: 23393
  Synthetic sequence.

SEQ ID NO: 23395 - protein, 181 aa, Artificial Sequence
  Synthetic sequence.
DEDERVEELLRELEEVLDRLAKLNKKLDERNKEVAEESKRLNETVDRELKEVLKRLEEKLEDKDKLRELKKKAEKLVRENRKHLEESERRHRKTAEDNKRHLERLEESARKLLEDLRKVKEDGRANSELVERIRRELERLKRSSEEVVKKLTEELKKDKKSSEEVVKDLRRALRELERAVD

SEQ ID NO: 23396 - protein, 181 aa, Artificial Sequence; identical to SEQ ID NO: 23395
  Synthetic sequence.

SEQ ID NO: 23397 - protein, 174 aa, Artificial Sequence
  Synthetic sequence.
SELEKVKEDIRRLLKRLKEDIKRIKDEIDRLLEELKRHLKEVEEEVDRILEELKDLKRRGTTEDTLRRVREEIKRLIKESEEALEKVKREIEEIKKRSEEKLKRARTEIKKIKDNVPRREKLERVKEDVERVLEEYRKRSEDLARRVEKVLREYKKRSDELEKRVEDVIKEVAD

SEQ ID NO: 23398 - protein, 174 aa, Artificial Sequence; identical to SEQ ID NO: 23397
  Synthetic sequence.

SEQ ID NO: 23399 - protein, 174 aa, Artificial Sequence
  Synthetic sequence.
KELEEVARKIDEELKKLDKNIRDIADEIRRILEELEKDLREIEKRIRDILRRLEDLKRRGTDERTVKRAEREIREIAKDSRRKLEEVRERIERIMRRSKKTLDDVKRRIEEEAKNVPRTDELKTVEDKVRKALREYEEKTRKVKKDVDEVIKKYKTDSDRVLDEVEKALREVER

SEQ ID NO: 23400 - protein, 174 aa, Artificial Sequence; identical to SEQ ID NO: 23399
  Synthetic sequence.

SEQ ID NO: 23401 - protein, 181 aa, Artificial Sequence
  Synthetic sequence.
RVEEKLKRVSDELKRAVDESNKKIEELLERLKRVHDETNKEITEILRELKEVVDKAREDGLDDERLKRILDEARDVIRRVRETDDDLRRRNKEMVDRLKDLNRKLEKRAEELIREVKDKIRTDELVEDIERKIEELIRRDDDLVRRAEEEVEKSIRELRRLVDEVRKEIKKIVKKIEDDVR

SEQ ID NO: 23402 - protein, 181 aa, Artificial Sequence; identical to SEQ ID NO: 23401
  Synthetic sequence.

SEQ ID NO: 23403 - protein, 181 aa, Artificial Sequence
  Synthetic sequence.
SREDKARELLRELEKVDDDHRRRVRELLERLKKVLEDHRRAVKDIIKRLDDELKRIKEEDDKGDKIEEILRRVRKKIRELEEHVKKTNEDIRRKIEELRRHLDETNKETNRKIERLRRELKEKKIDEEVAKEVKDIVREVEDHLRRVEEEVRRIIREVEEHIRDLERRVRELLEELKRRSK

SEQ ID NO: 23404 - protein, 181 aa, Artificial Sequence; identical to SEQ ID NO: 23403
  Synthetic sequence.

SEQ ID NO: 23405 - protein, 181 aa, Artificial Sequence
  Synthetic sequence.
SEEEKVRRLKEELRRVIEKHKKDVKEIEDRLREVDDRHRREVKKLIEELKKVLEDAKRRKREGKDMEKRLDELREIIKKLMRHAEKFNRETNKKIEEEKRHLEEANKELEKEIRDLEREVKETKIDEEVAKRVKEIIEKVERHITEVKKRAEELVEEVERHIRELKKRVEDLVEEIERDTK

SEQ ID NO: 23406 - protein, 181 aa, Artificial Sequence; identical to SEQ ID NO: 23405
  Synthetic sequence.

SEQ ID NO: 23407 - protein, 180 aa, Artificial Sequence
  Synthetic sequence.
DEKETAEELLRRIEKVIKRLEDTMRKLNKKLKEAIERHHRTAKKLLDDIERVIREVEKDRGDDRDVRRVLEDIKRKLDELRKRIEDVDKEVEDHLKRNHDKVRKILEDLKKLLDELRRLLDELRREELEDDVRRIIEEIDRLLRESEEDHEDLIRRLKRSLEELKRLAEDIIRKLSEDRK

SEQ ID NO: 23408 - protein, 180 aa, Artificial Sequence; identical to SEQ ID NO: 23407
  Synthetic sequence.

SEQ ID NO: 23409 - protein, 180 aa, Artificial Sequence
  Synthetic sequence.
REKEAAKRILDRIEKVIRDHHREAKRLNDELEKVIREHHETVKELLKRIKEVIDKFKKDKGDDRDVERIRKRLEELLKKLEDDARRVDKRLRDVLRRNHKEVREVNEEMRELLKRLADLLDELSVEELEETARRIIEKLKKSLEDSKRDHERLKKEIEDSLKRLTELVKKIIEEIERDRK

SEQ ID NO: 23410 - protein, 180 aa, Artificial Sequence; identical to SEQ ID NO: 23409
  Synthetic sequence.

SEQ ID NO: 23411 - protein, 180 aa, Artificial Sequence
  Synthetic sequence.
DEDEEARRLLEEIRKVIEEAEEEAKRLNERLRRVIKEHHRKVKELLDEIERVIEKVLRARGDDRDVRRIIKEIRERLERLREEAERVDRKLKEHLERNEKKVEEMRKRITKLLDDLRKRLKELSVDELRERVREIKEKLRKDLKDSEDDHRRMEEEIKKSLERLERLVREIIKDLEEKLR

SEQ ID NO: 23412 - protein, 180 aa, Artificial Sequence; identical to SEQ ID NO: 23411
  Synthetic sequence.

SEQ ID NO: 23413 - protein, 180 aa, Artificial Sequence
  Synthetic sequence.
KDEERAKRLLDEIERVIRRHHKTARDLNRELERVLKEHHDTARKLLEDIKKAIDDLKRTRGDDRDVDRILRDLERLLRELEKKIREVDKRAKEHIKENERRVKKVNDELRELLERLARLLRELDAKELEDKVKEIIDRIEKSLEESDKNHKKLIRELEKSLDDLRREAKEIIDDAREKAK

SEQ ID NO: 23414 - protein, 180 aa, Artificial Sequence; identical to SEQ ID NO: 23413
  Synthetic sequence.

SEQ ID NO: 23415 - protein, 179 aa, Artificial Sequence
  Synthetic sequence.
SAAERAEEVLRKLRESLERHKKVNKDLLEEIERSLREVAKDVDRVLKDIKRVLDELKRRRRDLEEVEERVRRILRTIEKLLKELEDDNRRILEELKRKSEEVAKRNEDIARELKDRLRKDKGARDEVEELVRRVHRENEKFSKESEDLVREVHERNKELVKRIRKILEDATRELEKAAK

SEQ ID NO: 23416 - protein, 179 aa, Artificial Sequence; identical to SEQ ID NO: 23415
  Synthetic sequence.

SEQ ID NO: 23417 - protein, 179 aa, Artificial Sequence
  Synthetic sequence.
DMKEEAEEVLKEIEEVLKEHRDINRRLLEEIKKSLEDLSREVERVLDEIRRLLKRAVEERPDVEELEEDVRRILREIEERLKDVRRRNREILERIKEESKRVSEEVKKILEEIKKRVTETQGADEEVRKIVEDLKKRLKELSEKSERIVRKVHRDNERVVREIRDIVRRLKKRLEDATR

SEQ ID NO: 23418 - protein, 179 aa, Artificial Sequence; identical to SEQ ID NO: 23417
  Synthetic sequence.

SEQ ID NO: 23419 - protein, 179 aa, Artificial Sequence
  Synthetic sequence.
SAKEKVDEVLRRIKELLDRHKKVNEEILEEIRRSLEEHREVNERLLETIDRLLKELKRSRKDLEEVEKRVRDILRRIKELSDEVAEENKEILKELRERSERVEKRVREILKEIKDRVTKDKGAREEVEEIMRRAEEELRKLSKESRELVKRLHERNEEMSRRSKKIVDEAKKELEDAER

SEQ ID NO: 23420 - protein, 179 aa, Artificial Sequence; identical to SEQ ID NO: 23419
  Synthetic sequence.

SEQ ID NO: 23421 - protein, 182 aa, Artificial Sequence
  Synthetic sequence.
SAEEELDRLEKELDKLLKEHHEENKRLLEEIDRVLKEHEETLRRLIKELREVLKEVKEKLRDKRKVDELDKRMRELEERLKAILEDSKRKVREIKERLKELNRESEKRVKEVKDTLRDLLRRNSEKVEKLREDVERVKRELEDLTRKSEELVKRLKDTLRRVSEELKRRVDEAKKEAREVER

SEQ ID NO: 23422 - protein, 182 aa, Artificial Sequence; identical to SEQ ID NO: 23421
  Synthetic sequence.

SEQ ID NO: 23423 - protein, 182 aa, Artificial Sequence
  Synthetic sequence.
SAEEELKRLLEENERVTEEHHKRNRDLLRRIDEALRRHEKTLEDLIRELDRVLRELERRLKDKEKVDRIRREVEKVKEELKRILEESRDIVRRAKETLKKLNEDSERESEKVLKRLREIVDKVSEKVDDLRRIIEESRRRHEELTKESEKLVREVEDILRRLSEELAELVKRVKDKLDEDAK

SEQ ID NO: 23424 - protein, 182 aa, Artificial Sequence; identical to SEQ ID NO: 23423
  Synthetic sequence.

SEQ ID NO: 23425 - protein, 182 aa, Artificial Sequence
  Synthetic sequence.
SAEETLKRLAERIRKLLEEHRETVKRVIDRLDKVLRDHHRENKRLLEDIDRVLRRLEESLKDEEKVKEIRRRVEEIKDTLRRLDERSRDRVRRVKKEAEDRLRRSEEEIRRILRELEEIVRRNKEKVEDLDRRVKEVERRLREMSKTIEKLVKDIERELKEASEESRELVERMKRELTEAEK

SEQ ID NO: 23426 - protein, 182 aa, Artificial Sequence; identical to SEQ ID NO: 23425
  Synthetic sequence.

SEQ ID NO: 23427 - protein, 182 aa, Artificial Sequence
  Synthetic sequence.
REIEEILKEIEKSLRDLEEEVRRILEEIKKSLEDLRESMERIVEEVDRRLRTLKEVFDRGELDEEKIKRVEDTMKKILDDVKEEIKRHHEDLRRILKEAEERIKEHHDRLRETLERLKDKTTDDRVRRIIEKLEEDLRRVNKKIKETLEEAAKRLEDADREIEKILRDLARKIRKVLEEIKK

SEQ ID NO: 23428 - protein, 182 aa, Artificial Sequence; identical to SEQ ID NO: 23427
  Synthetic sequence.

SEQ ID NO: 23429 - protein, 182 aa, Artificial Sequence
  Synthetic sequence.
SEVEEIERRIEKSLKELRERLEEAEKRHEELLERLEREIDRIEKELRKDLKRLRDMTRRGEVDEKTIDEEEERLRRKLEELKKIVEKVRKENEDLLRKWKRDIDEHHRELRETLKRAKDKTKTERVKKEIDRLEKRLEEVNEEIKKRLKELAERSRRVLERIKDRIRRAAEELKRVLDEVRT

SEQ ID NO: 23430 - protein, 182 aa, Artificial Sequence; identical to SEQ ID NO: 23429
  Synthetic sequence.

SEQ ID NO: 23431 - protein, 182 aa, Artificial Sequence
  Synthetic sequence.
SEIEEILKRLKELLKELKERNEDILRRVEKSLKDLRKKLEEIVRDLRRLLEELREMVKRGEVDEETIKKVMRDAEKILEDLRREIEEHHKKLRKILEDSKKENEDLEKRLREELKRVKDKTTDDRVREIIKTAEKELEKALRTSEDIDRRLEERLEKVNKEIREELRRAEEEIKRVLEEVKR

SEQ ID NO: 23432 - protein, 182 aa, Artificial Sequence; identical to SEQ ID NO: 23431
  Synthetic sequence.

SEQ ID NO: 23433 - protein, 185 aa, Artificial Sequence
  Synthetic sequence.
DELDRIRKEVKRISDKNRRHVERLDEEVRKLLEELRKHLEDLTREVERLLRELKEVKKEGKDEETVRRVLRELEERIRRLKKHADEANKELKDKIDELEKHIKKANEDSKKEIDELEEDLKRKTRTEEMRTKVEELRKRLEESLEEHKRAADELRKRLKKVLEEHEKRVRELEEELRRVLKEAED

SEQ ID NO: 23434 - protein, 185 aa, Artificial Sequence; identical to SEQ ID NO: 23433
  Synthetic sequence.

SEQ ID NO: 23435 - protein, 185 aa, Artificial Sequence
  Synthetic sequence.
DELEELRKLVEEISRENREHLKKLKKLVEDLSRENEKHLRDVDKRVKELLEDLERLTRRGLDEETVRRVLERVEEEIRRTKEHLDKFNEDSERKARELKRHAEKFNEESKKKIDDLEDDARRKTRTEDVERELRRLKKELDKSLKEHRTTLERLEEELRKSNKEHRDRVKELREELEKVLRDAKR

SEQ ID NO: 23436 - protein, 185 aa, Artificial Sequence; identical to SEQ ID NO: 23435
  Synthetic sequence.

SEQ ID NO: 23437 - protein, 182 aa, Artificial Sequence
  Synthetic sequence.
SMLDEARKEVKELKDRVERASEKLEDNARRNVEKLERVSEELEREVKRLLDEIEEVKRRNGDEELLERVVRRLKRELEKLKEKSDEISKDSERNLDEIRKESERIKKELEKALRDLKKRADDDLIDEETLKELERRIREVLKKHDKTLRDLERRIREVNKRHKDVSDRLAERIKKVIRELER

SEQ ID NO: 23438 - protein, 182 aa, Artificial Sequence; identical to SEQ ID NO: 23437
  Synthetic sequence.

SEQ ID NO: 23439 - protein, 182 aa, Artificial Sequence
  Synthetic sequence.
DKEKELEREVDELLKRLEEHSKRVDKTVEDVHRRNEEALRDMERKVREVVEKLKEVKERTKTEEVMRRLERDVEKIKEDLRREVERVKEENKRVLDEIRRSLEESEKRVRDIEKKLDEEVRKAGRRLEEVDRLRRELREVLKRNRESVERAEEKLKKSVKELDERVKELEEELDRALDELRK

SEQ ID NO: 23440 - protein, 182 aa, Artificial Sequence; identical to SEQ ID NO: 23439
  Synthetic sequence.

SEQ ID NO: 23441 - protein, 182 aa, Artificial Sequence
  Synthetic sequence.
SEVEKLERDVRELHKDNKRHSDELDREVKKLLEELRRALEELKEKVERLTRRLEEVKRRTRTEEVLKRLEDEAREMIEELKKSLRELEKRVEDVEKRLEESLKRSREKNEKMKEDLDRELKKAGRRLKEVEELKRRIDRSVEENEDSIRRLKEEIKRIVDEVRRVVEKLIKEIKDAVKKLRD

SEQ ID NO: 23442 - protein, 182 aa, Artificial Sequence; identical to SEQ ID NO: 23441
  Synthetic sequence.

SEQ ID NO: 23443 - protein, 182 aa, Artificial Sequence
  Synthetic sequence.
DELEELKRRVEELEERNKDHSRKMRETVERVKERLDRHSKEMEKEVRKVVEDIKDVKRKTKTEEVLKRLKEKIEKIKEDLRRSLDESRKEVEKIKEDLRDSARKSHEENKDVKRKLEDDLRKAGRELREVDELKKEIERADKENKDSIEELERELDRVLKENEKSIRELEKELDDVLDEADK

SEQ ID NO: 23444 - protein, 182 aa, Artificial Sequence; identical to SEQ ID NO: 23443
  Synthetic sequence.

SEQ ID NO: 23445 - protein, 176 aa, Artificial Sequence
  Synthetic sequence.
SEAEKLLEENRRELEKVKRDAERLNDEIRERLKEIEDKLKTLNDEIRKLVKEMEDRNDRDKTVEEELRELIETLRRRYEELKRELEELIKELKRRYEELLDRLRRLSEESKERADRDLIDEEILRTIADDNRRVLEEIKKIIKHSRDELERVKRDIDRIVKHSVKLLEDVLRRLRK

SEQ ID NO: 23446 - protein, 176 aa, Artificial Sequence; identical to SEQ ID NO: 23445
  Synthetic sequence.

SEQ ID NO: 23447 - protein, 177 aa, Artificial Sequence
  Synthetic sequence.
DEEEIVKRIEDDARRIIEEVKEVLRRIRDLNERILREAEEVLKEIREINRKVLEDLRRDGLPSDEIRKAEEESEKNLRELEEIIKTVEKRSRESVEEIKELIKRAEDLLRELIRELRETRVDERVLKRLRDELDKLREDLERILRRNKKLLDELRELLERSRRENEKLVEELKRKAK

SEQ ID NO: 23448 - protein, 177 aa, Artificial Sequence; identical to SEQ ID NO: 23447
  Synthetic sequence.

SEQ ID NO: 23449 - protein, 178 aa, Artificial Sequence
  Synthetic sequence.
SEAERIEEEVKKLLKDVKKKLEELKESSKRVVEELDKVLKELKESSDRLAKEIKKALDDNRSEEDIKRLLRENKEHLRELDERVRELKKKNKKHLDDLKREVDELRKRLEDALRRIEERVRVKDVLEKLRELVKRLIDDLRRVVEELEETNERLDRKLEDVLKKLRETNEKTLRELRK

SEQ ID NO: 23450 - protein, 178 aa, Artificial Sequence; identical to SEQ ID NO: 23449
  Synthetic sequence.

SEQ ID NO: 23451 - protein, 181 aa, Artificial Sequence
  Synthetic sequence.
SVREDLKRVVEDIRRIVKEVHERNREASKRSEDLVREVHERNERIARELKKIVDDLRRVKEEEKLKEIEKKLEEDLERAARENRRILEELKKISEDVARENKEVLDRIKERLDRLAKDVEDRNAERRVLEEVRKEVEKVLREIEKSLRDHERENKRLLEDIERSLRELEKTVEKLKRDIRR

SEQ ID NO: 23452 - protein, 181 aa, Artificial Sequence; identical to SEQ ID NO: 23451
  Synthetic sequence.

SEQ ID NO: 23453 - protein, 181 aa, Artificial Sequence
  Synthetic sequence.
SAREALKEAVKEIERIVREVHDRNRRASERSEKIVRDVHRRNKKLTDESKDLVDKARRIKEKEKLDELLKELEERSKKVAKENEDIRREIEKLSEDVSRENEKVLEKIRRDLERLRKDVRDRNVDKRVLEEVAKRVEEVLKRIKDSLEEHRRVNDKLLKDIEKSLRDHERANEKLLEDLRK

SEQ ID NO: 23454 - protein, 181 aa, Artificial Sequence; identical to SEQ ID NO: 23453
  Synthetic sequence.

SEQ ID NO: 23455 - protein, 179 aa, Artificial Sequence
  Synthetic sequence.
DELEELLKRIEDVIRRVEELLDELLERHRKVSKESNERLEELLRRHEKVSEEVKRENAGDERFKRTVDRLNDELRKKVKKLKEDDEKRNKELADDVKRLKEELRETLDRIRKEVEKLEPTEEVEKRVREVLKEIEDRAREVEKRARDSVRRNREELERLERDVRRSLKKLRDDLERMRR

SEQ ID NO: 23456 - protein, 179 aa, Artificial Sequence; identical to SEQ ID NO: 23455
  Synthetic sequence.

SEQ ID NO: 23457 - protein, 183 aa, Artificial Sequence
  Synthetic sequence.
SKVEKLLEDIKKLVKEVSDKIEELLKRLHEVVREIAKAVRDLIRENKRVVDDIVKKVRERGVPEEDLKRLEDRVEKSIRDLEEKLRDLKRRHDESTKRLKERLERAERRVKKLLDKLERRGDNGKEAEDDARRIIEEIERLLREVKKYIEEHIKRLRTVLKKLAEDSKKHLDELRELLRRLEK

SEQ ID NO: 23458 - protein, 183 aa, Artificial Sequence; identical to SEQ ID NO: 23457
  Synthetic sequence.

SEQ ID NO: 23459 - protein, 186 aa, Artificial Sequence
  Synthetic sequence.
SELETLLTDVERLLDESRRVAERVLKEVKELLDEWEKRHKELADRIRELLRRVEEEMKRANLDEEMKKRLEDELRRVDEKIKERDEDVKREKRRIEEKLERIKERSDREEKRVRKRLEDLRRRDLKDEEVRREATDLRREIKEHTDEVEKKLEELAREIEELLERSERSAEELRKEIEKLLEEIRR

SEQ ID NO: 23460 - protein, 186 aa, Artificial Sequence; identical to SEQ ID NO: 23459
  Synthetic sequence.

SEQ ID NO: 23461 - protein, 178 aa, Artificial Sequence
  Synthetic sequence.
SEIEKLLEDFKKRIEDIKRRLERYLEEVRKRVEKVKRELERALEESKRTVDEVKKEIDRAPPTEELRERLRRLKEEHRRRIRELEERLKEENRKNEERNRELEKELEDEARKVEEAEKRANASDEVRKEIRKLLDDIRRVVEKVKRDNERLNRDLNRRVREVIRESEKLNKRLEEAVR

SEQ ID NO: 23462 - protein, 178 aa, Artificial Sequence; identical to SEQ ID NO: 23461
  Synthetic sequence.

SEQ ID NO: 23463 - protein, 174 aa, Artificial Sequence
  Synthetic sequence.
SESETLEKELKELKEEADKLIEDIRRRLEEVARRVERNVTESERTLEELLRRAREKKKRRPQDREVEKELTEYRKELEKNREKSERDIRRVKEKLDEIEDRLRERLKRVKDRLDKVDVDRRVKEEVKRVLEEIERALRTVLKEVRDLLKRLEELHREVLDKNRRVLKAISDEAK

SEQ ID NO: 23464 - protein, 174 aa, Artificial Sequence; identical to SEQ ID NO: 23463
  Synthetic sequence.

SEQ ID NO: 23465 - protein, 174 aa, Artificial Sequence
  Synthetic sequence.
SEDEKVKKDLDELRDRVRKNIERIRRKLKKLLDEARDNVRRSEETLRRLARRVEKIKKDKPRDEEVREELERYEEELKRNKEESDRKLEKVREDLKKNLEESERRVRDFERRLRELDIDRSVKEELRRVLEDLKRLHEEVSKRVEDALREMKELHDRVLKRNKDVLRELKERAQ

SEQ ID NO: 23466 - protein, 174 aa, Artificial Sequence; identical to SEQ ID NO: 23465
  Synthetic sequence.

SEQ ID NO: 23467 - protein, 178 aa, Artificial Sequence
  Synthetic sequence.
SLEEIVKDILRRIKTKADEIKEKVDRSLREIEELVKEIKKEVDDSLRDIERVAEELRREGREDEKMRRKLEKDEERNKRTLDEIERKVRKLNRDNEEKNRETKEEVDELEKEVREIERKANLDERLLRDVRRILEELRDLVRRLHEDNKRLDEDLNRKVEKLKRDNEDLNKKMRDRAE

SEQ ID NO: 23468 - protein, 178 aa, Artificial Sequence; identical to SEQ ID NO: 23467
  Synthetic sequence.

SEQ ID NO: 23469 - protein, 179 aa, Artificial Sequence
  Synthetic sequence.
SEKEEADKKLKKVMDDLREILRRLLETLKRVIERSEEVLKRLDDRNREVLEEIKRAIERLDRREDEIRTVEEELRRNDERVKEDLTRHKRELEETEKEVRRTLTKVDEELKKIEDEIRRGDRDEKEAEETVRRMKELVDRIRKKAEEDVKKLREDSKRTADRSKKNVEDLKRRLDELAK

SEQ ID NO: 23470 - protein, 179 aa, Artificial Sequence; identical to SEQ ID NO: 23469
  Synthetic sequence.

SEQ ID NO: 23471 - protein, 178 aa, Artificial Sequence
  Synthetic sequence.
SEIEELVRRLERKLEEHKKMVDKYREDLKRTLDRVNELSKDYIKKLRDILEKAERLVRRGELKEEVVKKIEDELKKLNEEYEKRVRDVERELRKLNDDVRKLHEELEKDLRREEEDVERKGTSEDLRRIAERVLREAHRTAKDLHRDSERVREEIKKSVDRVHEESERVLREIRKLKK

SEQ ID NO: 23472 - protein, 178 aa, Artificial Sequence; identical to SEQ ID NO: 23471
  Synthetic sequence.

SEQ ID NO: 23473 - protein, 183 aa, Artificial Sequence
  Synthetic sequence.
SIEEEVRKIVDDIRRSSEELEKSVKRVVEEIAESSKEEKDRVKRNIEEIRKEIDKLRRDGADERVKEKLDRNLEESRRRLEEYEKKLRDELRKAKKELDDYKRDLDRRLKEAEERLRDVKDRIDKDVLEKLKRLLDKVVRDSEDVIRKLEERLKKVVDESKEVLKELEELHERVMREVEETIR

SEQ ID NO: 23474 - protein, 183 aa, Artificial Sequence; identical to SEQ ID NO: 23473
  Synthetic sequence.

SEQ ID NO: 23475 - protein, 183 aa, Artificial Sequence
  Synthetic sequence.
KIEEDIRRELTKILDKLRKLLEKAKKNVEDIERSSRDLKRRVDETIEKIKDELRKLERDGDTDEMERRLRKKLREVEEELKKYEEELRENLKRSEEELRKVKKDLEDELRELEDRLEKIRDRIDEEVLERAERELRRVMKEVEKVLREIEELHRRVAETSKRVIDELRRLLEKVFKEFEDAVR

SEQ ID NO: 23476 - protein, 183 aa, Artificial Sequence; identical to SEQ ID NO: 23475
  Synthetic sequence.

SEQ ID NO: 23477 - protein, 182 aa, Artificial Sequence
  Synthetic sequence.
SEVDEDLKRLEDRVREYEDRVREDIRRLEEDLKRLRKRIEDSIEEMRRTLEEVKEDVRREGPDDRLREELRERNERHRDELRREAERVEKKLRDMKRKLERSHEEVKKELEEVRKKAKKDNLDRDRLTKLREVLERLEKRIREIDEEIKRVLERVEKEIRDALRKIEKVNEDVEKALRDILR

SEQ ID NO: 23478 - protein, 182 aa, Artificial Sequence; identical to SEQ ID NO: 23477
  Synthetic sequence.

SEQ ID NO: 23479 - protein, 181 aa, Artificial Sequence
  Synthetic sequence.
SLEEEIEKVIRKLKEVVERINERNKRALDKLRKVVEEVKDALRRTNEELKKVVKEVERRGAVDERVREETKREEERSEDKLREEDEKLKRVEETNRRDDKRTRDELKRVRERLEEKKRRGGDKDDVRRLKREIEELIKRIDDKIRKLIRRHEELVREIREELKKHEERVKDVLRKLEKLAE

SEQ ID NO: 23480 - protein, 181 aa, Artificial Sequence; identical to SEQ ID NO: 23479
  Synthetic sequence.

SEQ ID NO: 23481 - protein, 171 aa, Artificial Sequence
  Synthetic sequence.
SEVEKLKKEADEESERNKDEVRKLEKESKENADRIRRHLEEHLKRSDENVKRVKDAKLPKERAREELERHLRRTEDNLRRIKEHLKRHLKKSEEDLRRSDKRLRELKKELEDRIKSEEMLRRLEELLRENKKRNKEVLDRDRELLRELDEEVDDVLRRDKELLEELERRLK

SEQ ID NO: 23482 - protein, 171 aa, Artificial Sequence; identical to SEQ ID NO: 23481
  Synthetic sequence.

SEQ ID NO: 23483 - protein, 182 aa, Artificial Sequence
  Synthetic sequence.
SEVDEVLERIERLADDNRRKAETVLRKIARLLEELKKHSEDVNRKIKELVKELEDEVRRAGVPRDDVERVLREIEELSKRHREEVKRNEERIRRELEKLERETRKLLEEIRRELDKLKKRNLDRELLERVLRRVEKKSEDHKRKLEEAERRVDKNREDHERRNEELLRRVEERVEDVKRRIK

SEQ ID NO: 23484 - protein, 182 aa, Artificial Sequence; identical to SEQ ID NO: 23483
  Synthetic sequence.

SEQ ID NO: 23485 - protein, 185 aa, Artificial Sequence
  Synthetic sequence.
DEVKEVLKRIKDLLDELRRHSEKVNRDVERLLEELARNSEKVNREIRRLLDDLRRLVEEKSTDEEVEDELRRAEKEVEEKNKRHKEELERNRETVKRKNEKHRDEVRKVEEDVRRTLEKIERDQLGRDDLERILREVDKKIKDLKRENERMLEEVERNAKEHKDRDREELKRVKEDLDRLRERLR

SEQ ID NO: 23486 - protein, 185 aa, Artificial Sequence; identical to SEQ ID NO: 23485
  Synthetic sequence.

SEQ ID NO: 23487 - protein, 178 aa, Artificial Sequence
  Synthetic sequence.
KDAEELEKEVERESRKNEESIRRIREEVDKLSKDNDRKLKEIEKEVEDLRRRVDERRKRPGGEEFARKLIKELRDRLKEIAERIEKTNRELKEKLERIAKEIEDLKKRNREELKRLEEEKRGDEKLLDKIRKVVKENEERMDKLLEDIERVVRENIKKNKEVLERARRVIERLEEKIK

SEQ ID NO: 23488 - protein, 178 aa, Artificial Sequence; identical to SEQ ID NO: 23487
  Synthetic sequence.

SEQ ID NO: 23489 - protein, 178 aa, Artificial Sequence
  Synthetic sequence.
DEDKKLEKDVRDKSEDNKRRLEEIKKKVEDASRENERKIEEIKRRVEEKAEEVDRARKRPGGEKRLKDLIDDLRKTLKEIEEEIEKLKRDNEERLKDIRREIEEINKKLEDDLERIRRAKKGSEELLKTATELVTRNRTENERVLREAERVVKENLRRMDELLKDIRRVIEELERRIK

SEQ ID NO: 23490 - protein, 178 aa, Artificial Sequence; identical to SEQ ID NO: 23489
  Synthetic sequence.

SEQ ID NO: 23491 - protein, 175 aa, Artificial Sequence
  Synthetic sequence.
EEVERSLKKLEDDIRRIERELEEMVRKSKREIDKLVRDLEEMLKDSRRKLEKLRKDNITSEEARRSLEKHNRELEKVLEDLERRSRRHKEEVDKLLKDLKKKLDDLRREIEELRRRGVSEEAIRELERLLEELLRKIEEVIKDLRRLNKELDEEIKRVIDEARRLNKELEDDLRR

SEQ ID NO: 23492 - protein, 175 aa, Artificial Sequence; identical to SEQ ID NO: 23491
  Synthetic sequence.

SEQ ID NO: 23493 - protein, 178 aa, Artificial Sequence
  Synthetic sequence.
SKVEKILKDIKRLLDELRKKLKEVKDRLDEINEELRETLKRSLDRNRKINEELKDKLRRRNAPEDVDEESKKHLEDVKRKIDEIRKRSEEHRKRVEDEIRELEERLKELLKRARDVVREGRVGDEVLKRVEEEIRRLEEELDRTLERSKREVEKIKREIERTNRESERAVKEIDDRER

SEQ ID NO: 23494 - protein, 178 aa, Artificial Sequence; identical to SEQ ID NO: 23493
  Synthetic sequence.

SEQ ID NO: 23495 - protein, 178 aa, Artificial Sequence
  Synthetic sequence.
SKDEEVLKTLRRILEELRDVHRRNLEDNKRITDRLREIHERNLRDNRRITKELEEVARRDGASKEEVDRLRERSEEYLRRLEEHLKRLEEKSKRYLDDLKRHLEEVDKRVRELEREIEREGAGDEKREEVKKEVDETRERNERKNRRSREDVKRVEDRNRDANRKSRKEAEDVKRRLT

SEQ ID NO: 23496 - protein, 178 aa, Artificial Sequence; identical to SEQ ID NO: 23495
  Synthetic sequence.

SEQ ID NO: 23497 - protein, 178 aa, Artificial Sequence
  Synthetic sequence.
SKVEEVLKRLREILKELEEVHKENKDDVKRILRDLEKTHKDNLDDNRRITEKLKRVVERDGLGEEVKEDLERRSREYLEDLERHLRELKRRIEEYEKELDEHLERLREEVKRIEEEIKRRGAGDEEREKVERRAKEARDRNKRKNERVKEEVKRVKDRNKKKNDESKETVRKIEEDAT

SEQ ID NO: 23498 - protein, 178 aa, Artificial Sequence; identical to SEQ ID NO: 23497
  Synthetic sequence.

SEQ ID NO: 23499 - protein, 175 aa, Artificial Sequence
  Synthetic sequence.
SDSERILKDIEDKLREIKKRSDDNRRRLEKENREVEKRVREILRRIEEENKDVEREDKRRDEVLRRLERRYDDLRREIRETLERLEKRYRDNEEELERLLEEVERRVKKILKELDEKGVEEKVKRDLEEALKTLRKVAEDNKKSLRESLETVKKLLEDLERELRKSAESVRRKMK

SEQ ID NO: 23500 - protein, 175 aa, Artificial Sequence; identical to SEQ ID NO: 23499
  Synthetic sequence.

SEQ ID NO: 23501 - protein, 175 aa, Artificial Sequence
  Synthetic sequence.
SESEELLKRAEDEVRKVEKKSRDNERRLREKLKKAKEDLDRIDEDIKRLNKELEDRNDKDSRVLKRARDEYRRIRREIEKLLEDLERDVKRNEDDLKRDLDRLEESIRKLKEDMDKAGLEERLRRELERILEELRELVRRNEEELKKIMKRVREEVEKLLRKLEKSLESVDRKVT

SEQ ID NO: 23502 - protein, 175 aa, Artificial Sequence; identical to SEQ ID NO: 23501
  Synthetic sequence.

SEQ ID NO: 23503 - protein, 180 aa, Artificial Sequence
  Synthetic sequence.
SRDEKAERMVREVEKKIKELIDRNRRVTEKVKEDIKRLIEDLERVTRDVSRAIKELARRLRDTDLRRLEEELRRIEKSSRDVLRKLEEELRRLSRTSEEYLRRLKERLDELRKEVEDIKRKKDIKEEDDKRIEEDLRKLEEDSRRYDEDLKRELERLRKEVEEYKKRMREELRRLKEEAD

SEQ ID NO: 23504 - protein, 180 aa, Artificial Sequence; identical to SEQ ID NO: 23503
  Synthetic sequence.

SEQ ID NO: 23505 - protein, 180 aa, Artificial Sequence
  Synthetic sequence.
SELERATKVVKRVADRIAELIRENARVTKRVADESRKLLEETETVTREVMRAIEELLKRLRGERAKKLKKLLEDIRRSSEEVLRKNKKDSEELKRTSDEYLERLRRKLEKLKDEVRKIKAENSIREEDLKKLEDDLKRAADESKKYDDDLRRKLDELRRRHEEYKERLKEMLKRLEDETR

SEQ ID NO: 23506 - protein, 180 aa, Artificial Sequence; identical to SEQ ID NO: 23505
  Synthetic sequence.

SEQ ID NO: 23507 - protein, 180 aa, Artificial Sequence
  Synthetic sequence.
SELEDARRVVKRVADRIKRLIEENERVTKEVKEASEKLLKDTKDATRRLAKEVKELVKRLRGKDVEELKRRLEEIKRSSDKVEEDNRRESERLRKTSEEYVDELRKELERLEREVKEIEERNNIDEKDKKRLEEELERLRESSERYDERLKRELERLEEEHRRYIRRLKEELDKLREDTD

SEQ ID NO: 23508 - protein, 180 aa, Artificial Sequence; identical to SEQ ID NO: 23507
  Synthetic sequence.

SEQ ID NO: 23509 - protein, 184 aa, Artificial Sequence
  Synthetic sequence.
SEVEELIKDIRRHNTRLEKRMREILEDLKRHLKRSEDKMRKLVKELKELLDRLRDIARDGELKEEVLRRVREELRRVEEELKRTLERNKEKLEKVREDLERELRRDRKKNEELRKEIEKVRKDIDEKLLKELEDVIRENEKRSRDIARTLEKALEELRKASKELIDTARDILRKVLEDVDRLRQ

SEQ ID NO: 23510 - protein, 184 aa, Artificial Sequence; identical to SEQ ID NO: 23509
  Synthetic sequence.

SEQ ID NO: 23511 - protein, 179 aa, Artificial Sequence
  Synthetic sequence.
SEVETSAERLKREVEKHHKEVEEYIRRLEEELKKMTRDVERALEKIKEDVDRLRKEQKSKDELDETVRDLERKIEELKRKLEKKLEDIERSSREVLDRTRRKLEELEREVKKLEDEINTDEELLKRLRDVLEEVSRRIKDNLEELKKVSERLKRRIEELIRRLEKVMRDVRRSAEEIKR

SEQ ID NO: 23512 - protein, 179 aa, Artificial Sequence; identical to SEQ ID NO: 23511
  Synthetic sequence.

SEQ ID NO: 23513 - protein, 179 aa, Artificial Sequence
  Synthetic sequence.
KEVEEDIERLKRILEKHHKDIERAIRRLEEKLKRLEDKLRKYKRDLEEEVARLKDEQRSEELLKRSVEKIKRSSEELKKEIRRLLEEIRKEIEDLKRKTKEVLDRIRREVEDLERRINSDEKVLRRLKEVLREIEERIRRNKEELDKALERVKRTIERLIRELEKLSERLKRIADEIAR

SEQ ID NO: 23514 - protein, 179 aa, Artificial Sequence; identical to SEQ ID NO: 23513
  Synthetic sequence.

SEQ ID NO: 23515 - protein, 179 aa, Artificial Sequence
  Synthetic sequence.
DEVDEIVRRLRETVDRHHKRIKEAIEKLKEEVKKHHREIEEYIRRLEEEVKRLADEQKDKDSLTEELKRIEKSSKELEDKSRDKLRKVREEIEEMKKRTEDTLKRLKEEVEDAKRRINTDRKLLEKLDRVLKKLEEDIRRNKEALDRALREAEKSLTDNIKELRDVSREIAERIKEITR

SEQ ID NO: 23516 - protein, 179 aa, Artificial Sequence; identical to SEQ ID NO: 23515
  Synthetic sequence.

SEQ ID NO: 23517 - protein, 175 aa, Artificial Sequence
  Synthetic sequence.
DEKEKVIEDIKELLKELEKKLEDIIREIEKELKRNDEENEESRRRIEDMLRRLEELKRRSDVEERVKKEVEDTLRKLKREYDERDRENRERLKRILEEMREDVKDLREKLRKLRKDLKGTEDVDRVLREAERRVREILKELEEVLRRAEERSEENLRSAEKVLREVEKRLKELTD

SEQ ID NO: 23518 - protein, 175 aa, Artificial Sequence; identical to SEQ ID NO: 23517
  Synthetic sequence.

SEQ ID NO: 23519 - protein, 175 aa, Artificial Sequence
  Synthetic sequence.
SEEERIIKRIKETLEDLKRKLDRIREEIERDIRRNNKKNEDSIRDIERMLRELRRLFEESEVKEKVVEDVRRRLKRLKEEYRKTDEENKERLKRILEEMEELVKRLRDELEDLRRKIRGTKELKEVLEEAKKTVDKILRDLEELLRRAEEESRRNLREAEEVLKKVREDLERLAT

SEQ ID NO: 23520 - protein, 175 aa, Artificial Sequence; identical to SEQ ID NO: 23519
  Synthetic sequence.

SEQ ID NO: 23521 - protein, 175 aa, Artificial Sequence
  Synthetic sequence.
SEEEEVIKEIKDALRDLRRRAEELMKELRELIRENNERNKESEREIRRLLDRLRDLKRRSEVKEEVVKTVRKELEKLKREYEKLNEDNERKLREVAEAVRKLREDLERILDRLRKELEGTEEVKRVLDDAKRAVEEILARIKELLDEVRKASKENLERAEELLRDVERELDRLTK

SEQ ID NO: 23522 - protein, 175 aa, Artificial Sequence; identical to SEQ ID NO: 23521
  Synthetic sequence.

SEQ ID NO: 23523 - protein, 178 aa, Artificial Sequence
  Synthetic sequence.
SEVERLIEDIRRANEELNRKSERKSRESKKENDRLNRESDKKSRDSERVLEELRRRNITSKDLRKKARELREDHRRYLERLKRALEELARDHERYLRELDEALRRLLTRVRETERRITDEELVRRLDELLKESETNVRDNKRRVRDNLRRTEENARRNLEKVKKNVRKIDKVIKEIET

SEQ ID NO: 23524 - protein, 178 aa, Artificial Sequence; identical to SEQ ID NO: 23523
  Synthetic sequence.

SEQ ID NO: 23525 - protein, 178 aa, Artificial Sequence
  Synthetic sequence.
SEVDETARKLDEDLKRLEEEVRRTSKESEDENRKLNETSKRESDESKRRLDELRRKNITDKDLREDLKRLEDRHRKYKEDLDRELRRLEEKHKEIIKKLRRSAEELERRMRELARRITDERVLRKLKDLVEKVKRVIEKLVKELEDNVKKTKDNARRNKREIEENARRIREEIKKLED

SEQ ID NO: 23526 - protein, 178 aa, Artificial Sequence; identical to SEQ ID NO: 23525
  Synthetic sequence.

SEQ ID NO: 23527 - protein, 178 aa, Artificial Sequence
  Synthetic sequence.
SEVEKEADEVRRTNEELNRRSEETSRRSEEDLRRLEEKVRRASKKSEDDLRRLKRENITDKELDKSLDELRKEHEKIIKELEDTARRLKEEHRKYIEELDKALKELDDRAKESERRITDEEMVKRLRDVVKRSRENIEENKRRIEDNLRRIDEVIRRLIEELRRNMRRIEEEIERIRR

SEQ ID NO: 23528 - protein, 178 aa, Artificial Sequence; identical to SEQ ID NO: 23527
  Synthetic sequence.

SEQ ID NO: 23529 - protein, 184 aa, Artificial Sequence
  Synthetic sequence.
SEVEREIERLEEDLDRLRREVDEAHKRSKKKLEELRKEVEDYEERVKEELRRLEKLVREGRVDERDLKRVRDELHESSKRVLDRLKRALEKLEEEYKKLLEKLRRSLDKIREEVERLERELKDSPEEVRERLERALRKAEKDVKRLEDELKRSLKEVRETVRELEERLREVNERVEELLDRLRK

SEQ ID NO: 23530 - protein, 184 aa, Artificial Sequence; identical to SEQ ID NO: 23529
  Synthetic sequence.

SEQ ID NO: 23531 - protein, 186 aa, Artificial Sequence
  Synthetic sequence.
RVEDRVRDLIRKHDETSREIEKRIRDSIKRLADVLDKIRKAIDDLIRKLREAVEDLLRKIGKDDEDKARELKEEVDRAIERLRRELERLKREVERIIEKNEEILRRLREESERVKRELDEARRRKLSEKEVEDLARKIEKLNEDLRRRLEKLDKENKDVIRRLEDALRRLAEEIKRLIDELRERAR

SEQ ID NO: 23532 - protein, 186 aa, Artificial Sequence; identical to SEQ ID NO: 23531
  Synthetic sequence.

SEQ ID NO: 23533 - protein, 171 aa, Artificial Sequence
  Synthetic sequence.
KDEDRLRDDIRRAIEEIEEKLKRLKDRNKEHIERLKKRNEDLNRRNRDVVRRLRERDTDEKEIEEAMRRTRKEHKKALDDNRKSLKESEDELRKAEEDLRKTLEDLDRKLRAEPRTEELEKLREDLRRVIERVEREIRRSSEENRRVVKKSVDNIRDSLRKNEDVIRKLRK

SEQ ID NO: 23534 - protein, 171 aa, Artificial Sequence; identical to SEQ ID NO: 23533
  Synthetic sequence.

SEQ ID NO: 23535 - protein, 181 aa, Artificial Sequence
  Synthetic sequence.
DVEKKIKDLARELREVIDDARRKNRKLHEDAREVSERHEKAVRDLTEELKRVIDELRKRNIDEDTLRERRKRIEEEIRKVEKDNEDILREIKEDNEEIDRKLDEELKKLEEDIKDLERRKVPEDMLREVEKRVKEEIKRIKDDLDEVRKRHEKKVRDIRKHLKELEDRIKKTEKDLREEAR

SEQ ID NO: 23536 - protein, 181 aa, Artificial Sequence; identical to SEQ ID NO: 23535
  Synthetic sequence.

SEQ ID NO: 23537 - protein, 181 aa, Artificial Sequence
  Synthetic sequence.
RVEEEIERLSRDLKRVIEKAKRDNDRLHKEVRKASEDHKRENKRLHEDVKRVIEELRKRNIDEETLRKTMEDIERKNREVDKRNEERLREIERENREIDERLKEKEERIRRRIDDARRRKVEERMLKKLEDEIEETKKDIEREIREIDKRHKDAVKELRDHIRELAREHEEEKKRLEETAR

SEQ ID NO: 23538 - protein, 181 aa, Artificial Sequence; identical to SEQ ID NO: 23537
  Synthetic sequence.

SEQ ID NO: 23539 - protein, 181 aa, Artificial Sequence
  Synthetic sequence.
RVEEEIRRLLEESERVHKELEDINRRLHEKVDRVSKKHREENKRLHEKLKRAIDRLREKNIDEDTLRRKEREIKKRNDRVDEENRRTKKEITDKNRRIDEEIKRNLDENRKRIEDVKRRNIPEEALKKLEKEVKDNERKLREEARRVEEEHEKTVRDLKKHLDELREEHDRILEELERTRK

SEQ ID NO: 23540 - protein, 181 aa, Artificial Sequence; identical to SEQ ID NO: 23539
  Synthetic sequence.

SEQ ID NO: 23541 - protein, 173 aa, Artificial Sequence
  Synthetic sequence.
SDMEKRKRDIKRKLDESNKKSEEAVREVERKLDESNKEVKKKEERVEDELRKLEEKRRRGSGEELLRRVKELEDDLRRKLKEVRDRHDRLRRELEKILEKLKEDHKRIVDELKKGPDDEKLKDIERELRENLKRNEDIVREILKKLEDNLRRVEKLAEDIRRKLEKVADDLRK

SEQ ID NO: 23542 - protein, 173 aa, Artificial Sequence; identical to SEQ ID NO: 23541
  Synthetic sequence.

SEQ ID NO: 23543 - protein, 171 aa, Artificial Sequence
  Synthetic sequence.
SELEEDKKRIEETLRRLEETAKEYHRRSREELRRLEEEAKRYHEESKETLDRLRRENITSEELRDTIRRLEDRNKKLLEKLKKDIDEHKRRNEELMRRLRKTIEDLKRELDKGPDDKKLKDIKEEVERVMKKLEDLVRRDNEESEKVLEKLKRLVERNNEDIKRALEELRK

SEQ ID NO: 23544 - protein, 171 aa, Artificial Sequence; identical to SEQ ID NO: 23543
  Synthetic sequence.

SEQ ID NO: 23545 - protein, 171 aa, Artificial Sequence
  Synthetic sequence.
SEDEERLRRIEEELRRLEEEAREYHERSREELKKLREKAKEYHERSRRELEELRRRNITSEELRKKIEEHRKRNEDLLRELKRTIEELEKRNRELLKKLREDIKRLRDELRKGPDDKRLKEITRKVEEVMKKLEKLVRDNNEEIRKVMEELKKLVEDDNEESDRALKELET

SEQ ID NO: 23546 - protein, 171 aa, Artificial Sequence; identical to SEQ ID NO: 23545
  Synthetic sequence.

SEQ ID NO: 23547 - protein, 171 aa, Artificial Sequence
  Synthetic sequence.
DEMETRLEDVRKKLDDSRRETRKVEEDIRRTLEELRREAKKYHEDSKEELDDLRRRNITSEELKETIKRLEDRNRKLLEDLERKIREIEKTLEDYLRRLEERIDKLRRELDKGPKDEKLKEIKERIEKVLRENRDVVKKIKEDVRRALKELEELVRKNNEDIKRLLDELRR

SEQ ID NO: 23548 - protein, 171 aa, Artificial Sequence; identical to SEQ ID NO: 23547
  Synthetic sequence.

SEQ ID NO: 23549 - protein, 172 aa, Artificial Sequence
  Synthetic sequence.
SRVEEVERRVRDKSRKSKEKLRKLEEDVRRESETSRDRLRKLAEEVKTKVKELKDKRVPKEEVEERVRRIERRLEETLKDLRRRYEEVERRLKKALEDLRREHEKVKDELRRGEIDSEDLKRLAKEIEDNLEELERKIREIRKELRRSLEEVEKTVEDLKRELKKVLDELRK

SEQ ID NO: 23550 - protein, 172 aa, Artificial Sequence; identical to SEQ ID NO: 23549
  Synthetic sequence.

SEQ ID NO: 23551 - protein, 179 aa, Artificial Sequence
  Synthetic sequence.
SDIEEAKERLERKLEKLLRKVEEYLKEIADEIRRLEEELEEYNRRSKERIDRVLEVKERGEADRRVIEEEIRRMKRRNEDLERKVEKKLRELEKRNEEVKRDLEEAKKKIKKEIDELRERGVDESVLKELEELLKELEDRIRKILTESTELLRRLEKRVRDSLRRNTEELDELLDRLEK

SEQ ID NO: 23552 - protein, 179 aa, Artificial Sequence; identical to SEQ ID NO: 23551
  Synthetic sequence.

SEQ ID NO: 23553 - protein, 179 aa, Artificial Sequence
  Synthetic sequence.
SEVEKSEKKLRDEIERLVRENEKYLERIKELVEELLRELEKAVRELEKEVTEIEEVKRQGNVDKRLIEDLIRRIRKKIEDLRRKVKKAVTDLKRANDEVRRKSEEDLRRIEEEIKRLEDRGVEERVLKKLRDLVKEVVDRSKRSLDESTKVLDTLEKEVRKVLEALKDILREALERLDK

SEQ ID NO: 23554 - protein, 179 aa, Artificial Sequence; identical to SEQ ID NO: 23553
  Synthetic sequence.

SEQ ID NO: 23555 - protein, 181 aa, Artificial Sequence
  Synthetic sequence.
SREEIIKKLKEEVERLLRESAKVLEELKRRLEALLRESEEILRELRELVRTLLEKLERDGLDRRDIDKIRRDIERREREWEKETEDTRREIEELERRWRRRLEETRKRLEDIEERLKKEEISEKDLKKTEDDLKREADEHRKAVEDELRKVKKRLEEHRERVRKRLEDIEKTLRDIDREVR

SEQ ID NO: 23556 - protein, 181 aa, Artificial Sequence; identical to SEQ ID NO: 23555
  Synthetic sequence.

SEQ ID NO: 23557 - protein, 181 aa, Artificial Sequence
  Synthetic sequence.
SSVEDLLRKAEEVVRRAEEKSRDSHEKTKDVLRKVKRKSEELNKHNRESIKKVEEVRRRTDDKRVLEKVLEDIERNSRDAVRKHKRVLEELREVVRRSEETNRKILKEVRRVVEEVIRRLREEGAPEEVLKTIEDLLRKLERKVRETIETDRRLLRKVEEELKRSIEDSRRLVDELKKRVT

SEQ ID NO: 23558 - protein, 181 aa, Artificial Sequence; identical to SEQ ID NO: 23557
  Synthetic sequence.

SEQ ID NO: 23559 - protein, 181 aa, Artificial Sequence
  Synthetic sequence.
SSKDRLRDEIRRVVERVREISERVNKHNRDSVKRVEEESRRINKEIRKVVEDVDRMRRRVTDERVVKELVKTLRDVVRKVVEKHKKAVKEVRDNSKEAEEIHKKALDELREVARRVIEMLRKDGVPEEVLREIEKLVRDVEREVRESIERSKRLVKELEERVKKSIDEIKKEVDDVERKLK

SEQ ID NO: 23560 - protein, 181 aa, Artificial Sequence; identical to SEQ ID NO: 23559
  Synthetic sequence.

SEQ ID NO: 23561 - protein, 181 aa, Artificial Sequence
  Synthetic sequence.
KEVEDLKEKVKRVVEEVEKISRELNKHNRDSVRRAEKTSKELNDHNKDSIRKVREVLKRTTDKRLLEKVLRDIKENSDDMVRKHEKVLDEVRRNSDDVVTKHKKALEDLKRMAEEVERELEKAGAPDKVLKDIKKLLKDVEKKVRESIKESKELVKRLKDKLEESIRRSKKDVEDLKREVD

SEQ ID NO: 23562 - protein, 181 aa, Artificial Sequence; identical to SEQ ID NO: 23561
  Synthetic sequence.

SEQ ID NO: 23563 - protein, 181 aa, Artificial Sequence
  Synthetic sequence.
SSVDKLRKEIREVLRRVERISEESHKHNEESVRKVKERSERLNKHNRDSARDVERVLREVTDERILRTILRKVTENSKRAVEDHERALEEVRRNSEDVERKNRKALKELEDVVREIEDRLRKEGAPEEVLEEIRRRLEEVEERVRRDLEESKKLVDELRKRVEKSIRESRKLVDDLRKRVT

SEQ ID NO: 23564 - protein, 181 aa, Artificial Sequence; identical to SEQ ID NO: 23563
  Synthetic sequence.

SEQ ID NO: 23565 - protein, 181 aa, Artificial Sequence
  Synthetic sequence.
SSVDKLKDEVRKVVETVKDLSRRLNETAKRVADRVRKISRETHEEVRKVVEDVKDVRRRTNDKRKLEKVLDELREVIKEAHKKNEEVLDELRRVVKRLEDEHRKALEDLERVIRRVIKELRREGADETVLEELKRLLDKVREDVRRSIEEIRELLKTVEKEVRDDSRDLERLLKRVEEETK

SEQ ID NO: 23566 - protein, 181 aa, Artificial Sequence; identical to SEQ ID NO: 23565
  Synthetic sequence.

SEQ ID NO: 23567 - protein, 181 aa, Artificial Sequence
  Synthetic sequence.
SSVDRVREEIERVARRVRKLSEDSHREVEKVLKEVEEISKRTHEEIDKVVKEVEKVIRDTTDKRELRKVVDDLRKVAEEAHKKNEDALRKLEKVVREVMTKNRKVLEELRKVVKEVIEKLEREGAPEEVLEEIRRLLETVEREVKTDIDRLREELRRVEEAVKKDSEDIRRKLKRVEDDVK

SEQ ID NO: 23568 - protein, 181 aa, Artificial Sequence; identical to SEQ ID NO: 23567
  Synthetic sequence.

SEQ ID NO: 23569 - protein, 183 aa, Artificial Sequence
  Synthetic sequence.
REAEDIVRRSHELVERAREKLRRLNKDSERLVDEVEKELREVVERVAELIKRAKDEIGTEDDKVRKAVELLERVLREVKKVVEELLRKIRKVLRDDHESVREVKERVDDADRKVKKVVDEVGSVEEVLEKVLRDSERVLKELEEKLRKSLEDVKRVIDEVKKVLEDVKRKVEEVLKRVRDKRR

SEQ ID NO: 23570 - protein, 183 aa, Artificial Sequence; identical to SEQ ID NO: 23569
  Synthetic sequence.

SEQ ID NO: 23571 - protein, 183 aa, Artificial Sequence
  Synthetic sequence.
SRAEKVERESHELVRTLKEELDRVVEKVERLVRRVEEELKRVNKESAELVKELKDRIGTEDEKAVEIVKRVEELLKEDHDTVRDLLRELREVLERVRELIDRLRRRVETVDDEVRKLVRDVGELDEVLTKLVKSSRDVIEEIREDLKRVLKEAEEVIRRVKKRLEDSLEKVKEVLRELLRAAK

SEQ ID NO: 23572 - protein, 183 aa, Artificial Sequence; identical to SEQ ID NO: 23571
  Synthetic sequence.

SEQ ID NO: 23573 - protein, 183 aa, Artificial Sequence
  Synthetic sequence.
SSAEDVVRRSHELVRRLEEELDKVNEDSERLVREVEERLKRANEESKRRVEDAKRRIGTEDEKVKRLVELLEKVLREDTDTVRRLREDLRRVLEKDTRSVEDIKRKLRTVDKEVKKFVRDVGSLEEVLEEVLRRSREVLKKLKEDLKRSLDDAERVIRRVREDLKRSLKRVREVLEEVRRRTK

SEQ ID NO: 23574 - protein, 183 aa, Artificial Sequence; identical to SEQ ID NO: 23573
  Synthetic sequence.

SEQ ID NO: 23575 - protein, 183 aa, Artificial Sequence
  Synthetic sequence.
SSVDRIVEESHTRVRKLMKDLEDVNDESRRRVERLRERLEEVVKEVEKLVEELRRRIGEERREARRIVERVERALERVRDVVKKLLEELERVLKKDTESVERLKEELDKVDKEVKDLLRRVGSLEEVLKTILERSREVLDRIRKELERSLKEVEDVLRRIEKDLKKVLDEAREIIKRLLDEAK

SEQ ID NO: 23576 - protein, 183 aa, Artificial Sequence; identical to SEQ ID NO: 23575
  Synthetic sequence.

SEQ ID NO: 23577 - protein, 184 aa, Artificial Sequence
  Synthetic sequence.
SRLETVLERAKELIDRIRKLLEDVRRKVKELIDRIRRLNEEANRESEELIRRIEEELRKGKDAEEVVREVKERLERLLRRSEEVSKKSRKDLEDLVREAEKVIRDLARLLREVVREVEEVVRRDNTEDARRILEEVRKLVKELEEELRRALKEVRDLAKEVDEDSKRALDRNEKLIRDLDRKVE

SEQ ID NO: 23578 - protein, 184 aa, Artificial Sequence; identical to SEQ ID NO: 23577
  Synthetic sequence.

SEQ ID NO: 23579 - protein, 184 aa, Artificial Sequence
  Synthetic sequence.
RELEEAKKKVEDLLRRILEENERAHEESKKLIEEIRRLLKKMNEESEELRERIRKKLEENSTSDKVVREVRKEIDRLVERSERVAKRLKEELDRLLERSKKVSDDSRRKLKELLEEVEKVIRTLNSEDVERALDDVRRLLREVERRSEELLRTDEEAIRTLKKEIDKVLKENKDKADRLKEEVN

SEQ ID NO: 23580 - protein, 184 aa, Artificial Sequence; identical to SEQ ID NO: 23579
  Synthetic sequence.

SEQ ID NO: 23581 - protein, 184 aa, Artificial Sequence
  Synthetic sequence.
DELETVERRVEKLIEDIKRELRKVHEESKKLIREIKKELEDANRESERVIEEIKRELDRDKDSERVVERLEEKLRKLVRRSEEVIKELKKKLDELVKESERVARELRRKLEELVREVERVVREVNSEDARKMLEDVKKRAKDVEDEIEEVLRRDRELIKELKRELDEALRENRRLIEDLKRKIK

SEQ ID NO: 23582 - protein, 184 aa, Artificial Sequence; identical to SEQ ID NO: 23581
  Synthetic sequence.

SEQ ID NO: 23583 - protein, 184 aa, Artificial Sequence
  Synthetic sequence.
SEAEEALKRVKKAIDDARKLLEEANRKDKKSIEEAEKLLREAHERSKKAIKEAEDALDKAKTDEKAVERAREKADRAVKESEDAARRAKEIADKSLEDSERAAREAKKLADEAVDEARDAARKANSEDAEKALRDAKRLADDLKRTADEVLKENKRTAEDLKRKADEVLERDKKLAKELKEKAT

SEQ ID NO: 23584 - protein, 184 aa, Artificial Sequence; identical to SEQ ID NO: 23583
  Synthetic sequence.

SEQ ID NO: 23585 - protein, 184 aa, Artificial Sequence
  Synthetic sequence.
SELEDVKRKVKRLIEDIERALTEANKEDEKSIEETERLNRTVHEESKELVERLKDELRKRSTDKKVVEKVKKKLDDVLRRSKEVSERSKKILKDSVRRSAKVAEELKRRIDKLVEDAEKVIRDLNTEDVDEALKEVRDRAKKLKDKIKKVLDDNRRTVEDNERKSDELLKTDKELVREVKERTE

SEQ ID NO: 23586 - protein, 184 aa, Artificial Sequence; identical to SEQ ID NO: 23585
  Synthetic sequence.

SEQ ID NO: 23587 - protein, 183 aa, Artificial Sequence
  Synthetic sequence.
RELEKVRKEVERLIKEIKDLNKRAHDETKTRIDRIREKNEKVHEESKRLIREIEELLRRKGGESEEVVREIEKILDRIRRESERASEESRKELEDIKRRSKEASDRSRKILEEIRRTIEEVLREGAVTEEVIKEVEKRLDELRKESKKLLDDDRRLIEKLKEESRRLLEEDRRLIKELKEKVK

SEQ ID NO: 23588 - protein, 183 aa, Artificial Sequence; identical to SEQ ID NO: 23587
  Synthetic sequence.

SEQ ID NO: 23589 - protein, 183 aa, Artificial Sequence
  Synthetic sequence.
SAAERAAEEVKKLIDEARKLLERAHRETKKLIDEARKLNKRALDEVRRLIEEADRLLRRDGGEADEALKRAEEIAKRALDLAKRASEESERIAREAIKLSEDAARKAREIAKRALDLARKALKDGAAREEVAERARRLAEELKKEADDVLRKDRDLARRAREESEEALKEAEKLARDLRRRAK

SEQ ID NO: 23590 - protein, 183 aa, Artificial Sequence; identical to SEQ ID NO: 23589
  Synthetic sequence.

SEQ ID NO: 23591 - protein, 178 aa, Artificial Sequence
  Synthetic sequence.
KEAEDIKRKVEKVAREITEKSRKSHEELRKVVKEARDKSEKSLRDVERVLREIEELLRRRRKEDVLREVKERIEEILRTNKKVLEEVKERVKRIVDKNRRMLEEVEKRVREILKELKRDRPDSKDLIEEIKRRLDEVRRRSEDNLKKMEEELKKVEEDSRRVVERIRTELKRVEDEAR

SEQ ID NO: 23592 - protein, 178 aa, Artificial Sequence; identical to SEQ ID NO: 23591
  Synthetic sequence.

SEQ ID NO: 23593 - protein, 178 aa, Artificial Sequence
  Synthetic sequence.
SEAEKIRKDVEKVIREVREDSKRTLERSRKVDEEIRRKSETSHRLVEEVIRRAEELLRRERREEVVEEVKRRIKEIVDRNKEALDEVRKRNEDILRENDRVLERIKRLVEKILRDLKRDRDKDEELIEEIKKALEDVKRESEKVKEESRKSLEDVERDSDRNLKDMERLLREVTERAK

SEQ ID NO: 23594 - protein, 178 aa, Artificial Sequence; identical to SEQ ID NO: 23593
  Synthetic sequence.

SEQ ID NO: 23595 - protein, 178 aa, Artificial Sequence
  Synthetic sequence.
DEVEEIRKEVERVIREVEEKSKETLRRSEKVDREAKKKSDDSRRKVEKVADEIRRLLETRRDDRVLEEVARRVEAILRENEEVAREVEKRNREILKTNADVLDEIRKRVEEILKELKRDRPDDKDVIEEIRRLLDEVRRRSEKVIRDSERSAEEVKERSERVIEELKRLLEKVAREVK

SEQ ID NO: 23596 - protein, 178 aa, Artificial Sequence; identical to SEQ ID NO: 23595
  Synthetic sequence.

SEQ ID NO: 23597 - protein, 178 aa, Artificial Sequence
  Synthetic sequence.
SSVERVERDVARVAREIRKISRDTKEESKEVDRRIDEISKRTNEDVRRVAEEIKRLKEKRRRDEMLREISRKAEEIVRENEEVLEKVKRLNEEILKKNEDVLRKVAKDVTDILRRLKRERPDDKDVIKEIEDRLREVEEESKKAIEESKTSLKRVKEKSEKNVEDMKKLLEKVREDVR

SEQ ID NO: 23598 - protein, 178 aa, Artificial Sequence; identical to SEQ ID NO: 23597
  Synthetic sequence.

SEQ ID NO: 23599 - protein, 181 aa, Artificial Sequence
  Synthetic sequence.
SEVEKVLDEIRRLLKEVEERSKENNDRNEELARRNTRRSEENIRRIEELLRRVREEARKDRVPREVLKELEDRVREVLERNKEVLERLRRLHEEISRKNEEVLREVKREVEKVLEKLRRIDDEKFLREVRREIEEIIRRIKEASEKTHKEAKEVVDRINELSRKSHETIKEIIKRVRDRAK

SEQ ID NO: 23600 - protein, 181 aa, Artificial Sequence; identical to SEQ ID NO: 23599
  Synthetic sequence.

SEQ ID NO: 23601 - protein, 181 aa, Artificial Sequence
  Synthetic sequence.
REVDEVLDEIRRLLERVREESEKNNRDNEKLMRDNEDRSRKVIETIKRLLEDVKDRATKKNVPEKVLKEIEDLVREVLEENKRVLDTLRELHKEVSDKNKKVLEEVERLVTEVLKKLRDIDDEKFLREVRREIEEIIRRIRELSERTHREAKEIVDRINELSKRTLDKAKEMLDRAEEKAK

SEQ ID NO: 23602 - protein, 181 aa, Artificial Sequence; identical to SEQ ID NO: 23601
  Synthetic sequence.

SEQ ID NO: 23603 - protein, 181 aa, Artificial Sequence
  Synthetic sequence.
DEVEKVLRDIEKKLEDVERRSKEVIDEIRKLLKEVEEESRRNVKKIREELKKVVDDVRRKNVEREVLEEVKRLVDEILKKNEDVLREVTDLVRKVLRKNEEVLRTVKELIERVLDELRKIDDEKFLRDVKRMVDEILDTARELSRRTLEEIKRIIARIRERSEKSHEEARKALRDVEEKAR

SEQ ID NO: 23604 - protein, 181 aa, Artificial Sequence; identical to SEQ ID NO: 23603
  Synthetic sequence.

SEQ ID NO: 23605 - protein, 181 aa, Artificial Sequence
  Synthetic sequence.
DSVREVLKKIEDELERVKRDNKDVNRKNEELMRRNEERSRRVVEDIKRKLKELVDDVRRNNVPDDVLRELKELVERILRKNERVLEELKKLHKEVSDKNEDVLRRIEELVREILRKLREIDDEEVLKRVDEEAEKVLRENEKLSKKSLDEAREIVREINRLSEDTRREADEILERVKEKVR

SEQ ID NO: 23606 - protein, 181 aa, Artificial Sequence; identical to SEQ ID NO: 23605
  Synthetic sequence.

SEQ ID NO: 23607 - protein, 181 aa, Artificial Sequence
  Synthetic sequence.
DEVETVLEKIERLLRKLEKDSREVIKKIKRLLDEAKKESRKNIEEIKKLLEEVKREVDRRNVDDRVLDDVRRRVTEVLEENKRVLDELEKLVKRVLEENKRVLDEARKLVKEILDKLREIDDERFLREVEKELEDMLRRVRKLSEDTERKIREILERIKRLSDDSNRKAKEILREIRKRAE

SEQ ID NO: 23608 - protein, 181 aa, Artificial Sequence; identical to SEQ ID NO: 23607
  Synthetic sequence.

SEQ ID NO: 23609 - protein, 172 aa, Artificial Sequence
  Synthetic sequence.
DELEKVKEEIRRLLRRIEEDVKRSEERNKELLRRITEEVKRSERRNEELLKEIKDKVDSEILRKVEKAVEDSLRRLREVLRKVKEVVERVLETNRRILEEIKEVVERVEKLLDERDLKKVREDLERMLRRVEEELKRSNEESERAIEEVRRELEDIDRESRKAIEDVLREEK

SEQ ID NO: 23610 - protein, 172 aa, Artificial Sequence; identical to SEQ ID NO: 23609
  Synthetic sequence.

SEQ ID NO: 23611 - protein, 185 aa, Artificial Sequence
  Synthetic sequence.
SEIDEVLTRLRKISKDLNETSDRVNERARKIIDDIKKESKRVNDEAREIVERLKREIDKTRDRDVLRRILKEIEDVARRVKEINEELLRRVEKVVREVEEINRELVKRSREAVERVKRLLDERVSDKDKVERVVREVEKLHEEDRKRLEESTRSVRKLLEELKRELEKSTRSVKKLVDELRERVR

SEQ ID NO: 23612 - protein, 185 aa, Artificial Sequence; identical to SEQ ID NO: 23611
  Synthetic sequence.

SEQ ID NO: 23613 - protein, 185 aa, Artificial Sequence
  Synthetic sequence.
DEVDEMLKRAEDRIREISDTSRKVNEDARKIVEDLKRDSERVLRELRKRIEELRREIERDRDEDVVRRVERKVEKVVREVHERNKELLDRVRKVVEDVEDINRRLAEEVRRVAEEVRRALRRDADDEKRVREVAEEVKRLVKELEERLRRSTESVKRLLEDVERAVKESSDEVEKLLRRLREELE

SEQ ID NO: 23614 - protein, 185 aa, Artificial Sequence; identical to SEQ ID NO: 23613
  Synthetic sequence.

SEQ ID NO: 23615 - protein, 185 aa, Artificial Sequence
  Synthetic sequence.
DEIEEVLRDAKRISDELNRRSEEVNRELREIIKELTKRSRKVLEELKKIVRDLEKKIKDTRDKKDLDRIREEVTDVVRKVHEINKRLLEEVRRVVEEVKRINDKLVRDSERAVEKVRRLLERDVDDREKAERVLRTVEELHKEDRDRMKESTDSVKRLLEELKRRAEKSSRTVEELLRRLEEKIR

SEQ ID NO: 23616 - protein, 185 aa, Artificial Sequence; identical to SEQ ID NO: 23615
  Synthetic sequence.

SEQ ID NO: 23617 - protein, 185 aa, Artificial Sequence
  Synthetic sequence.
SEIDELLERAKKRSKELNDTSKEVLDRARRIIEEISKTSEEVNKDLERIIRELAEEIKRTRDRRVLDRIRREVRRVVKEVKEINERLLREAERVARDVHRINEELVRRSEEVVKEVEDVLRRKVDDEKRVREVLKEVRRLHEEDRKRMKESSEDVERLLTELRKRMKESTDSVEKLLKELEDRVR

SEQ ID NO: 23618 - protein, 185 aa, Artificial Sequence; identical to SEQ ID NO: 23617
  Synthetic sequence.

SEQ ID NO: 23619 - protein, 185 aa, Artificial Sequence
  Synthetic sequence.
SSLEKLLEDVRRRSEELNRRSRKVLEDLKDIIRRLKEESKRVLDEAKKKVDDVERKIDKDRRRETVKEVLERVEKVVTDVHRINEELLRRITEVVKEVHERNKRLVEESRRVVKEAEEVLRRDVDDSDKVRKALEDVRRLHEEDKRRVDESSKEVERLLRELREDMKRSSEEVERLVKRVRDRLK

SEQ ID NO: 23620 - protein, 185 aa, Artificial Sequence; identical to SEQ ID NO: 23619
  Synthetic sequence.

SEQ ID NO: 23621 - protein, 185 aa, Artificial Sequence
  Synthetic sequence.
SEADELLKEVKRISDELNDTSRRVLEELREISRRLNEDSKRVLKELEDILEEIRERIDRTRDREVLKRLLERVAKVVKEVHDINRDLVRRSREAVKRVHDINRRLVEESRKVVKKAEEMLRERVSDEERVRELVERVKELHEEDKRRMDDSSRDVERLHKEDADSARDSSRKVRELLEELRRRVE

SEQ ID NO: 23622 - protein, 185 aa, Artificial Sequence; identical to SEQ ID NO: 23621
  Synthetic sequence.

SEQ ID NO: 23623 - protein, 182 aa, Artificial Sequence
  Synthetic sequence.
KELEDVLRELKRILEELEKLSREADERSKEIVKRLVEETTRSLKEVKEIVERLKELDDAGKDRREVEKRLRDAHRKNEDTLRRSSEKLDRVLKESERVVRDSSTKLRKVLKDAEDVVRDKVEDEKRAREVRETVRKLVEDVKKKNEESERRNRELVKEVRKRNKEVRDRSRKLVKELEDKLR

SEQ ID NO: 23624 - protein, 182 aa, Artificial Sequence; identical to SEQ ID NO: 23623
  Synthetic sequence.

SEQ ID NO: 23625 - protein, 182 aa, Artificial Sequence
  Synthetic sequence.
SSLEKVLKDLRKILEDLRREIKTVLDDLRRILEELKRETERVDKKSKEIIETLSELRKAGTDSRDVDRRVKEVLEESRRAVERSSRKVKKVLEDAREVVRRIEEAADKVLKDARRVLREKVEDKKKVDEAIREVEKLIEELRRDLDRVRKTVEKLVRDLERRNEESKRRNEKLVRKLEEELR

SEQ ID NO: 23626 - protein, 182 aa, Artificial Sequence; identical to SEQ ID NO: 23625
  Synthetic sequence.

SEQ ID NO: 23627 - protein, 182 aa, Artificial Sequence
  Synthetic sequence.
DELETVLRKLEKLVRDLKKRSTDVLRRLEEIVKELTDETKRVDDESRDILRRLKELRDRGVDSREITKRVREALKESRRVIKKSSEDVERAIDEVRKMIEKSSRDVDEVLREVREVLRDKVENKEEADRVITTVEELVKELRRRNEEVKERVEKLARELRRRNEESIKTNEKEVRELEKRLK

SEQ ID NO: 23628 - protein, 182 aa, Artificial Sequence; identical to SEQ ID NO: 23627
  Synthetic sequence.

SEQ ID NO: 23629 - protein, 182 aa, Artificial Sequence
  Synthetic sequence.
STLKKVLDENRKSIKELLDMSRRVLEKLREILRRLEEETREVDEKSERIVTTLEELIKAGTDKRRIKEELDRALKESEDMVRDSSRKLEEVLEEARRVVEDSSRKLRRSLEELKKVVRDKVEDEDKAKKVIDEVRKSVKRLEEENERVLRDVERLVREVEKKNRESEKRNRKLVEELRRKLK

SEQ ID NO: 23630 - protein, 182 aa, Artificial Sequence; identical to SEQ ID NO: 23629
  Synthetic sequence.

SEQ ID NO: 23631 - protein, 182 aa, Artificial Sequence
  Synthetic sequence.
SVLEEVLKKLEKILRELKREIEEVLKKLRRILEELVRETEKSLEKVDRIIKELEKLIEAGRDKRDVEREVRRVHRENEETLRRSSEKVDRVLKEVEDVVRRIDRRVKEALREAREVVRDKVEDEKKAREVTKTVEKLIRELRKTLEDVKREVRKLVEEVKRRNKDVERKSRELVKKLEERLR

SEQ ID NO: 23632 - protein, 182 aa, Artificial Sequence; identical to SEQ ID NO: 23631
  Synthetic sequence.

SEQ ID NO: 23633 - protein, 182 aa, Artificial Sequence
  Synthetic sequence.
STLEEVLERNKESIERLRKESEDSHRKLKEIMERLKRETERSLEEVEEIVKRLKELTDEGRDKREVRKRLEEVHRKNEKTVRESSEKVERVLKENKESVERIVEKAEESLRRLAEVLRDKVDDKEKVKRVIEKAKKSVEDLERRLREDEEAAREWVKKLRTENEKVRKRSEELVRELEERLR

SEQ ID NO: 23634 - protein, 182 aa, Artificial Sequence; identical to SEQ ID NO: 23633
  Synthetic sequence.

SEQ ID NO: 23635 - protein, 182 aa, Artificial Sequence
  Synthetic sequence.
STLEKVLRDLRKILEELLRMSKKVLEELKRLADRLKEEIKKSLDKVKKIIDELRDLTRKGKDKREVEERVKRVHDENEKTLRKVIEDVRRVLKEVRDVIKESSDRLREVLERARRVVRDKVEDEDKARKVIEEVTREVRRVEEENKKVERTVEKLVEELEETVREARERSERLVRTLEEELR

SEQ ID NO: 23636 - protein, 182 aa, Artificial Sequence; identical to SEQ ID NO: 23635
  Synthetic sequence.

SEQ ID NO: 23637 - protein, 182 aa, Artificial Sequence
  Synthetic sequence.
SDAERVEKEIREVLKRVEDLLRRVNEETKKVAKEVRELLKEVDDRSREIMKRVAEKLRRISDKKTAKEEVDRVLKEIEKTLRDLKRTVEEVLKRIEDLSKKLHEDVRRVLEEVEELLRRLLERRKDDKDVAREVEKLLRELEKKLEEVNRHDKKLLEELEERLKESEERNRRLLEELKRRLD

SEQ ID NO: 23638 - protein, 182 aa, Artificial Sequence; identical to SEQ ID NO: 23637
  Synthetic sequence.

SEQ ID NO: 23639 - protein, 182 aa, Artificial Sequence
  Synthetic sequence.
REVEEVLKRIEELIRRSEEETREVNERTKKLAEDVRRLLEEVDRRSKKIADEVRELLERIDDKDTARELVDRVVKKIERTARELRKTVEDVLREIKRLSEELHKRNRTSVEDIRRLLKDVVDKRKDSKDLVRTVEELLKRNEEDLRRVNEHDKKLLEDLTRSLERSEERNKTILEKLKEDLR

SEQ ID NO: 23640 - protein, 182 aa, Artificial Sequence; identical to SEQ ID NO: 23639
  Synthetic sequence.

SEQ ID NO: 23641 - protein, 182 aa, Artificial Sequence
  Synthetic sequence.
SDAEKVLDEIRKRIEESEKRTKEVNDRTREVLDRVRKLLEKVNKESRKVAEDVREAAERIKDKEELRKTVEEVLEEIKRISERLHERVRRVLEEIKRLSDELHKRNRESVKEIRELLRELLERRKDDEEVRKDVERLLRENERSLREVNRHDEALLRELEKRLEEVNRHDDKLVKDLRERER

SEQ ID NO: 23642 - protein, 182 aa, Artificial Sequence; identical to SEQ ID NO: 23641
  Synthetic sequence.

SEQ ID NO: 23643 - protein, 178 aa, Artificial Sequence
  Synthetic sequence.
DEVREILEDVKRINKEVEDELRKIEEEIREIVKTVRDESRKTLEELERILRKVEDDLRKDRREEILKTVKELVKKIIDDDRRIVERVLRELERLVEEIKKVVDEVKRLNKELIDRLKTRNPEVEEAVKDNERLAKETEDKVREVVKRIRKIIEEVERTARESERRLRKLLKEVEDRAR

SEQ ID NO: 23644 - protein, 178 aa, Artificial Sequence; identical to SEQ ID NO: 23643
  Synthetic sequence.

SEQ ID NO: 23645 - protein, 178 aa, Artificial Sequence
  Synthetic sequence.
EEIERILEELRRIAKKVEEDSRRTLETVRRLNEEVKRRLREILEEIRRVAEDVRRKLDEKRSDEEAVRRVLEDVKKKVEDVKRRLEEVLREVEKKNRDVTETNKKILRDLEKKVRDVIRRVKSEDVKRELERILEEVRKKSREALEKNKRLLEDTRRVVEEVKRELEKILRDVKRKVD

SEQ ID NO: 23646 - protein, 178 aa, Artificial Sequence; identical to SEQ ID NO: 23645
  Synthetic sequence.

SEQ ID NO: 23647 - protein, 182 aa, Artificial Sequence
  Synthetic sequence.
SVVEELRDELRRAEEENRKIVEDTTRRLEDMIRRDEKINEEVERRLEEVTRRVEELRKQGRDKDEIVDELRRVVEELEKILRDALKDSTRVVDELRKVNEDATRISREVVRRLRKLLKDRVDDERKAREMEKEVTEILRRLEEENKRDLDRIKKLLDELRKKNEDTLRRIRRLLEEVRERLR

SEQ ID NO: 23648 - protein, 182 aa, Artificial Sequence; identical to SEQ ID NO: 23647
  Synthetic sequence.

SEQ ID NO: 23649 - protein, 177 aa, Artificial Sequence
  Synthetic sequence.
SSLDEVLERLRKLLKEIEDKVRRINEEVKKSSEDVERELKRVVDELKRRVERLKEEVRLERLIRELERILDEIKKKLDRLAEENRKILKRVNDESKRILDELRKILRELEERLRRITDERELEKILRDAERVVREIEKRHRDLLEELKKANEDTRRALDEIRKEAERVLERVREEAK

SEQ ID NO: 23650 - protein, 177 aa, Artificial Sequence; identical to SEQ ID NO: 23649
  Synthetic sequence.

SEQ ID NO: 23651 - protein, 177 aa, Artificial Sequence
  Synthetic sequence.
DEVEEVLKRLRESSEESKRRADDVTRRAEESSRRVHKRSREVVERLKKLVEEVERRVRLRELLETLRRILERLKERLEKLNEENKRILEKVKRDIEKLKRDNEEILREVEERAKRLRDRRELEKLEREMRDVDRRTDEALERLLRTLEEVNKRTDEENKKILEDLKRVVEEVEERDR

SEQ ID NO: 23652 - protein, 177 aa, Artificial Sequence; identical to SEQ ID NO: 23651
  Synthetic sequence.

SEQ ID NO: 23653 - protein, 177 aa, Artificial Sequence
  Synthetic sequence.
SEIEKVIEELRRSSEESHKRSRKVEEDARRSSDEVHRRSREMLRKLREEVKDVERKVRLEDLLRKLREILKRVEDDARRLNEENRRILKELEERLEKLNRDNKKILEDVERRLRRITDRRDLRRLREEMRRVDERTTRENEKILRELEEVNKETIKENERLLRDLKRVVDRVREEDR

SEQ ID NO: 23654 - protein, 177 aa, Artificial Sequence; identical to SEQ ID NO: 23653
  Synthetic sequence.

SEQ ID NO: 23655 - protein, 177 aa, Artificial Sequence
  Synthetic sequence.
RRIEEVIKEARKSSRESHEESKEVMERLKRSSDDSHRKSEEVLRRLRKLVEDVERRVRLRELLEELRKILKRLEEKARRLNEENKKILERVKRLLEELNDRNERILRRVEDDLRRITDDRELKKLRDELKRVDDETRKANEEILREMEEVDKRSKEANDRLLEELAKVVKRVDDEDR

SEQ ID NO: 23656 - protein, 177 aa, Artificial Sequence; identical to SEQ ID NO: 23655
  Synthetic sequence.

SEQ ID NO: 23657 - protein, 177 aa, Artificial Sequence
  Synthetic sequence.
KDIEEVIRRLRESSKESTKRLRDVVEDLKRSSKEVHDESEDVLRRLEELVRRLKKKVRLRELVKRLEEILEELRRRAKELNRRNKEITEELVKELEELVRRNEEILRDVERKLRRITDKRLLKELEDRMRRVDERTDEELEKIRKRMKEVDDRSRDVNRKLAEDLKRAIKRVDDEEK

SEQ ID NO: 23658 - protein, 177 aa, Artificial Sequence; identical to SEQ ID NO: 23657
  Synthetic sequence.

SEQ ID NO: 23659 - protein, 182 aa, Artificial Sequence
  Synthetic sequence.
DEVREVLRRDEELHRELKERIDRILEELERLHRDLKRKIDRVLEELKRLHEDVKRELDKRGGIEELKERSDRVLTKSARIAEELKKTSDDVLRKTREIVKEIKRKLDDNLRRVREIVEKLKNVEEALRKLHEESKKSVRDVEKELEELRRENKKVIEDLEDELRRLLEENKRAADELRKRAE

SEQ ID NO: 23660 - protein, 182 aa, Artificial Sequence; identical to SEQ ID NO: 23659
  Synthetic sequence.

SEQ ID NO: 23661 - protein, 182 aa, Artificial Sequence
  Synthetic sequence.
DEVEKVKDDVRKLVEKVKRDAKRAHEDNERKHRKLKKELDDALRELKKRHEELKRRIDDRGGDKDLKKRSDDVLRKSEEIVRRIKKELDENLRRHRERVERIKRKLDELLKKIDDIVEKLKDVDEALRRLKEELDKMIEDVRKELRKLNEDSDDSIRRVKKRLKELRDENEKVIRDIRRETE

SEQ ID NO: 23662 - protein, 182 aa, Artificial Sequence; identical to SEQ ID NO: 23661
  Synthetic sequence.

SEQ ID NO: 23663 - protein, 181 aa, Artificial Sequence
  Synthetic sequence.
SELEKVRKKVEDISRESEKHLREVKKENDRIIKEIEDELRKLLTDVEREIREVEKRIREERSEKVREEIKKRLERLLEEVRKAIEDLKRKSDEVVKETEKAVRENEEKLEDLRREVAEADDRREKAKRVFEEIERIVRRNKEELRRILKELRELHEEVKEKIKKVLEDVKRLVDELLERAK

SEQ ID NO: 23664 - protein, 181 aa, Artificial Sequence; identical to SEQ ID NO: 23663
  Synthetic sequence.

SEQ ID NO: 23665 - protein, 181 aa, Artificial Sequence
  Synthetic sequence.
SELEKVLRDVREAIKRNEDLLRRVHEESRRISEESEKNLRRVHERSRRIAEDVRRVLRERRDEDVVRKLRKKLEDLLEESTRAVKENVDELRRALERSEEVVKRSEEHLRDVLRRVEEADDRREEAEKVAREAKKLVDDLKRKNDEVLDEDRKEVERNERELERVLREDKKLLEDLEREIK

SEQ ID NO: 23666 - protein, 181 aa, Artificial Sequence; identical to SEQ ID NO: 23665
  Synthetic sequence.

SEQ ID NO: 23667 - protein, 181 aa, Artificial Sequence
  Synthetic sequence.
DFAKKLEDEARRVSEESRRHLEDLLRRSKESIDALKRKLEDMLRRVREVIKRIEDELRRERSESVAKSVRDLLREVRDEVRRVRETLKKESEEDRKRVEEVLRRNEELLKRVDERLKEVLRRGEISERVIERIKELLDRNRKELEDVARDAERLNRELNERVDRVLKEVEERLKELEDRVK

SEQ ID NO: 23668 - protein, 181 aa, Artificial Sequence; identical to SEQ ID NO: 23667
  Synthetic sequence.

SEQ ID NO: 23669 - protein, 181 aa, Artificial Sequence
  Synthetic sequence.
DKAKELEEEIRKIIREIEELLRRMEETSRKSSKESEKHLRDAHEDSRRIAERIKDLLRKEKSEKVREEVERLLRDLERRTREVIKTNRKLSEDDKRRVDEVLKRATELLEELRKKIREVLERGEVSEDVIRELERLLRELKKRIEDVVRRIKELNEDNNRKVEKIREDDERLLEKVRRDVK

SEQ ID NO: 23670 - protein, 181 aa, Artificial Sequence; identical to SEQ ID NO: 23669
  Synthetic sequence.

SEQ ID NO: 23671 - protein, 181 aa, Artificial Sequence
  Synthetic sequence.
SAAEDVLRKVEKIIKEIEELLKRALEESRKSVKELEKILRDAHEKSRKIAREIEDALRKRKDEDVARKVEDLLRRLKEDTERVIREIERLSEEDKRRVEDVLRKAEELLERLRKAVREARERGEVSDEVVEEIKRLLEELRKKIEDVADEIRRLNEEVNKKLDDLVKTDTKLLEDVDRKVK

SEQ ID NO: 23672 - protein, 181 aa, Artificial Sequence; identical to SEQ ID NO: 23671
  Synthetic sequence.

SEQ ID NO: 23673 - protein, 181 aa, Artificial Sequence
  Synthetic sequence.
SAAEEVRKKNEKISRELEKLNRKALEDSRDSIRKLKKILDDAHKDSREIIKEIEDLLRKRRDEDVRKRVEELLRRLEERTRKVIKEIRERSKEDEERVKEVHEENKKISEDVKREVKEVRDRGEVSDEVVEEIKRSNDENNERSKKVLDEIKKLNKEVNDRVEELLERDKRELERVKRDVD

SEQ ID NO: 23674 - protein, 181 aa, Artificial Sequence; identical to SEQ ID NO: 23673
  Synthetic sequence.

SEQ ID NO: 23675 - protein, 181 aa, Artificial Sequence
  Synthetic sequence.
DEFRDIEERAKELAEENETINRRVLTEHKKLIDELREILERVLREHEKRLKDLKDLVRKIDSEEVKKTITDALKRLRETSKELADEVKRVEDELRKTTEELERENKKLLDEVRELLKKVKRDGVVSEEILERIRKLLEDVEEKVKKSVEDSRRLLKTIREEVERVLDTSRKLLKRLEDDVR

SEQ ID NO: 23676 - protein, 181 aa, Artificial Sequence; identical to SEQ ID NO: 23675
  Synthetic sequence.

SEQ ID NO: 23677 - protein, 184 aa, Artificial Sequence
  Synthetic sequence.
SDLEEVEKRAEEIIRRNKEELEKVLRESKDIIDKNRKLNKESLDEVKRIIERLEDLLRKDGRSERVEELVRKVDREIREVIKRNRELNERSVRELEKLNRESEKLDRESKKELDDLIRDLERRSDTEEVRKVAKKIRDEAKKSHDESKKLNDTSRDLVRKSKEEAERIDEEMKKLLKEIKDKVR

SEQ ID NO: 23678 - protein, 184 aa, Artificial Sequence; identical to SEQ ID NO: 23677
  Synthetic sequence.

SEQ ID NO: 23679 - protein, 181 aa, Artificial Sequence
  Synthetic sequence.
SEVEEILKRIEDLARTLLKLNEDSLRRNEEIIRTIKELNEKTLKENKEIIDRLRELLRRTRDKDTLEELLKKVEEELRRSNEEDKKLLETAARLVKRSNEEDKRLLEEAAKRVEELLDEARKRNLDERVLKEIEDLLREVADRSRKFNERSERLLREVEERSREVNDRSKKLMDTIAKEVK

SEQ ID NO: 23680 - protein, 181 aa, Artificial Sequence; identical to SEQ ID NO: 23679
  Synthetic sequence.

SEQ ID NO: 23681 - protein, 181 aa, Artificial Sequence
  Synthetic sequence.
SEVEKALERVKKLAEDLERLDKESLERVEKVIRDAERLDKTSREEVKKIADEADDLRRRAKDKDTLRKLLEDLKRRAEELNRKNEELLRRVAEAIRRISEDNRRLLEEVARRVEDLLREARERNVDEEVLRRIRRLLEEVRKKVEDSNRELKRRLDELEKRVRDSNKEIRELVKEVERKVN

SEQ ID NO: 23682 - protein, 181 aa, Artificial Sequence; identical to SEQ ID NO: 23681
  Synthetic sequence.

SEQ ID NO: 23683 - protein, 181 aa, Artificial Sequence
  Synthetic sequence.
SRLEEVLRRIRKLLRDNKETAKRVLEEIERLLREADKRNREALKEIEKRMREVEDKLRKARLPEDVVRELRRRITELLRRLEEITRRSRERVKEILERLKEVVERTERKIRKIERELSEIKREKDLEELRRRVKEVSDESRKLLEDLLDEARKVLEENRKLVEEILREAKKVIDEIEEKLR

SEQ ID NO: 23684 - protein, 181 aa, Artificial Sequence; identical to SEQ ID NO: 23683
  Synthetic sequence.

SEQ ID NO: 23685 - protein, 181 aa, Artificial Sequence
  Synthetic sequence.
SELEKVLREIRRLLDEARKRNEEFLRRIEELLRRNEEEVRRVLEKIERKVERVKRDLERRRVPEEVVRDAERRIDEIRRKIEEILERTKRDVERLLKELRDITRETERRVKELEDELSRVRREEKLERILRTARKVVEDNERLVREVLKKVKRVSDESRRLLEEIDREVDEVIKRLEERAK

SEQ ID NO: 23686 - protein, 181 aa, Artificial Sequence; identical to SEQ ID NO: 23685
  Synthetic sequence.

SEQ ID NO: 23687 - protein, 175 aa, Artificial Sequence
  Synthetic sequence.
SEAEEIRRRLEEISRRSVEHLRKVLEEIKRISERSKRHLDRVLEENKRRLEELRELLERGRDKRELLEDLKRVHDESRKVIEKNKEENDRALKRAKEVIDENRERNKRVLDEVRKGGLPEEVLRELEELLKESEERIKRIEEEIKKIIDKSREDIKRVLEEIERLNKKAADDLRK

SEQ ID NO: 23688 - protein, 175 aa, Artificial Sequence; identical to SEQ ID NO: 23687
  Synthetic sequence.

SEQ ID NO: 23689 - protein, 175 aa, Artificial Sequence
  Synthetic sequence.
DEVREVLEELKRISDDSIRHLEEVLRRLREIIERLKATNDDVLRELEEIIRTLLDLDRQGVDKEELKKALDDVLRRIEDIHRETKRRLDEVLKEAEEAADRNRERNERAVEKVRRGGLPKEALDTLERTVEESKKRIKEILDRVKELIDKAREDSKRSVEEVRRRIEKARRDLDR

SEQ ID NO: 23690 - protein, 175 aa, Artificial Sequence; identical to SEQ ID NO: 23689
  Synthetic sequence.

SEQ ID NO: 23691 - protein, 175 aa, Artificial Sequence
  Synthetic sequence.
SKVDELLKRLEDIIRKLDKENEKVLRELEEISKRSVDHLKRVLEENRRILEELERLLEGGTDKEELLRRLEEVHRRSRRMVEENKKRNDDVLRRVTEVHKETKDRLEKALKDVKDGGLEERVLRDLKRLVDEARRRSERSLEEVKRIADESRKEIERILREIEEENRRAKDKLRR

SEQ ID NO: 23692 - protein, 175 aa, Artificial Sequence; identical to SEQ ID NO: 23691
  Synthetic sequence.

SEQ ID NO: 23693 - protein, 175 aa, Artificial Sequence
  Synthetic sequence.
SRAEDLLRRLEKIIRDSLRHLREVLKRLERIIDELRKTNERVKEELERIIDTLRKLKDNGVDKRRLEDELRKVDERIKRIHKKTVEDLERVLKEVEDVARENKKRNDEVLKEVEDGGLPEEILRRARELVDESRRRLEKVVKEVRDVIRTLKKDSDKSLRDLEEEVRKAEEDLRK

SEQ ID NO: 23694 - protein, 175 aa, Artificial Sequence; identical to SEQ ID NO: 23693
  Synthetic sequence.

SEQ ID NO: 23695 - protein, 175 aa, Artificial Sequence
  Synthetic sequence.
DEVRELLDTLRRIIERSVKHLEDVLRDLKRIIDKLREDNRRVLEENRRRLEELDKLRKEGTDKEELKRRLDEVHKESRDIHRDTRRRLKEVLDRVKEVAKRNREENDKATDDVRKAGLPEEFLRDVERLAEESRRRLEAVEREVERLITEAEKESKKSLDEVERLNRELKERLKK

SEQ ID NO: 23696 - protein, 175 aa, Artificial Sequence; identical to SEQ ID NO: 23695
  Synthetic sequence.

SEQ ID NO: 23697 - protein, 183 aa, Artificial Sequence
  Synthetic sequence.
DVEDILRTIRDLIRRVDEKSRKTLEENRRAIEEVLRRSDETLRRNKKLIEDVEEEVRRTVKDEKLLREVKRRLEELLKENKEMADRTREKLERLLRENERVVKETKRTLKEILDRAEEAARVERREFMETVLRKIKEDIERLEERNREVHEKSREEIRKLEEENEEVHRKSRKEIDEIRKELK

SEQ ID NO: 23698 - protein, 183 aa, Artificial Sequence; identical to SEQ ID NO: 23697
  Synthetic sequence.

SEQ ID NO: 23699 - protein, 183 aa, Artificial Sequence
  Synthetic sequence.
DVEEILKEIRKRIEDVKRESEKTLKEIRDLIKKVAEDIERSVKENRELIDKVRRELERDVRDEDLLRRLKEKLDRLLKRSEEVAERLRRKLKRLAEEVERVAEDTKRKLEKLLDDAEKMSRMDDRKVLTDVLKEIERRIDELRRRNEEVVEKIKREIKKLEDESKRVNDESREIIKRIKEEVD

SEQ ID NO: 23700 - protein, 183 aa, Artificial Sequence; identical to SEQ ID NO: 23699
  Synthetic sequence.

SEQ ID NO: 23701 - protein, 183 aa, Artificial Sequence
  Synthetic sequence.
DVEEIIREIRKLIEKVLRDVRRSAEENKKLIDEVKRRVEEMLKRNRDMIKKVLDDVRREVRDERKLDEVRKELEELLKENERVAEKVDRRLRELLERSKRAIRELERKLEELLKKVEEAKKVERREFLKKVLDEIREIIERLRRESEKVNEDSKREIKDIERELREVHKKSRRIIRRIEEKLR

SEQ ID NO: 23702 - protein, 183 aa, Artificial Sequence; identical to SEQ ID NO: 23701
  Synthetic sequence.

SEQ ID NO: 23703 - protein, 183 aa, Artificial Sequence
  Synthetic sequence.
DEAREVLERLKKISEEDKRRSDKVNEETRRIIKEAEERSRKVNEETKRIIEKLEEDLRDRPKTKELLDELRDILRRAKERSDEVLKRLREILDRIRKRSEKVFKESREINEELRRRVEDVVRKGVISEEILRELREILRENTERVERSLRDNRRLLDELRKKVERSAEENERLLREAEEKLRK

SEQ ID NO: 23704 - protein, 183 aa, Artificial Sequence; identical to SEQ ID NO: 23703
  Synthetic sequence.

SEQ ID NO: 23705 - protein, 175 aa, Artificial Sequence
  Synthetic sequence.
SEVDKVLDDSRKSAEDLRREIETVLKRNKELIDENRKRLKEVLDRNAKLADDLRRERKKGTDEKMVEDVDRTSKKTIEDLKRESEKSLRDSEESIRRLRERARENIERNRKLVEDVRIEERVVRTLEKLIEEWRKAVEDVLRTLEKLTEEAKRESERILEELKRITKELRDEERR

SEQ ID NO: 23706 - protein, 175 aa, Artificial Sequence; identical to SEQ ID NO: 23705
  Synthetic sequence.

SEQ ID NO: 23707 - protein, 183 aa, Artificial Sequence
  Synthetic sequence.
SEVEDVLRRLEELLRRLEKKSRESLEELRRRLDEVRKDSERSNEDSERLIRELEEIRRKLEDEETVRRIVERVLEELERINRENHEKAKRVVEELEKIIEENHREAKRVTETLEELIKRLKERNPELKEFLDTMRRIVEELKKRLKEVNDRIKDIVRRAEEELKRSNDENKERIERAEKKVRD

SEQ ID NO: 23708 - protein, 183 aa, Artificial Sequence; identical to SEQ ID NO: 23707
  Synthetic sequence.

SEQ ID NO: 23709 - protein, 183 aa, Artificial Sequence
  Synthetic sequence.
SELEKVLEELKKLLEELERESDTSVKELRTLLERLEEESKESNERSKRLAEELERRLKDEKDEDTVDKIVRDVLTKLDKLNKDNEKRAREVLKRMDEIIKRNHKRARDVIKRLREIIDDVRRRNPEAREFLETMERIIEELEKRLREVNEDLKRIVRTVAERLKKSNRDNRELIRTLKDRVRT

SEQ ID NO: 23710 - protein, 183 aa, Artificial Sequence; identical to SEQ ID NO: 23709
  Synthetic sequence.

SEQ ID NO: 23711 - protein, 183 aa, Artificial Sequence
  Synthetic sequence.
SEVEDVLRRLEELLRRLKEKSKKSNEESKKLIKELKEESDKSRRDLERLLEKLDRDLKRLKDKETVKKIVDEAEKRLRRIIEENHRTAEEALRELKKINERNREMAEEVVKRLRELIDELRKRNPEVREVLERMRELVEKLKEDLERSNKENKDLIDKVKRDLEEVNRRLEKIVREVKERVRT

SEQ ID NO: 23712 - protein, 183 aa, Artificial Sequence; identical to SEQ ID NO: 23711
  Synthetic sequence.

SEQ ID NO: 23713 - protein, 183 aa, Artificial Sequence
  Synthetic sequence.
SEVEDVLRRLRELIEELRERSERSNEESKRLADELEKRSEESLRRLAELLRKLEEDLRRLEDKDTVDKIVEDVKRKLDKIIKDDHDTAREMEKRLEKINEENKREAERVLREAKRLIDELRKDNPEMREVLTTIAKIVTDLERELRKSNEENKKLIDELRKRLEDSNKRVKEIVKRLEEEVRR

SEQ ID NO: 23714 - protein, 183 aa, Artificial Sequence; identical to SEQ ID NO: 23713
  Synthetic sequence.

SEQ ID NO: 23715 - protein, 182 aa, Artificial Sequence
  Synthetic sequence.
KDVEEALKELERVLEELKRLSKELLDRLRELADRIRRISKELLEELKRLLKDIKETVDRIKDKDTLEEVVRRLVKELEDILRTHKRLVDDIIERLKKILEDHRRLVERAREELERLLKELEDRGVDEDVLRRLRELIEKVKRDLDRTDETLKELIKTLEDELRKSNETIEDLIRRLEEALRK

SEQ ID NO: 23716 - protein, 182 aa, Artificial Sequence; identical to SEQ ID NO: 23715
  Synthetic sequence.

SEQ ID NO: 23717 - protein, 182 aa, Artificial Sequence
  Synthetic sequence.
SDLERLLDELRKLLDDLRRKSEELLRRLDTLAKKIEREAEKITKDNKELIDRLRDRLRRIRDEDTLREVVKEAVKRLRESLRDHERLVDEIRRRLEKILEDHRDLKRRIEETAKKILDDLRRRGVEERMLRTLERLIEKLKEELKRTDKELERLIRELKKRLDDNNRRNEELIKRVEDELRK

SEQ ID NO: 23718 - protein, 182 aa, Artificial Sequence; identical to SEQ ID NO: 23717
  Synthetic sequence.

SEQ ID NO: 23719 - protein, 179 aa, Artificial Sequence
  Synthetic sequence.
SEAETVLEEMKEVSKRTEEKNKKVEDDDKRSIDELRKKLEKVLREDRRSIEDLERRLKENKGSDKVLRELKERLRRNKDRSEKVVEDLKRELDKNLEDSKKISEETKRENERALEKARRANVEEEVLRTIERLSRENKKKDEDTLRKSKEEHERVREELERVLETSRREHEKVKKRLED

SEQ ID NO: 23720 - protein, 179 aa, Artificial Sequence; identical to SEQ ID NO: 23719
  Synthetic sequence.

SEQ ID NO: 23721 - protein, 180 aa, Artificial Sequence
  Synthetic sequence.
RVEEMLERLRRLHEEVKRRIDEVLRELEEESKRNEERIRRVLERLRDEHRKLKETLDRRNADDDLRRTLEENRRKVEEIIRRLEELNERARKELKKIVDELRKKLEENLKRVEDVIREPVDEEELERLERKSRESIERLKDTLRELKERLKRISDRSDEKLREAEKRSRESIEEVKKRAK

SEQ ID NO: 23722 - protein, 180 aa, Artificial Sequence; identical to SEQ ID NO: 23721
  Synthetic sequence.

SEQ ID NO: 23723 - protein, 180 aa, Artificial Sequence
  Synthetic sequence.
EVEDVMREARKLHKELEDKIRDAARRIRETIDRVKKEDDDSLRKLRKLHEDLKRELEKRNVDRTLEEKLRRNLDEVEKASKESRRHLEELERDVERIIEALKETLRRNLKKVEDVVKKPVDRDELRKLLEDSKRSIEKVEDDLRKLEEKIKRVIDDNRRKNKELEEKSRKSIRDLEEEVR

SEQ ID NO: 23724 - protein, 180 aa, Artificial Sequence; identical to SEQ ID NO: 23723
  Synthetic sequence.

SEQ ID NO: 23725 - protein, 180 aa, Artificial Sequence
  Synthetic sequence.
EVEDVLRELRKEHDDLRKEITDVLRRLEKLHRELDEEDERSVKRIRELIEEVMRELRKRNAEERLEEELKRALEDVERVSKESKDHLRENLRRVEEIAKRLRDLLKENLKKVEEVLREPVDRKDLKALKEDSKRSIDDIRRKLEEARRRSERSIDENRKLNKRVIEKIREIIRRLEEKTK

SEQ ID NO: 23726 - protein, 180 aa, Artificial Sequence; identical to SEQ ID NO: 23725
  Synthetic sequence.

SEQ ID NO: 23727 - protein, 180 aa, Artificial Sequence
  Synthetic sequence.
EVEDVLREAERLHRTLLKEIRDALRRLRKLIEDVKRKDDESLKRLREKLERLKESLERNKVEEDLKRTLEKVREELERASERSKRHLEKVLRELEKIIKELEDRLRENLDRVRRVVDKPVDREELKKLLEDSKRSLDELRRRLKEVEDRVREAIKKNEDENRKLERRLDKIIEDLERRVK

SEQ ID NO: 23728 - protein, 180 aa, Artificial Sequence; identical to SEQ ID NO: 23727
  Synthetic sequence.

SEQ ID NO: 23729 - protein, 181 aa, Artificial Sequence
  Synthetic sequence.
SEAEKILKEIRDISDRTREELKKVKDEHKTLIDRLREILERALREHDRLAKELEDIKRKIDSEDLRREAERVLETLKRTSEELDEIVKKVERELEDTTRRMEESLRDMNRRLRELLDKLRKDGVPEEVLREISKIIKDNHDEVTEVLKESEELIRRLRKEVEDVRRTSEKLIRELEERVRE

SEQ ID NO: 23730 - protein, 181 aa, Artificial Sequence; identical to SEQ ID NO: 23729
  Synthetic sequence.

SEQ ID NO: 23731 - protein, 181 aa, Artificial Sequence
  Synthetic sequence.
SEVDDVLRRLEELIKTLEDINRKSLEDIKKLIDDLRKILEDALRKHEKLIRELREMKKRIDSREAEEIAKRVLEELKRTSDDLRKKVERVDEDLRRLLRENHERNKKILRDLERLLRDAARRGVPKEFLDRMREEIRRLEEESRKSDETIERLIRELRRRVEEVLKTSTDLIRELEEEVKK

SEQ ID NO: 23732 - protein, 181 aa, Artificial Sequence; identical to SEQ ID NO: 23731
  Synthetic sequence.

SEQ ID NO: 23733 - protein, 182 aa, Artificial Sequence
  Synthetic sequence.
SSVERVLEAVKELAKKLAEDIRRSLEHIRRLLEEVEKKHRDSKEHVRKLLKDLRDIAREKGAGEELVRDADRLAEEIKKYHDENVDRIRRAVEELAEAHKRLLEEAEKLVRTIEDRLRKVGSDDKELKKILDELRKLIRKVLEALRELNKRAKEILDRVAENVKEVNERLERLVRRIAEEIR

SEQ ID NO: 23734 - protein, 182 aa, Artificial Sequence; identical to SEQ ID NO: 23733
  Synthetic sequence.

SEQ ID NO: 23735 - protein, 182 aa, Artificial Sequence
  Synthetic sequence.
SSVERVKEEVEKLLEKLEREIRKSLKTIRELLRELKRKHEESKEHVRRLLEKAEREARRRGVDERLVRELRKLVEDIERYHDDNLRRAEEVVRKVEEDHRRLLEDARKLVEEIKRRLEEVRSDDKKLEEILRRAKELIDRVLEELKKLNEELRRIIEEIVRNVKRVNEKLEKLLRDIKRRID

SEQ ID NO: 23736 - protein, 182 aa, Artificial Sequence; identical to SEQ ID NO: 23735
  Synthetic sequence.

SEQ ID NO: 23737 - protein, 182 aa, Artificial Sequence
  Synthetic sequence.
SSVEEVLRRVKELLKTLKKKHEDSKRTVKELLDDLRKKHEDSKRHVRKLLEELEKRARERGVDKRLVDELRELMKRIEEYHDRNLKRVEDLIKEIERYHDRNLAELEKLARRIEERLKTVRSDDKELKRILEEVKELVKRVLENVERVNREVRERLKEVSRNVERVNKEAKELVDEVEERAR

SEQ ID NO: 23738 - protein, 182 aa, Artificial Sequence; identical to SEQ ID NO: 23737
  Synthetic sequence.

SEQ ID NO: 23739 - protein, 182 aa, Artificial Sequence
  Synthetic sequence.
SSVEEVRKRVRDLIKRYREEVEKIKKDVRRLLDELREEVKRSLDHVRKLMEELRRKIKRDGVDRRLVEEADELVKTIEDRHEKVKRTAEKLVEDVEREHDELKRKVEELVKEIERRLEEVRSDDKELKRILDELKERLERAKRENEDSVRKLRKLIEEILREIRRLNKEAEDLIREIEERAR

SEQ ID NO: 23740 - protein, 182 aa, Artificial Sequence; identical to SEQ ID NO: 23739
  Synthetic sequence.

SEQ ID NO: 23741 - protein, 182 aa, Artificial Sequence
  Synthetic sequence.
KDVEEVLTRVRELLRRVEEEIRRSEEHIRRLLEELRRKHEESKDSIRKLLEDLEEKVRRRGADERLLREAKRLVEEVERYHEKNLRDAEEMVRRVEEKHRRLLEEIRRLAKRIVDDLRRVRSDRKDLEEILREVEKLVEEVERRLRKLNEELKEILRTIVENVERVNRRLEELIRDIKRRVK

SEQ ID NO: 23742 - protein, 182 aa, Artificial Sequence; identical to SEQ ID NO: 23741
  Synthetic sequence.

SEQ ID NO: 23743 - protein, 175 aa, Artificial Sequence
  Synthetic sequence.
SEVEKIVEEVKKIVEEVERLHRKLLEDLRRVVEEVEDRSRRINEEAKKIVEDLKRRGNEDEDTVRKILEDAERVLDRLRKEHERLLRELEEVLRRLHEESKKIIRRLDRVLEEVRRAGVDEEVLKEIEDRLERLRRRAEEVNDTARKIVREVEESLKRSVESLKKLVDELRETLR

SEQ ID NO: 23744 - protein, 175 aa, Artificial Sequence; identical to SEQ ID NO: 23743
  Synthetic sequence.

SEQ ID NO: 23745 - protein, 175 aa, Artificial Sequence
  Synthetic sequence.
DEVERLLEEAKKIVEEMKRLHEEILREVEEIVRELDEKHDKLLRDAEEIVKELKKEGNEDKRTVEEILRRLEKVLKELREEIEKINREIKKVVEEARKKSEDIIRRADKVLEDLDRAGVREEMRRRLEKLVRDLREKSREVNERIDKLLEELHEKSERVKKTIDDLVEEVKDTLT

SEQ ID NO: 23746 - protein, 175 aa, Artificial Sequence; identical to SEQ ID NO: 23745
  Synthetic sequence.

SEQ ID NO: 23747 - protein, 175 aa, Artificial Sequence
  Synthetic sequence.
KEVEDILREVKKIVDELLRRHRELLERARRIIKRLKEEHDRLLKELEEIVRDLTRKGNEDEDTVREISKRAKEVIERLETESRKLIRTIDEVLKELHKESRKIIKELEEVVKRVREAGVSEEILRRIEELLKRLRDDAKRVNDELKRLVEELRKRSKEVNDELRRLLKELEDRLR

SEQ ID NO: 23748 - protein, 175 aa, Artificial Sequence; identical to SEQ ID NO: 23747
  Synthetic sequence.

SEQ ID NO: 23749 - protein, 175 aa, Artificial Sequence
  Synthetic sequence.
SEVEEILKEVERRVDELTRRHEELLRKADEIVKDIRRKLEEINKRLKDIADDVRRKGNEDERTVRELLEELREAVKRARELHKRLLEEVKEVLERLREESKKIIEELRRVLEKVRRAGVDEEILRRIETLLEELERRSKRVNDELEKLVRELKEELERSKRSIDEILKKVSKDLK

SEQ ID NO: 23750 - protein, 175 aa, Artificial Sequence; identical to SEQ ID NO: 23749
  Synthetic sequence.

SEQ ID NO: 23751 - protein, 175 aa, Artificial Sequence
  Synthetic sequence.
DEVERLLEDLREKVKRLVKKHEDILREVEKEVRRILRTSEEINREAEEIIRELDKRGNEDEETVRRILRTIEEVLKELEKRHRDLLKELEEVAKRVKEKSDELIKTIDRVIEKLRRDGVDEDVLRDVDRLLRELREKSKEVNKRIKELLDKLKTDLERSKEHLERLVKTLKDKLR

SEQ ID NO: 23752 - protein, 175 aa, Artificial Sequence; identical to SEQ ID NO: 23751
  Synthetic sequence.

SEQ ID NO: 23753 - protein, 175 aa, Artificial Sequence
  Synthetic sequence.
DEVEDLVRKLKKRVDDLLAEHKRLLDEAEKIVREVLKKSRESNERNKKVSKEVRERGNEDKDTVKRLTDELEKVMRDNKETHDRLARELEEAVKRLKEESEKIKRDLDRVLEKIRRDGVSEEVLKTLDRLVEELRKASEDVNRELDKLLKDLEKKLRDSIRHLEENHKDVRRALE

SEQ ID NO: 23754 - protein, 175 aa, Artificial Sequence; identical to SEQ ID NO: 23753
  Synthetic sequence.

SEQ ID NO: 23755 - protein, 178 aa, Artificial Sequence
  Synthetic sequence.
DEVEKVLKEIRKRVEDSLRHLEKVNKEAREIVEKVREELRESNERLREIVKTIRDRLEKLKGNDEMLKRLKDELDEALRRHREILDRLRRELDKVRRRLEELHRENKEDNRRVLKKAEEDGVEEDVRRTVEELVRRSEKAIEDSRRSIEDLVRRLKEDIERSLRSVEKLVEELTEAIR

SEQ ID NO: 23756 - protein, 178 aa, Artificial Sequence; identical to SEQ ID NO: 23755
  Synthetic sequence.

SEQ ID NO: 23757 - protein, 178 aa, Artificial Sequence
  Synthetic sequence.
SEVEKVLEELRRIVTKSARHLDESNERLKEIIRRLDEKNKEALKRAEDIIRDIDDKLKKLKGDKRVLDELARRIEEVLRRLRRIVEESRKELDEALKEHDRALRENERENREALRDAEEKGVDKKVKDEVKKLIDDSREKIKRSRESVKRLVEEHRRRSEEVRKTLEKLAREITERIR

SEQ ID NO: 23758 - protein, 178 aa, Artificial Sequence; identical to SEQ ID NO: 23757
  Synthetic sequence.

SEQ ID NO: 23759 - protein, 177 aa, Artificial Sequence
  Synthetic sequence.
DELEEVADEVRKIIEDLERRLREVVKTSEKLNKENRRRTEDVEKEVEKILRELEEKLRGDEKVRKIIEDLRRELKKAKDESEKSNREIRETTRRLEEEVKKIEDELRKILEEAKDIRADEDIRKVLKELREIIKEVEDMLKEVLDRNRKLIEDNLRRLKEVLDRLRKKVREIEEEAR

SEQ ID NO: 23760 - protein, 177 aa, Artificial Sequence; identical to SEQ ID NO: 23759
  Synthetic sequence.

SEQ ID NO: 23761 - protein, 177 aa, Artificial Sequence
  Synthetic sequence.
SEIEEAEERVRRLIERNKRETDRVAEEVKRINDENRRATEKVKRDVKRILDDLRRKLEGLDEVREILDRIRRRLEKLERDSKKSNEELERRLKKAIDRSRKTDEDLKEILKKAKDLEKDKLLRDVLRDLERLVRKNLEELKRVLDELKRLMEDNLRRLEKVLEELERLVREIVERAR

SEQ ID NO: 23762 - protein, 177 aa, Artificial Sequence; identical to SEQ ID NO: 23761
  Synthetic sequence.

SEQ ID NO: 23763 - protein, 177 aa, Artificial Sequence
  Synthetic sequence.
EELERVAKKVRDINRRNKEETKRVEDEVRRLIKENEDTSREVVRRNEEILKDLERKLGGLDEVRKILKELEEETRRLLKRSEDSNRRLEELLRRAKKESEDTNKRLEEILKEAERLEKRDVVREVLERLKELVKRNLDKLKRVLDEIRRLIEENLDELRRAHEEHRRIAEDIRRKAK

SEQ ID NO: 23764 - protein, 177 aa, Artificial Sequence; identical to SEQ ID NO: 23763
  Synthetic sequence.

SEQ ID NO: 23765 - protein, 177 aa, Artificial Sequence
  Synthetic sequence.
ESLERVKEEVKKILEKNRRTSEEVARRVKELIDRNREKSKDVARKNEKILEDLERKLRGDKDVKKILDELEKRTRDLLRDSERSNEELRDLLRKLLEESKRTNDEIKKILDEMDKLRSEEEVERVLRRLRELVRENEKRLKEVLDEIRRLIRENEEKLEKAHREHKKLAEEVERRKR

SEQ ID NO: 23766 - protein, 177 aa, Artificial Sequence; identical to SEQ ID NO: 23765
  Synthetic sequence.

SEQ ID NO: 23767 - protein, 181 aa, Artificial Sequence
  Synthetic sequence.
DDVERVLKEVRELVERANEEIRKVLERDRKSNEDANRKIREVLRRVEELVDRIDKIRRELSDKKTVRETVEDILRRIEELLKELKRISDETLKRNEDSARELRERSERTLRRIEDLLRELKKRKASDEVVKKIKELLDRHRKTTEEVLERIRRSLEKHRRDSEEVMKELRRLVKELEDRTR

SEQ ID NO: 23768 - protein, 181 aa, Artificial Sequence; identical to SEQ ID NO: 23767
  Synthetic sequence.

SEQ ID NO: 23769 - protein, 181 aa, Artificial Sequence
  Synthetic sequence.
DEVRELLRTIEELVRDANRKIKEVLDRDRESNDRANKTLEEILKRDKRSNEDVEEKLKKLTDKSKVKEIVDRVRKENEDSLRKLEETSRKTLEDNKESLKELKKLSEKTRREIERLIDEARKRNVDKKVEKKIRDLLKKHEEDSRKALEDIKRSLERHRERSEEVLKRIRDSLRELDKKTK

SEQ ID NO: 23770 - protein, 181 aa, Artificial Sequence; identical to SEQ ID NO: 23769
  Synthetic sequence.

SEQ ID NO: 23771 - protein, 181 aa, Artificial Sequence
  Synthetic sequence.
DSVEEILKRVKELVDKANEKIKEVEERVRRSDEELKKILEEILREIEKLVREVEEIARRLSDKETVRERVERIEKRLRELADTIRRIVERVLRENERLLRELKKLSDKTLEDIKRLLDKADKDKVSDEVKKKIKDLLEKHERDSRKVLRKLEESSKETEDRAKEVLERIEKLLEDLRRETK

SEQ ID NO: 23772 - protein, 181 aa, Artificial Sequence; identical to SEQ ID NO: 23771
  Synthetic sequence.

SEQ ID NO: 23773 - protein, 178 aa, Artificial Sequence
  Synthetic sequence.
KDAEELLKRVRDLLKRSLESLEKILRDSKELADRWRKKLEDLLRESEELVDRAEKILRRGDNDKRVLDKIAEEVRRTNDDSRRLDEELHRLSRDTLRKLEENLRRTEKEVREMDKRAAERGVDERVREELKKLLTRVEEEHRKVLETDKKLLKELHKESKEVNDRDRELLERLEESVR

SEQ ID NO: 23774 - protein, 178 aa, Artificial Sequence; identical to SEQ ID NO: 23773
  Synthetic sequence.

SEQ ID NO: 23775 - protein, 178 aa, Artificial Sequence
  Synthetic sequence.
KDAERLLRELKKLLEESLKSLKELTDRIRDEVRRVKKRLRDLLRESEELVKRAEDILRRGDNDKRVLDELRKEVERTNRKSEDILREAKELIEKVERELERNLEETEKLIKRIREEMKRRGVREEVEETAKKLLDEVRRAHEEVLKEIRELLRDLERTVREVNEEDKKLLRKLEEDVR

SEQ ID NO: 23776 - protein, 178 aa, Artificial Sequence; identical to SEQ ID NO: 23775
  Synthetic sequence.

SEQ ID NO: 23777 - protein, 174 aa, Artificial Sequence
  Synthetic sequence.
SEAEKVRKDLKDIADDLHRVSERVLREDERLLKRLHDVSRDVRERDREIVEDLRRGGISKTLLKEVERLSEESKRKLDKLNEEVRRLSEESRKRLKDLNDELREIVRRVKETVDSGDDREEVLDRARKEVDEIKKKHKKVLDESRKLVAEAERKHEEILKESEDLAREIKERER

SEQ ID NO: 23778 - protein, 174 aa, Artificial Sequence; identical to SEQ ID NO: 23777
  Synthetic sequence.

SEQ ID NO: 23779 - protein, 174 aa, Artificial Sequence
  Synthetic sequence.
SRAEKVREDLDRIEEDLRRVHREVLKEVERILKELHDTSKRVRDEVEKIVRDLRRAGIPKDLLKRAEDLIKEIKDKLDRLNERAEEIFRDIRRYIEENEERSKRLVDEVRKRVDDGDDREKVLEDARKLVRESKENIRRVLEDLKRIVKKLKEDHKRILDELKKLVDKIKEDAR

SEQ ID NO: 23780 - protein, 174 aa, Artificial Sequence; identical to SEQ ID NO: 23779
  Synthetic sequence.

SEQ ID NO: 23781 - protein, 174 aa, Artificial Sequence
  Synthetic sequence.
SRAERVREEIDKILEDLHRVSERIKRELTKLMEDLERTHERIKKAIREILADLRRRGVPKSLLKKAEDLVKRVEDYVRKNLEDSRDDIRKVREEVEELNKRAEDLVREVKKIVDSGDDREEVLKEAKKLVDDLKEKHKEVLTRVERLVEESKKNLKRVLDELRDLVRRVKEEAK

SEQ ID NO: 23782 - protein, 174 aa, Artificial Sequence; identical to SEQ ID NO: 23781
  Synthetic sequence.

SEQ ID NO: 23783 - protein, 174 aa, Artificial Sequence
  Synthetic sequence.
SEAERVREELDKIVEDLHRTSEDVKRRDEELLKDLERRHKEVKEEDEKILKDLRDSGIPKDLLREITKLSRDSKKYLEENLRRSRKLSRDSKEKLEELNRRARDVIRRVRETVDSGDDRERVLEELRKTVTEMKKRHRDILRESEELARESKENVDRVLEESRRRAEEIKRRAK

SEQ ID NO: 23784 - protein, 174 aa, Artificial Sequence; identical to SEQ ID NO: 23783
  Synthetic sequence.

SEQ ID NO: 23785 - protein, 174 aa, Artificial Sequence
  Synthetic sequence.
DERERVKEELDKLLRDLERVHDKVREDDKRLLDDLRRVHEKARRDDKRILDELKRAGIPEDLLREVEKLSRESKRYLDENLRRSEELSERSRKYLDDNLERSRRLMEDVKRKVESGDDREEVLERAKELVKRSKENVERVLRDSERLAKESKENVRRVLEESKRRVEEIEERAR

SEQ ID NO: 23786 - protein, 174 aa, Artificial Sequence; identical to SEQ ID NO: 23785
  Synthetic sequence.

SEQ ID NO: 23787 - protein, 174 aa, Artificial Sequence
  Synthetic sequence.
SEAERVREELKRILEDLERVHREVEEAIERIVEELEDVHRRARERVERILRELERRGIPKDLLERARKLIEDIKRYLDENLKESRRLAEDVKRKIRENLKRSREIVERVIRIVDSGDDREEVLKEIEKMVKESRDTVRRILEELRELVERSKRNVEKVLRDLERAVEKIERDAK

SEQ ID NO: 23788 - protein, 174 aa, Artificial Sequence; identical to SEQ ID NO: 23787
  Synthetic sequence.

SEQ ID NO: 23789 - protein, 174 aa, Artificial Sequence
  Synthetic sequence.
KEAEDARRRVDEILEELRKLHDEVRKTDKELLDDLEREHERVKREDDKILDTLRRQGIPKSLLEEIKRLSEDSKRYLEENRKESRRLSEESKRKLDENLERSERLAKEIRERIDSGDDREKVLEDLERLVETSRKTVRDILEESKELVKRSKENVRRVLERSKELVKRVSERAK

SEQ ID NO: 23790 - protein, 174 aa, Artificial Sequence; identical to SEQ ID NO: 23789
  Synthetic sequence.

SEQ ID NO: 23791 - protein, 184 aa, Artificial Sequence
  Synthetic sequence.
SDVDEARKTVKKILDESEETLERVRRELERILRDSERTLKRVEERVRRILRDLERELRKLPEDDKLKELERRVREATKDVERMLDEDRKRNDKARRELKKVLDENRRKNKKVMDDAEKILRETTDREEIDKVLKEIRERVERSKKHLEDVLDRLRKIIEESKRHVEKVLEKLEKIVKELKDELK

SEQ ID NO: 23792 - protein, 184 aa, Artificial Sequence; identical to SEQ ID NO: 23791
  Synthetic sequence.

SEQ ID NO: 23793 - protein, 184 aa, Artificial Sequence
  Synthetic sequence.
KDIEEVEKRVREILEDSRRMSKKDEESTRRILEESRRVSEEDKKSTEEILKELKDELRKLPERDKLERLRREIEKVVEENRDVNRRDNRRNEEAIRENKELNKEDNDDNEKVLEDAKRILDETTDRDTIKKMLEEIKRRVDESKRHLRESNKRIRDIAEESKKHLEDSNKKVRDRADELKKRLK

SEQ ID NO: 23794 - protein, 184 aa, Artificial Sequence; identical to SEQ ID NO: 23793
  Synthetic sequence.

SEQ ID NO: 23795 - protein, 184 aa, Artificial Sequence
  Synthetic sequence.
SDLERVKKAVEDILRDSERTLRRARERLKRLLEELRRTSEEDKKSTDEILERLKRELEKLPPDRKLERLDDLIRRLVKRNKEINDRVNEVVERMMREAEDRLRRDKERNDRVVREAEEIIRRVTDRDELRKLLEEIRRRAEESKRHIEEVLKRLEEIVKRLKEELKRSNDEIREIVRRLEEELK

SEQ ID NO: 23796 - protein, 184 aa, Artificial Sequence; identical to SEQ ID NO: 23795
  Synthetic sequence.

SEQ ID NO: 23797 - protein, 180 aa, Artificial Sequence
  Synthetic sequence.
STLEEMEKEVEKLNRDSRRTLREVAERVEELNRDNERTSKRVEDAVRELNKRLRDEVRRREVEKVIKESRDSLERLKERSKRSNEESKRTLDELKKKVEDVNKRSKESLDRLREAVKNKAPEEELRKVLKENEELARELKKELERALEENRRLHEENKEDLRRVLEENERLHRKLRKDAK

SEQ ID NO: 23798 - protein, 180 aa, Artificial Sequence; identical to SEQ ID NO: 23797
  Synthetic sequence.

SEQ ID NO: 23799 - protein, 180 aa, Artificial Sequence
  Synthetic sequence.
DTLERVAEAIRRLNEDLKRTLEKVERAVREILKRLAETLKRAEEEVRRLNRDLERKVRRDEVEEVIRRSRESLRRLKEEVKRALDRIKRLLDELKKRVREVNERSKRSLEDLKRLVENNASEEEIKKVLDDNKKLAEDLKRELKRVLEEIRKLVKELEDIVREVLKTNKELHERLKRRAD

SEQ ID NO: 23800 - protein, 180 aa, Artificial Sequence; identical to SEQ ID NO: 23799
  Synthetic sequence.

SEQ ID NO: 23801 - protein, 180 aa, Artificial Sequence
  Synthetic sequence.
DTLERAAEEVKKLNEDNKRTSKRVEDEVRRLNRENEEMSKRVKDTVKKILDDLRRKVDRDEVDEVLRRIEELLERLERESEKSNERSRETLRRLKRRSEESNKRLEELLRELDKLVKDNADEKEIERVLRELERIARENKKELEKVLRENRELHERNKKLLEKVLRDIKRLAKTLRDRTR

SEQ ID NO: 23802 - protein, 180 aa, Artificial Sequence; identical to SEQ ID NO: 23801
  Synthetic sequence.

SEQ ID NO: 23803 - protein, 180 aa, Artificial Sequence
  Synthetic sequence.
RELEEARERVKRLNEENKEFSRRVAEEVKKLNEENERTSKKVEDEVRKLNEDLRKKVDRRDVKRAIERSKELLKRLKEKSEESNKTSEKTLRDLERKSRESNKELKRLLEELEELVKNNADEETIKRVLEELTRIMDRNRKDLRRVLEENKKLHDENRKELKRVLDENRRLHEEVKKRAK

SEQ ID NO: 23804 - protein, 180 aa, Artificial Sequence; identical to SEQ ID NO: 23803
  Synthetic sequence.

SEQ ID NO: 23805 - protein, 180 aa, Artificial Sequence
  Synthetic sequence.
SELERVKTEVEKLNRRNREATERVKEEVKKLDEENKKSSKRVEDEVRKILDELRKKVDRDRVEKALREIEKLLEDLKRTSDKSNRESEELLKELEERSKRSNDTTKKLLEELEELVKNNADREELERMLKRLKEIIERNEERLKEVLDRIRELIERNKELLRRVLKRIRDLVKELKERAD

SEQ ID NO: 23806 - protein, 180 aa, Artificial Sequence; identical to SEQ ID NO: 23805
  Synthetic sequence.

SEQ ID NO: 23807 - protein, 180 aa, Artificial Sequence
  Synthetic sequence.
RELEEVERRVRELNEDNRRKTEEVKREVKRIDDDNRRASERAAREVKKLNKDLKDKVDDDEVDRVIEESRRLLRELEDKSKRSNDTSKRLLEELEKRSKDSNRRTKELLERLKELVDRNADEKTLEDMLRRLKEIIKRNKDELEKVLRDIKKLVDDNKRDLERVLRRNEELHRELLERAR

SEQ ID NO: 23808 - protein, 180 aa, Artificial Sequence; identical to SEQ ID NO: 23807
  Synthetic sequence.

SEQ ID NO: 23809 - protein, 180 aa, Artificial Sequence
  Synthetic sequence.
DELERAKEEIERLNDELKKSLEEVEKEVEKLDDDNRRTSRRVSEEVKRLNKELEDEVRRDDVERAIRESEELLRRLEESSERSNEESRRLLKELAKTVREVSKTSKKSLEELEKLVRDNADRDTIRKVLKENEDLIRKLEEILKKVLDEIRRLIEDNKRELEDMLRKNKELHDRLRERAR

SEQ ID NO: 23810 - protein, 180 aa, Artificial Sequence; identical to SEQ ID NO: 23809
  Synthetic sequence.

SEQ ID NO: 23811 - protein, 180 aa, Artificial Sequence
  Synthetic sequence.
SELEEVKKEVEKLDERNKRLSKRVEEEVRKLNEENKRATERIKREVEKILEDLRRKVRRDDVDRVLDTIRRLLKRIEEESRKSNKETRKLLEELKEDSKRSNEETKKLLEDLEKLVKDKADREELKRMLDRLRRIIEENERKLKEVLDRLRDIIRKNKEDLKRALERIKKLVEDLKRRAT

SEQ ID NO: 23812 - protein, 180 aa, Artificial Sequence; identical to SEQ ID NO: 23811
  Synthetic sequence.

SEQ ID NO: 23813 - protein, 185 aa, Artificial Sequence
  Synthetic sequence.
SDLERVLDEIRRLAKEVKDTLRRMLEKNEELSKRDEDKTREMLKEIERLVKELEEIADKLSDEKTVREIVRRIEEDIKRLLEEVKEKNERSIRKSKKTLDDAKRIVDKILEEIRRLLEELRKRVKDDDRLRKAEEEIKEIERDLKRTLDEVAKEVKRTIDRNRETSKRAAREVEKLLEKLREKTR

SEQ ID NO: 23814 - protein, 185 aa, Artificial Sequence; identical to SEQ ID NO: 23813
  Synthetic sequence.

SEQ ID NO: 23815 - protein, 185 aa, Artificial Sequence
  Synthetic sequence.
SDLERMLREIRKLVEDDKRRTREMLRDNERLSREDKKKTDDVLRRLEELVRRLEEILKKLKDKDTVRKIVKEIIEELEKILKELEDTNRKSIEDSRRTLREVREINKDSIKKLEDLLKEVAERVDDDKRLDDIRRAIEEIIRDLRRASKKASEDVERTIERNERTSEEAKRRIEELIERLRRTDK

SEQ ID NO: 23816 - protein, 185 aa, Artificial Sequence; identical to SEQ ID NO: 23815
  Synthetic sequence.

SEQ ID NO: 23817 - protein, 185 aa, Artificial Sequence
  Synthetic sequence.
SDLEEALKRVEKLVRDDKEKTKRMLERNRELVKRNKEKNKRMLDEIRRLVEELEDILRRDKDRDTVRRIVEDIKRRIKKLLDDIRETNERSIRESEETLKRVEDLNRESLRTIEELLREIKERVEDDKRLKEVEDAVREILKDLKRTSERAKEEIERTIRDNERVVRRLEEEARKILEDLERRDK

SEQ ID NO: 23818 - protein, 185 aa, Artificial Sequence; identical to SEQ ID NO: 23817
  Synthetic sequence.

SEQ ID NO: 23819 - protein, 182 aa, Artificial Sequence
  Synthetic sequence.
SRIEELLKTVEKLVDEVKKALRKLLEENKDLARKSKESLERLLDEVRDLVRRLEEILDRGDNDERVLREIEKRVKDAKDRVRDNLREVHRLDEESKRRLEDLLRRVKELAEDVKKKLKDDVDDKDKLERVMRTLDEILKDLERTVERVKRALDESNRDLRREHERIKKELDKILDRLREKAR

SEQ ID NO: 23820 - protein, 182 aa, Artificial Sequence; identical to SEQ ID NO: 23819
  Synthetic sequence.

SEQ ID NO: 23821 - protein, 178 aa, Artificial Sequence
  Synthetic sequence.
SEVERLKEELDKLHKENREVLEDSKRSLDKILDDVRKLAEDVKKRLDDILKELRDRGVPEEALKEAEKVITDLKRRIDELLDRVRKIVEELKRRHDRLLEEHKRIIDDIKDKLEKNKTDRDLLRRLLREAERVSEETKKESKKLNDEIRKVLERLRDELRKIEDEIRKVVRRIRERAN

SEQ ID NO: 23822 - protein, 178 aa, Artificial Sequence; identical to SEQ ID NO: 23821
  Synthetic sequence.

SEQ ID NO: 23823 - protein, 178 aa, Artificial Sequence
  Synthetic sequence.
DEVETLKKRLDKLHEDNKRDLERSKRSLEELLKELEEVVRRSEKTLDELLKKVEDQGAPRELLEELKRIMDELKRKHRELLKRAKEMLEEVKRRHDRLLEEHKEIVERIKREVERNKDDRKLLKELEDTIRKVSDDTRRKSEELNEELKTVAEEIKKRSRELNEEAKDVLEKVERRTT

SEQ ID NO: 23824 - protein, 178 aa, Artificial Sequence; identical to SEQ ID NO: 23823
  Synthetic sequence.

SEQ ID NO: 23825 - protein, 178 aa, Artificial Sequence
  Synthetic sequence.
DEVERAKEKLDKILEDLRDVVRRSKENLDRLHEENRETLERSKKNLDRLLEKVKKDGVPEELLKELERIIRDLKRKHRKLLEDHRKIIEELKREHDRLLKEAEEIVRRIKDELEKRKDDRRDIERILRELEKVLKKLTDESERLNREVERVSRDTKKKSKELNEELKRVLDEVKRKAD

SEQ ID NO: 23826 - protein, 178 aa, Artificial Sequence; identical to SEQ ID NO: 23825
  Synthetic sequence.

SEQ ID NO: 23827 - protein, 182 aa, Artificial Sequence
  Synthetic sequence.
DEVREVLRELKKVVDDSKRDLDRVLREAERVVKESKDDIKRLLEETERVARDVERKIRENKGNKEVVDRIRKEVKEVHERSERILKRNEEKNRTVLKKAEDMIERNLRENKKVADKIKRVVEELKIDETLDKEVKRLLKESKRAADELRERIKRLIEESKRLLDTVRREDKKILEKIERDLK

SEQ ID NO: 23828 - protein, 182 aa, Artificial Sequence; identical to SEQ ID NO: 23827
  Synthetic sequence.

SEQ ID NO: 23829 - protein, 183 aa, Artificial Sequence
  Synthetic sequence.
DEIEKILEDLRRISEDTKRKHEEILRELEEILRELEERHRRILREVEEVARRLEERLNEDKRVVEELKKEAEEAIDEVRKRSRRINEELKRVLEEVRRKSEELNKRTEKVVRDVKRKIEETVTDEEKVKEVEREIRRLLKENEDASREVERLIEELKRRLDKISEDVERVLKKILERIDRATK

SEQ ID NO: 23830 - protein, 183 aa, Artificial Sequence; identical to SEQ ID NO: 23829
  Synthetic sequence.

SEQ ID NO: 23831 - protein, 177 aa, Artificial Sequence
  Synthetic sequence.
RSVEEAEKVLEELKRRNERLNEEHRREVEKVREKNERLNKRHREDVERIKRELDKEPVPEEVKRKLEEAIKKLERIDEESEEETKRVIDRLREMDEDTRRKTEKAIRELRKFLEDTTDDETIKDVLRKIKKISDETRKTLEDTLRELREISEKTRRRLDESLKELEEILRRLKEETR

SEQ ID NO: 23832 - protein, 177 aa, Artificial Sequence; identical to SEQ ID NO: 23831
  Synthetic sequence.

SEQ ID NO: 23833 - protein, 177 aa, Artificial Sequence
  Synthetic sequence.
REAEEIRKEVEKLLRDLKRALDEHRETSRRLVEELKDILRKNREEVERLVREIREVIKRVKDREVVEEVKKRLEDLVRDIEKVLRDTERIIEKLKEDSEDVLRRLDKIAKDIERDVERREPTRELIEEITRIVEKAKKELREVSKRLREIVKKIKEDNDRSNKRLREIAKEIKDRLT

SEQ ID NO: 23834 - protein, 177 aa, Artificial Sequence; identical to SEQ ID NO: 23833
  Synthetic sequence.

SEQ ID NO: 23835 - protein, 177 aa, Artificial Sequence
  Synthetic sequence.
SEREEARERVKDLSRKLKEINERSEKHLRDLAKENRDANRRTREEVERLLDKIRKVIKDVKDREVVEKVRELVERLREEVERVNEKSERILREVEKRVRDVLDETRKIVRKMEEEVERREPTEELIRELEKIVRDAEKKNRDVNREVRKILEDSKRELEKVLRDLERKVREIEKELK

SEQ ID NO: 23836 - protein, 177 aa, Artificial Sequence; identical to SEQ ID NO: 23835
  Synthetic sequence.

SEQ ID NO: 23837 - protein, 178 aa, Artificial Sequence
  Synthetic sequence.
RELEEVLKKLKEDAERLKRILEEATRELEKILERLHRLNEKSTEELRRIVKDLKEELKRRGRDEEVDKKVKDIIRELEKKSTKNLEDSRRIAEELRKTSRETVERVRKDLEELRKRVEELTRSEEVEKTVRKLEEDLKRAIEKHEEDSRRLVKRLKESNDEHEKESRRLVRELEKEIE

SEQ ID NO: 23838 - protein, 178 aa, Artificial Sequence; identical to SEQ ID NO: 23837
  Synthetic sequence.

SEQ ID NO: 23839 - protein, 185 aa, Artificial Sequence
  Synthetic sequence.
DEVREVIKTVRKLLEDLHRTNREVIERVKRTSEETHRKNEDMLRRLRKLVEDLKETLDRLEDKDTLRRIAEEIEKRIRKLLEEAEKINREALEEHKDLLRKLEEENKRILEELKRLLDKLRKDVEDEKSLRDAEREVKKLLEELKRSLDKLREDVERLLRENKESLDRLREEVKKIERELREKTR

SEQ ID NO: 23840 - protein, 185 aa, Artificial Sequence; identical to SEQ ID NO: 23839
  Synthetic sequence.

SEQ ID NO: 23841 - protein, 185 aa, Artificial Sequence
  Synthetic sequence.
SDVDRVLEELRKLVEELHRRNRKIIEDLRRASEKTHRKNRDLLEKAKKLADELREIAERLEDREKLREIAREILERLKKLLEDVAKTNTDALREHEEALRRLKEENDDIKEKIKRLVDRVRERIKDKDELRRLEEAAKKILDDLEDSLRKLEEAVKDLKRKNKKSLDDLAEAAKDILRRLAETAR

SEQ ID NO: 23842 - protein, 185 aa, Artificial Sequence; identical to SEQ ID NO: 23841
  Synthetic sequence.

SEQ ID NO: 23843 - protein, 185 aa, Artificial Sequence
  Synthetic sequence.
DEAEEVIKTVKRLLDELHRRNEEAIKEDRRLVEELHRTNEKVLREVEELVKRLAEILRRLKDKDTVRKIVEDIKRELDRLLDELRKTNEEIRKRSDDLNRKINRENEEILRRLDDLLRDLEAKIRDKETLDRLRERAEELKRRLEKSLRDLNRDNERTKRELRESLRKLEETARRLKEEIDRRTK

SEQ ID NO: 23844 - protein, 185 aa, Artificial Sequence; identical to SEQ ID NO: 23843
  Synthetic sequence.

SEQ ID NO: 23845 - protein, 184 aa, Artificial Sequence
  Synthetic sequence.
DEADDLIRRVRELVKRVKEALEDLLRRNKDVLRKVKEELEKITRRNRDKVRRVEEELKRIKDRETLRRLVEKVKRELDESHKEVERLIEKVNEISKKTLRDVEKLVTEVKKRLDDIKDELDKRVKSRKLEELRKEVEKLKEELDRVLEEARKEVEKSNRELKEVLERHAEDNERIKRRLDEARR

SEQ ID NO: 23846 - protein, 184 aa, Artificial Sequence; identical to SEQ ID NO: 23845
  Synthetic sequence.

SEQ ID NO: 23847 - protein, 185 aa, Artificial Sequence
  Synthetic sequence.
SELERLLDEVDRIVREIEERLRDILRKNRELSEDSERKLRELLREVRDLVRRIMDELRRTKERDVIEEVVRRIRELLKRIEDRLRKIADDSHKLDEESVRRLEDIARRIKKRVDEILEEVKRSGVPREKLEEARRRIDEIRRRLEELLKRAREDSDRSNKRNKDLLREIEEELKKLKRELDEETR

SEQ ID NO: 23848 - protein, 185 aa, Artificial Sequence; identical to SEQ ID NO: 23847
  Synthetic sequence.

SEQ ID NO: 23849 - protein, 181 aa, Artificial Sequence
  Synthetic sequence.
SLKEKVKKVIEDLKRAIDDLLRKVREESKKSNDHIRKLLEDSERTLRDLARRIKKLKDDGDLDERLLKEAKELLEELKRRSEEIIKEVEKLNEESDRVIDKLLEDLARLLKRIDDRIEKITDARLIKEVIEEAERLLREIAKRIRKVIEEDRDLNRRIAKKLDELNRRAEELLKRIADRAK

SEQ ID NO: 23850 - protein, 181 aa, Artificial Sequence; identical to SEQ ID NO: 23849
  Synthetic sequence.

SEQ ID NO: 23851 - protein, 181 aa, Artificial Sequence
  Synthetic sequence.
SSKETVKDVLRKITKRIRDLVRESKKTSDESNKHIKELLERSKKTIDELERRIEDLRRRGDLDDDLLREAKELLERIERESRRVFKEAEELNKRSDDETRRIVKEAEDLIRTVEERLKRIEDEELLRRLIKELEDLMREIERKLRELNERDKRLNEEIAKKLEKLNRDARKLVEEIERRAR

SEQ ID NO: 23852 - protein, 181 aa, Artificial Sequence; identical to SEQ ID NO: 23851
  Synthetic sequence.

SEQ ID NO: 23853 - protein, 181 aa, Artificial Sequence
  Synthetic sequence.
KLREDLEEMLRRSEKHIRDLVKRSEETSRDSNRHIEKLLKDSRKTIEDLKRKIEDLARKGKLDEKLLEEVRRLLEEIRKRSEKVIEDARRLNKRSDEETKRIVREADELNKEVKDRADRIRKRELLERLIRELKRLNEEIAKKLEDLNREDRRLNEEIAKRLRDLNEELKKLVEDIERRAR

SEQ ID NO: 23854 - protein, 181 aa, Artificial Sequence; identical to SEQ ID NO: 23853
  Synthetic sequence.

SEQ ID NO: 23855 - protein, 181 aa, Artificial Sequence
  Synthetic sequence.
RSKEEVDKMLERLRERIEKLVEESRKTSKESNEHLEKLFRESEETIKELKKRIEDLRRKGLLSDELLEEVKRLLDRIREESKKVLDEARRLNEESNRKTEEIVKEVRKLLEEVKRRADEIRDEDLLEKLIRELEELIRRIEKKLRDLNREDRELNKRIADEIERLNREARRLIEEIRKRAE

SEQ ID NO: 23856 - protein, 181 aa, Artificial Sequence; identical to SEQ ID NO: 23855
  Synthetic sequence.

SEQ ID NO: 23857 - protein, 181 aa, Artificial Sequence
  Synthetic sequence.
SLEEEVRREIERSRRHIEKLVRDSERTSKESNKHIKKLLDESKRTLDEIRKRIEDLARKGKLDEDLLKEARDLIREIEKKSRDVIREAKKLNEESNKRTEDIVREARELNERVKRRVDEIREREVLKELIRELRRLNEEIRKKLEKLNDEDRRLNEEIRRKLEEINEELRRLVREIEERAR

SEQ ID NO: 23858 - protein, 181 aa, Artificial Sequence; identical to SEQ ID NO: 23857
  Synthetic sequence.

SEQ ID NO: 23859 - protein, 181 aa, Artificial Sequence
  Synthetic sequence.
SLEETVEEVLRRLRRKIEKLVTESEETIRRSKKHIEEVLEKSKRTLDKIKEDIDRLRKEGTLSDEILTELDKLIKDVEKKSKELIDEARKLLEDTKRETDRIRREVEELLRRLEKEVKRIREREVLKELIDRARELIERIARKLTELNKENRKLNEEIARRVEELNKELKRLLKEIEDRAR

SEQ ID NO: 23860 - protein, 181 aa, Artificial Sequence; identical to SEQ ID NO: 23859
  Synthetic sequence.

SEQ ID NO: 23861 - protein, 181 aa, Artificial Sequence
  Synthetic sequence.
STKETVARELERSRKHLEDSFREAERAIKESEEHIRELLERSRRTLKEIEDRIRDLRRRGDLDDRLLEEVKELIDRVRKRSEDIFRRAEELLRRTRERVKRSLDRARKLNDDVERRMREITDERLLRELIEELRRLNRKIHEDNRRLIEDNKRLNEEIKRELDKLNRELERETEEIKKRAD

SEQ ID NO: 23862 - protein, 181 aa, Artificial Sequence; identical to SEQ ID NO: 23861
  Synthetic sequence.

SEQ ID NO: 23863 - protein, 178 aa, Artificial Sequence
  Synthetic sequence.
SVRETLREVLKESKKHLDDLVRRVKEEIERSKKHIDDLIRRNKESLDDIRRTVEEKIKGREILRKIEEALKRNEDELRRIATEAEKVHRDVEKTIREIVKELRDVHREIEDAIRKKQDDSDLVRELIKRLKEINDRVAERIKDIIRKVREANKDLERKLRELNKRSRDVLEEVVRAEE

SEQ ID NO: 23864 - protein, 178 aa, Artificial Sequence; identical to SEQ ID NO: 23863
  Synthetic sequence.

SEQ ID NO: 23865 - protein, 178 aa, Artificial Sequence
  Synthetic sequence.
SAAEEAEKASKDSEKHIKDLIRRLREVSEESRRHLRRLIEENKRSLEEIEKEVRKKVKGEEIRREIEEALRRNEDKLKKIEDEMEEVNKKSEEDVRRLEKEVKDVNDRSSDTIRDNKDDTELIKRIIDRNREINRRVAEAIKKIIKDNRDINEDLERKLRKLNEESKRVLDDVVRREK

SEQ ID NO: 23866 - protein, 178 aa, Artificial Sequence; identical to SEQ ID NO: 23865
  Synthetic sequence.

SEQ ID NO: 23867 - protein, 178 aa, Artificial Sequence
  Synthetic sequence.
SVEERLKDELRKSEEHLRRLIRELEKALEDSKRHADRLIKENRDSLRRIEDKARKKIRGDEILDTIRKALKDNRDELEKILREVEEVDKESKRRLEEILRTMREVNEESKDRLRKKDKDDETVKRIIEENRRINEDLARKIKEIIRDNKRFNEEVEEKLKRLNDTSEEILRRLVRRDE

SEQ ID NO: 23868 - protein, 178 aa, Artificial Sequence; identical to SEQ ID NO: 23867
  Synthetic sequence.

SEQ ID NO: 23869 - protein, 178 aa, Artificial Sequence
  Synthetic sequence.
SVDKELEEVIRRSKDHLEKLIKEAEDALKRSEEHLRKLIEEVKRRLEEVEKRVREKVRGEEILREIEKVLKEVEESLERILKELEDVNRRSREELKRILREMERVDEETKRELDRRTDDSELIKRLIKENKEINEKLAREIEEIIKENKRINDELKKRLEELIERLERILEEVERRER

SEQ ID NO: 23870 - protein, 178 aa, Artificial Sequence; identical to SEQ ID NO: 23869
  Synthetic sequence.

SEQ ID NO: 23871 - protein, 178 aa, Artificial Sequence
  Synthetic sequence.
SVDRTLEEVIKDSRRHVKELIDRLEKVIKESEENVKRTVDDNERSLKEIADTVRREIKGREILEEIKRVLDDNRRAVEELEKEAREVHRDVREKLKRILEELKRADDETERRLRERTDDSEDIKRLIDTNRKINRDVAETIKEIIKEVRKINKEIDDKARELNKESRRVLEEVVRAER

SEQ ID NO: 23872 - protein, 178 aa, Artificial Sequence; identical to SEQ ID NO: 23871
  Synthetic sequence.

SEQ ID NO: 23873 - protein, 178 aa, Artificial Sequence
  Synthetic sequence.
SVAETLRKVLKESEENVKRTVDRAEEELKKSEEHLRRLVERLKEVLEDVRRRVEEEVKGRELLREMDEVLKRIEEEIRKILRRLEEADKRSREALDKLEKDAKRVHDEVRDRLEKRTDDDERVERIIRELREVNERLDREVERLIRENREINRRLAEEIKDLIRRLREILREVVERAK

SEQ ID NO: 23874 - protein, 178 aa, Artificial Sequence; identical to SEQ ID NO: 23873
  Synthetic sequence.

SEQ ID NO: 23875 - protein, 178 aa, Artificial Sequence
  Synthetic sequence.
SIAEKVEKVLKESKENLDETIRRAEEDLKRSRDHLRKLIEENKRSLDRIKEEVDRRIKGREILKEIEEMLKRNDDRLKEILREVEEADRRSREELKRILDEAREVHKEIRRKIDERRDDSDAIEKLITDLRKINEEADRKVKEIIKRNRDINKKVEDDLRELNKESTTVLREVVERER

SEQ ID NO: 23876 - protein, 178 aa, Artificial Sequence; identical to SEQ ID NO: 23875
  Synthetic sequence.

SEQ ID NO: 23877 - protein, 178 aa, Artificial Sequence
  Synthetic sequence.
SELEKIIEDARRVLEEDERRNREVNRKLRKILEDNERLNREVNKRLREILKRLKEELKRLKGDKKAVEEVRKKVEEALRDVERVLEESRRDIERVLREVEEMLERSRKHIEDVLRELERRDLDEEAKRALDKIREDVRKILEDTKRELEDVRRRVEEILRETREELKRVEDDVKRAED

SEQ ID NO: 23878 - protein, 178 aa, Artificial Sequence; identical to SEQ ID NO: 23877
  Synthetic sequence.

SEQ ID NO: 23879 - protein, 178 aa, Artificial Sequence
  Synthetic sequence.
SELEDIIRKLDEILKRNEEENRRVIRRLRELLEEDERRNRKAIEDLERIITKLKDDVRKLKGDEKVLRELEETVEKVIRELRKILEDSRRHIEKVLREIEKILRESERNARKVVEDLRSKPLDRDAERRIREVEEEVKRILEETEEVLRDVKRRVDEILKTTEDRIREIEEEIKRTVK

SEQ ID NO: 23880 - protein, 178 aa, Artificial Sequence; identical to SEQ ID NO: 23879
  Synthetic sequence.

SEQ ID NO: 23881 - protein, 178 aa, Artificial Sequence
  Synthetic sequence.
DELRDIIRELRDILRENKKRNEDAIRKLRKILKENEKKNRDAIRELEDILEKLRKEIEDLKGDERVLREITKRVRDALERIKRILEESEDDIRRVLEEIEEILRRSKKNIDDAVRKLRSKDLDRKVEEDIKRVEEEVKKILDKTDEELKEVERRVRKILRETEEELKRVEDEVRRAKT

SEQ ID NO: 23882 - protein, 178 aa, Artificial Sequence; identical to SEQ ID NO: 23881
  Synthetic sequence.

SEQ ID NO: 23883 - protein, 177 aa, Artificial Sequence
  Synthetic sequence.
REEEKARRVMEKLKRDVDRINTRHRDILKKIEDEVRRIDEEHKTEVKKIKDRAEEIIRRIDDEKTVREARDIVRKIEEEVRRSNKTTEEVLRRAEDRVRKSNETTRRLLEKLERELREREPDKDLIREVEKILKDIEDLVRESERELREILKDIKRMVDESLKRLEDILRELEERTR

SEQ ID NO: 23884 - protein, 177 aa, Artificial Sequence; identical to SEQ ID NO: 23883
  Synthetic sequence.

SEQ ID NO: 23885 - protein, 177 aa, Artificial Sequence
  Synthetic sequence.
REEEEMRKVVKDLEDAARELDRDHETKLRRIEEEVKKLNEEHKRELERIARRIKEIIDRIEDEKVVREIRKILEEVRKRAEDSNKETEDILRDVRRRAKESNDRSREVVREARKEVREKRPDKDLIRRLEEILRRIARELEDSLRKLEKILEEIKEIVKKSLDELRRIVDELEKRVR

SEQ ID NO: 23886 - protein, 177 aa, Artificial Sequence; identical to SEQ ID NO: 23885
  Synthetic sequence.

SEQ ID NO: 23887 - protein, 177 aa, Artificial Sequence
  Synthetic sequence.
SEEEEVRRVLKRIAEEVKRLDEDHRRILEEIRKKVEKSSRDHKRELDKIKRDADEIIRRISDEKVVREIKRIVEKIEKDAEKVNRETKRILDELARRVEESNKRSEDVLRELEKEVRDKEPSKDLIKKLEEILEEIRRLLEESLRELEDILKKVHDRNARTLERLREILKEIEDRAR

SEQ ID NO: 23888 - protein, 177 aa, Artificial Sequence; identical to SEQ ID NO: 23887
  Synthetic sequence.

SEQ ID NO: 23889 - protein, 177 aa, Artificial Sequence
  Synthetic sequence.
DEKRKVDKRLKEIEETIRRLLEEHRRELDEIRKRIEEISRRHRKELEDIEREVRKIISRIDDERTVERIREELKRVKEDADEVNRKLKEILERIEKRARESDEKVKRILDEIRKKVRDREPSEDLIRDVERVMREVKRDLERSLEELRDVVRRAEEEVRATLRKLREILKKVEDETR

SEQ ID NO: 23890 - protein, 177 aa, Artificial Sequence; identical to SEQ ID NO: 23889
  Synthetic sequence.

SEQ ID NO: 23891 - protein, 177 aa, Artificial Sequence
  Synthetic sequence.
SEEETMRKVVKEIREKVRRISERHKEELERITDALRRSSKRHEDELREIEKAVREIIRRIDDDKTVKEIKKILDDARDRVKKVNDKTDDDLKKIKKDAERVNRELERELRKAEEDARRREPSDKLIRELEEILERLEREVRKSLDRLRKILEDIHRTNKDTLDRLREILKKVEDRTR

SEQ ID NO: 23892 - protein, 177 aa, Artificial Sequence; identical to SEQ ID NO: 23891
  Synthetic sequence.

SEQ ID NO: 23893 - protein, 185 aa, Artificial Sequence
  Synthetic sequence.
SEVEEVIRRLEELVDRLHKINKRAIEENERLNRELHEKNRDIIRKLKELVERLRDIKEKLSDKETLRRILEEIKTRIEDLTRRARETNEEIKRRSDKTLKDIRKINRDIKEEIKKLVREIEERITDKETADRARDEVRRIEKELDDSLRELEKRVRDSKRHLDRSLEELEKVVDEIRKELEDLAK

SEQ ID NO: 23894 - protein, 185 aa, Artificial Sequence; identical to SEQ ID NO: 23893
  Synthetic sequence.

SEQ ID NO: 23895 - protein, 185 aa, Artificial Sequence
  Synthetic sequence.
KEVEEVIKRLRELVDRLEKENRDVNEDNKRLNEELHDRNRKMIEELRRLVTELEDIRRKLKDKDTLEEIIREILKRIEDLLKRIREINKKILEESRRTLEEAKKRNEEIRREIKRLLDELRKRITDKDLLKRVEDEARKIEEKLKRIHEETKKVADDSERHLRKSLRELEKVAREIKKRLEEERK

SEQ ID NO: 23896 - protein, 185 aa, Artificial Sequence; identical to SEQ ID NO: 23895
  Synthetic sequence.

SEQ ID NO: 23897 - protein, 185 aa, Artificial Sequence
  Synthetic sequence.
DEVREIIKDLRRLLKELEERNREINDRNKKLNDTLRKELEDIKRRLEKLLRELEKIVRELSDEDTLREIVERIKKRIRDLLEEVRKRIEEIKRRSRETLKRIKEINEEIKKRIRELLEEIARRITDEEVLRRVEEEVRDIERRLDKIHEDTRDTAEKSERHLDALLRDLERVAREIEEALDRLKD

SEQ ID NO: 23898 - protein, 185 aa, Artificial Sequence; identical to SEQ ID NO: 23897
  Synthetic sequence.

SEQ ID NO: 23899 - protein, 185 aa, Artificial Sequence
  Synthetic sequence.
SEVEEVIRRLRELLRTLEEENRKMIRENERLLEELKKRNEDIERELRKLVTELAKIADKTRDKDTLEKILREIEREIDRLLDEIHKINREIIKRSRDSLREAHKRNKEIKERIEKLLRDLEARITDEKLARELREVAERIKKRLDEIDETTRRMVTESIKRLEEIDKRTTERAREIKKELRDRAT

SEQ ID NO: 23900 - protein, 185 aa, Artificial Sequence; identical to SEQ ID NO: 23899
  Synthetic sequence.

SEQ ID NO: 23901 - protein, 185 aa, Artificial Sequence
  Synthetic sequence.
SEVEDLIRRLEELLDRIRRDNERIIKELEELLRELEETNKRLIERIRKLLEDLRDTVRKLSDKDTLRKILEEIRRTIDKLLKEIHDTNKRIKDEIERLLREIHRDNERIKDEIRRLLEDIARRITDEKLMREAKEAVDRIKKRLDEINKRTEDVARRIRKRLDEIDERTKEEAKRIKEELDKEEK

SEQ ID NO: 23902 - protein, 185 aa, Artificial Sequence; identical to SEQ ID NO: 23901
  Synthetic sequence.

SEQ ID NO: 23903 - protein, 185 aa, Artificial Sequence
  Synthetic sequence.
SEVEELIERLKELLERLEELNRRVNEENRRLNEELERRIRKAIEDLKDLLRRLDDIRRRLKDKDTLRKILEKIKRDLEDLIRKLRETLRRIKEESERTLKEIAEMNKKIKDELERLVREIEERITDEKKLRELKEVVDRLKKEIKRIDEETRKEAERSKRNLEKILRDLEREAKRLKEEIDKKAR

SEQ ID NO: 23904 - protein, 185 aa, Artificial Sequence; identical to SEQ ID NO: 23903
  Synthetic sequence.

SEQ ID NO: 23905 - protein, 182 aa, Artificial Sequence
  Synthetic sequence.
DEIRDLLRRLRELNKRIADRIRKLNEENKKLNKEVADKIRKLNREAREIIKTIAEIIKSGNRDRRVIETIEKLLRDVLKRSEDLLREAEKLDKDSLDRSKKIIKEAEDLNREILERIKKAGVPKEVLDRAKEEVDRSRKHLKELLDRSRETSDRSRRHLKDLMRRSRETIRKLDEELKRLEK

SEQ ID NO: 23906 - protein, 182 aa, Artificial Sequence; identical to SEQ ID NO: 23905
  Synthetic sequence.

SEQ ID NO: 23907 - protein, 182 aa, Artificial Sequence
  Synthetic sequence.
SEIEKLIREAERIIEEIAKEIKDLNEENERLNREVDKRLTDLNRRAKELLEEVKRIIDRGDRDKRVVDEVRKRLEDLLEESKRLIKEARDLDRETLEKSERIIDRIRELLRDVLRRVEEAGVDEEKLRDARREIERLRRELEKLLEDSRRTSEESRRNLERSLDESRKTIEELIKRLDDAER

SEQ ID NO: 23908 - protein, 182 aa, Artificial Sequence; identical to SEQ ID NO: 23907
  Synthetic sequence.

SEQ ID NO: 23909 - protein, 182 aa, Artificial Sequence
  Synthetic sequence.
SEIEKLIEDAKRILEEVARRLKKINEDNDRLVRKIADELRRLIEEAKKILDEIKKIIEDGDRDDRVIREAEELLKRILERVKKVIEDARRLDEETLRRSKKLVEEVEELLKKALDDVEKAGAPEDVLREVRKVIKKLRDELEELARRSRKTSEDSRKRLDDLLKRAREVIEELKKRLEDLRR

SEQ ID NO: 23910 - protein, 182 aa, Artificial Sequence; identical to SEQ ID NO: 23909
  Synthetic sequence.

SEQ ID NO: 23911 - protein, 182 aa, Artificial Sequence
  Synthetic sequence.
KDIEKLIKDLEKLNRDIAKRIRDLNETNKKLVRDVAEEIKRLNEELKKLLEDIRRIIERGDRDRRVTETARELLERVRKESRRLFEEIRKLDEDTLRESERIIKEAKDLNEEVRERLERRGAPEEVLKRAREMVKRSKEHLDELLKRSEDTSRESKRRLEKLLKESEDTIRRLEEELKKAEK

SEQ ID NO: 23912 - protein, 182 aa, Artificial Sequence; identical to SEQ ID NO: 23911
  Synthetic sequence.

SEQ ID NO: 23913 - protein, 182 aa, Artificial Sequence
  Synthetic sequence.
KEIEELLEEIERILREIKKDLERINKENEKLNREVKKKIEDLIREVRKIIEEIRRIIERGDRDKRVFDEIRKLLEEILKRAEDLLRRARELDKKTLDESEEVIDRVRKLLERILKTVEDAGVEERKLKEVRDTIEELKKRLEKLAKESRDTSRRSRENLERLAREFREEIKRLKKELEEART

SEQ ID NO: 23914 - protein, 182 aa, Artificial Sequence; identical to SEQ ID NO: 23913
  Synthetic sequence.

SEQ ID NO: 23915 - protein, 182 aa, Artificial Sequence
  Synthetic sequence.
SEIEKLIRDAEKILEEIAELIKRLNEENKELNERVAKRIKDLNEELRRLLKEIADIIRRGDRDERVIRTAEKLIEDVLRRSERLFEEAKKLDEDTLKKSKDIIRRAEELLRKILKELEDAGVPREELEKVRKVIDKLREELKRLERESERTSEESRRNLERLLRESRKTVEEIKKRLDELRK

SEQ ID NO: 23916 - protein, 182 aa, Artificial Sequence; identical to SEQ ID NO: 23915
  Synthetic sequence.

SEQ ID NO: 23917 - protein, 182 aa, Artificial Sequence
  Synthetic sequence.
SDIERLIAELEKLNKEIEDKIRELNRENRRLNKEIDEEIERLIEEARKIIEDIREIIRRGDRDDRVIKKIRDLLEDILDKVEKLLRELEELDKRTLDESERIIDEAKKLNKEVEDELERRGVDRKKVEEARKKIEDSKRHLEELLRDSRRTVKESNDNLRRSAEKARREIKRLEEALKELRR

SEQ ID NO: 23918 - protein, 182 aa, Artificial Sequence; identical to SEQ ID NO: 23917
  Synthetic sequence.

SEQ ID NO: 23919 - protein, 181 aa, Artificial Sequence
  Synthetic sequence.
DEVEKVVRELEEVLRRNKELLEKTKKETKEALDRNRELLEDTKRKTREILERLKKVIKEGRDRREVRETVKKAEKENEEANRRSRKHVREVKERNKRMNEESRKHVDRVVRKIAEVEKRLTDEEVVKRLRDILRRVKEAAEELHRDDERELRRVEKELEELHKDDRRVVEEVKDDVRKAEK

SEQ ID NO: 23920 - protein, 181 aa, Artificial Sequence; identical to SEQ ID NO: 23919
  Synthetic sequence.

SEQ ID NO: 23921 - protein, 181 aa, Artificial Sequence
  Synthetic sequence.
SDAERVVRELRKILKEIEDTIRKSKKETKEMLDRNRELARKVKEELKEILRRLEKMKRDGKPDEEVEKLVREAKKRVEDVIEESRKHVEEVEKRNRDINDDTRRKLETVERKLREVEKRLDDERLLRELRRIVEEVKRAVEELNRDDRRTLERVKREAKKIHEDLRRVVEKLERDVEEARR

SEQ ID NO: 23922 - protein, 181 aa, Artificial Sequence; identical to SEQ ID NO: 23921
  Synthetic sequence.

SEQ ID NO: 23923 - protein, 185 aa, Artificial Sequence
  Synthetic sequence.
DEVEKLKRELDKILEDLERLHRRLEEELRRIHEENRDLSRRTKEELDRILKRIEELLRERRDKSVVDEVRELLKRAEERVRKANEDSKRLSKEVADTVREASRRSKEILDELKKRVEKAEKDLTDDEKVLEELRRILRRVEEAVRRLNERSEEVLRDVERRDEELNEDNKRRLEEVKKRVEDLLR

SEQ ID NO: 23924 - protein, 185 aa, Artificial Sequence; identical to SEQ ID NO: 23923
  Synthetic sequence.

SEQ ID NO: 23925 - protein, 185 aa, Artificial Sequence
  Synthetic sequence.
SELDELKKSLEEIHRRDREKNRKLKEDLKRILDEIRKRLEESKKRLEEILREIERLLRERKDDSVRREIKKLLEEIKERVKKVDKETEDLLREAKKEVRRLEEDDKRSLKELTDEVRDAERRLTDDEKALKELRKILEDVARANEELNRDTRRTLERVEEEVEKLNRDHKRVLEKVERDVRRLTK

SEQ ID NO: 23926 - protein, 185 aa, Artificial Sequence; identical to SEQ ID NO: 23925
  Synthetic sequence.

SEQ ID NO: 23927 - protein, 185 aa, Artificial Sequence
  Synthetic sequence.
SEVERLKEELKRILEEIKKLVDDSKKDLERIHREDKKKNEDLKKRAEEILREIRDLLTKRRDKDVRKRIRELLEKLAREVEDMSRKDKESLDELEKRARDVNRRLKELLKRAAERIRKAEEDLTDDEKLLRDLRRVLEEVKRAVDEISKDHKRMLDAVKKANEELNDDSRRVLERVDREVKKAEK

SEQ ID NO: 23928 - protein, 185 aa, Artificial Sequence; identical to SEQ ID NO: 23927
  Synthetic sequence.

SEQ ID NO: 23929 - protein, 185 aa, Artificial Sequence
  Synthetic sequence.
SELDRVREEAKRIDDENRKRSEDSVRDSERLLREIEELHRETKERSEELLKRVEEIVRDRGNDEEVTKDLKRILDELRETHKRVLEESKRLLEEARRRHEEVIRRLEESLERLKRKVDEVKKRLKGDRLLEELEKVLRESARRNERIITENRRTMKRVSEEVEKLNRDDKRRMEELEKRAREIIT

SEQ ID NO: 23930 - protein, 185 aa, Artificial Sequence; identical to SEQ ID NO: 23929
  Synthetic sequence.

SEQ ID NO: 23931 - protein, 185 aa, Artificial Sequence
  Synthetic sequence.
SELERAVEELEKLLKELEDLHRKSKEDSKDMLRRVEELHRRTKEKSKRILEEIERRITEEGRDEDVERKIREVVERARKLHEEVLKRSKDILEEIKKLHEDVERRSKKLLDDLRKRVEDVKRRLTGDELMRKLEEILKRVAEAIKRLIDDDRRVLKRVAEEVKKLNEDDKRVADEVSERIKERLT

SEQ ID NO: 23932 - protein, 185 aa, Artificial Sequence; identical to SEQ ID NO: 23931
  Synthetic sequence.

SEQ ID NO: 23933 - protein, 185 aa, Artificial Sequence
  Synthetic sequence.
DELEEAEERLREIDKRNEDLHEESRKESKRLLDELRKLVEDVKRELEKILEEAKDIVRKRGKDKDVEKTLEDILREVETRVKEVIKDIERILKEIRETHRRVIERSKRSLEAVKDLVRRVEKDLTGKEKLEKLRDVLRESERRNRELIEEDKEVMRRVSEEVKKLIDDLRRALEKAARDVEKIRR

SEQ ID NO: 23934 - protein, 185 aa, Artificial Sequence; identical to SEQ ID NO: 23933
  Synthetic sequence.

SEQ ID NO: 23935 - protein, 185 aa, Artificial Sequence
  Synthetic sequence.
SELEDAERRAEEIDRRNKRTVERVEEELEKILREVEELHRRTEEKSKRILDEIRRKIRDRGKDEDVKREIREMVERAKKLHKDVIDESRKILEDIRRKVEKVIRDLERSLEELKKEVKEVEDRLKGKELADKLRDVLRRSAEENKKIIDRLRKILEDVARAVEELIKRDKRVMEEVKKEIDKLLT

SEQ ID NO: 23936 - protein, 185 aa, Artificial Sequence; identical to SEQ ID NO: 23935
  Synthetic sequence.

SEQ ID NO: 23937 - protein, 184 aa, Artificial Sequence
  Synthetic sequence.
SEVEEIKKRARKLLEEVREIVDRVKKLHERLLREIEKTNREAKREHKRVLDTIRDIFRRIDSEDVKRILRELEERLDKTTKDLEEINRRALEKVDETSKRVKRELERILEELDRLAKDIKAKLDEAETVADLDREIRRLKDELRRILEDLRRVSEEVKKELEKLTRDTRRVSKEVKDELKKVEK

SEQ ID NO: 23938 - protein, 184 aa, Artificial Sequence; identical to SEQ ID NO: 23937
  Synthetic sequence.

SEQ ID NO: 23939 - protein, 184 aa, Artificial Sequence
  Synthetic sequence.
REVDEIKKRLTEMLETVRKIVEEIRRELEKLLEDVREINERVKEEHERILKDIRDVARKIDSEDARKILTDALRDLDRTTRDLERKNREILKRLDDLVKEIRRRLTEILDRARKLVEDIERKLDDGETMEDLKRRVREVEKRLEEILRRLDDVVRKIKEELKKLTDDTRRVSKRVKDDLERTRT

SEQ ID NO: 23940 - protein, 184 aa, Artificial Sequence; identical to SEQ ID NO: 23939
  Synthetic sequence.

SEQ ID NO: 23941 - protein, 184 aa, Artificial Sequence
  Synthetic sequence.
SRVEEIKKELRRLLEEVRKKNEESKERDRRLNDTIRRELEEIIRRLRKLLEEIRRLRERIDSEEVRKILRDLLKRLDDLVRTITERLKRINEESNRLAEEDVRTLEKILRDLEELAERVERELDEARTVEDLRRVVEKVLRDIKRSIDDVRRENKKSNEDARRWLEELKREVKRLKDELREIEK

SEQ ID NO: 23942 - protein, 184 aa, Artificial Sequence; identical to SEQ ID NO: 23941
  Synthetic sequence.

SEQ ID NO: 23943 - protein, 181 aa, Artificial Sequence
  Synthetic sequence.
SEVERIKRELERLLKEVKDANKRVKDTLRKLLRDVEEMNRRVKRENHELLRRLDELVKAGRDEETIKKVKRESRELLRELAKVNRDVKERIEELLREVKKLNEDVKRKLRELLKELEERIRDEELLKDVRKVAKEVEEELKKLHDDTKRVADKVKEDLDRLHRDSERNARRSEEEMDKRRK

SEQ ID NO: 23944 - protein, 181 aa, Artificial Sequence; identical to SEQ ID NO: 23943
  Synthetic sequence.

SEQ ID NO: 23945 - protein, 181 aa, Artificial Sequence
  Synthetic sequence.
DRVREVKERLKKLLEEVERTNREVMERNHRLLEDVERKNRRVKEENHRLLEELKRLREDGKGDEAVKRVLEESKKLLDDLSEENKRVKEESDKLLDEIRKKNEDVKRKIRELLDRIRKEIEDERLLEDVERTAERVERELDRLHEETKRNADRSREELEKLHRDSEKNARDSAKELEKIRR

SEQ ID NO: 23946 - protein, 181 aa, Artificial Sequence; identical to SEQ ID NO: 23945
  Synthetic sequence.

SEQ ID NO: 23947 - protein, 181 aa, Artificial Sequence
  Synthetic sequence.
DEVERAEEELERLLRELKKLHEDAKERARELLKRIEDVNRKVKEELKRLLDTIRKLREAGRDESTVKEVKDRIEELLKELERLNREVKERIRRLLEEIHKLDEEVNREIERLLREVTRRIKDKDLLEKVKRVVEEVHKRSRELNEDTRRVIDKVEKDLDELHRDSRRVVETVKEELEKLRK

SEQ ID NO: 23948 - protein, 181 aa, Artificial Sequence; identical to SEQ ID NO: 23947
  Synthetic sequence.

SEQ ID NO: 23949 - protein, 181 aa, Artificial Sequence
  Synthetic sequence.
KEVEEVKRRLREVLKRLKEMHERVKRELEKLLKKVEDFNRDVKRKNHDLLRRLEELKKAGEDEKALKEVIDTSRKLLKDLAEVNEEVRKEIEELLKEAHRVDREVNEELRKLLEDITRRIRDKDLLEDVEREARRLHDESRKLNEDTKRVVDTVTEELKKLHRDSERNAKRSEEEMDKRRK

SEQ ID NO: 23950 - protein, 181 aa, Artificial Sequence; identical to SEQ ID NO: 23949
  Synthetic sequence.

SEQ ID NO: 23951 - protein, 181 aa, Artificial Sequence
  Synthetic sequence.
DEVERVKETLDKLLDDVRKLNEEVKKRLEELLEKVERDNRKVKEDNHRLLEEVKDLKRRGKDESALEEVKRRSDKLLEDVHRVNRTVEEEIKRLLDEVRKLNEDVKRKIRKLLEDIRRKIKDKDLLEDVERRAKRVEEELDKLHEDTRREADRVRRDLRRLDEDTKRNVDESRKELEKTRK

SEQ ID NO: 23952 - protein, 181 aa, Artificial Sequence; identical to SEQ ID NO: 23951
  Synthetic sequence.

SEQ ID NO: 23953 - protein, 185 aa, Artificial Sequence
  Synthetic sequence.
SEVEEVIRRIRALVEEIARKNEDILRKNRKLLEDLRELVERVIKEIKELIDRLADEVRRVKDKETVKKLIDDIRKRVEKLAEDLTRLIKEIKDRSRKTLEEAHKLNRDIIRDIRRLLEELRKRVKDDRVRKEVEEVLRDVEERIRRLDEEVRRRAEESERELERLREKVEDMIEKVKRALEELRR

SEQ ID NO: 23954 - protein, 185 aa, Artificial Sequence; identical to SEQ ID NO: 23953
  Synthetic sequence.

SEQ ID NO: 23955 - protein, 185 aa, Artificial Sequence
  Synthetic sequence.
SELEEIIKKLRKLVEDVARRNEELIKKLEETNKRLEDEVRELIEEIKKLIDELAETVKRIEDRRTLEDLIRKIKEEVEELLRRIRERVKEVDKEDKDLIKRIHDDNREILKRLEELLRRAEDKVKDEEMKKRLRDVAEKLKEDVRDLDRKVKKVAKESHERNRRILKELEEVAARVTERLEELRR

SEQ ID NO: 23956 - protein, 185 aa, Artificial Sequence; identical to SEQ ID NO: 23955
  Synthetic sequence.

SEQ ID NO: 23957 - protein, 173 aa, Artificial Sequence
  Synthetic sequence.
DEDERVDEVIKKVREDLRKLLEDSERVVKRSKEELDRWRKKVEDVMRDSDRRLEELRRDKRLEEIKRRSEKTLKEAEDLIRTIKRISEKTLEEDRELIKRAEEEVTRIEEEAKRGDNREEVIKELKKLIDKLREDSKKTIEENKKMNKDAADEIEKIIEDNRRLIKRIEEEDR

SEQ ID NO: 23958 - protein, 173 aa, Artificial Sequence; identical to SEQ ID NO: 23957
  Synthetic sequence.

SEQ ID NO: 23959 - protein, 173 aa, Artificial Sequence
  Synthetic sequence.
SEDERVEEVVKRIEDKLRRLLEESKRVVDDSKRRLDEWRKEVEKVVKKSTDDLEKLRRDKVLEEVKKISKETLDEARKLIDDARKRSDETLKRDERVIREADKKVKEITKRARDGDNREEVIKELEELIERLARISKKTIEEDRRVNKELAERIKEIIERNRRVIEEARERLR

SEQ ID NO: 23960 - protein, 173 aa, Artificial Sequence; identical to SEQ ID NO: 23959
  Synthetic sequence.

SEQ ID NO: 23961 - protein, 182 aa, Artificial Sequence
  Synthetic sequence.
KELEELIEELERLNREINERAKELIKKLRKLNEEVARRHERLIEELRRILEELKELLERGNRSDELLKRIRTMVEKVRKDNEDSLRELKELTDRVMRELTELLKEAKKLTDEIADRLRRIPLDEELRRRAKRVLEESKRNIEKVAEDVTRVLRESEESLERLRERSERVLREVEKTIRDMAR

SEQ ID NO: 23962 - protein, 182 aa, Artificial Sequence; identical to SEQ ID NO: 23961
  Synthetic sequence.

SEQ ID NO: 23963 - protein, 182 aa, Artificial Sequence
  Synthetic sequence.
SEVERLIEELDELNRRINEKHKKLRRELEELNKRVAERHEELIRRLRKLLEDLERLARRGNRSSKLLEDIKRLVDEVRERNRESLDELRRLTRTVAERNKRSLEEARELTERVRKKAEDVPLSEELRKRVEDALRRSKENIKRLEEESREVLRRSEKSIDELRRESERVLKEVKEEIERVRK

SEQ ID NO: 23964 - protein, 182 aa, Artificial Sequence; identical to SEQ ID NO: 23963
  Synthetic sequence.

SEQ ID NO: 23965 - protein, 182 aa, Artificial Sequence
  Synthetic sequence.
SELEELIKELRDLNRRINKRVDDLADELRRLNERINRRHEELIKELRRLLEDLKRKFDRGDRSSDLIREARELLKRIEERNRDSLRELEELSRRVEEDARRLLDELRRLTEEVKKRAEDVPLSEELKKRADDVLRESKENIERVERKIRRVLEESEENIEDLRRRSKEVLDEVRKRIEDIRR

SEQ ID NO: 23966 - protein, 182 aa, Artificial Sequence; identical to SEQ ID NO: 23965
  Synthetic sequence.

SEQ ID NO: 23967 - protein, 182 aa, Artificial Sequence
  Synthetic sequence.
SELEELIRRLKELNKDVNEKHKRLIEELEKLNRDINERHKELIEELERLLRRLEKLLRDGNRSSELMERIRRLIERVRDENRKSLETLKRLSDDIERKNRESLKRLKELTDEARKRLEDIPLSEDLRREAERVLRESEENIKELEDRSRDALRRSEENIRRLKKESEDVLREARREVERLER

SEQ ID NO: 23968 - protein, 182 aa, Artificial Sequence; identical to SEQ ID NO: 23967
  Synthetic sequence.

SEQ ID NO: 23969 - protein, 183 aa, Artificial Sequence
  Synthetic sequence.
SLEEELDKVLKESRDNVRRVEEELEEVMEKSERAAEKLRRDLDRVLEELEKMIRDLKRRGVPKDEVDRVLEELRRLADKLREDLDRVLKESKESIDRLRERVKEVKEESEELARRLKEKSRDIDREDIKRVIDTLRKLNERLNREVKEVIKRNEELVRRLAERVKKVVEDLRRLVKRLDDEVR

SEQ ID NO: 23970 - protein, 183 aa, Artificial Sequence; identical to SEQ ID NO: 23969
  Synthetic sequence.

SEQ ID NO: 23971 - protein, 183 aa, Artificial Sequence
  Synthetic sequence.
SLEETLKEVLRKSEENAERLKRELEKVLRKLEEDLRRLDERLDEVLKRSRDEARKLREADVPKDDVDRVVEESERSIRELKKEIKKVEDDLRKLATDLERRLEEVKERSRELVDRLRKKAKDIDREVIKRVIEDLDRLNDELNKEVEEVIRRLEDIVRELEKKIREVIKRNKELVDRLEEKVR

SEQ ID NO: 23972 - protein, 183 aa, Artificial Sequence; identical to SEQ ID NO: 23971
  Synthetic sequence.

SEQ ID NO: 23973 - protein, 183 aa, Artificial Sequence
  Synthetic sequence.
DLEKRLRDVLKESDENIEELRRELREVLKESEDNVKKLAEENKEVTDRLREEIKRLKEEDVRKDLVEEVRRRLERISEENKKTLDDVKKESKKLVDEVEKTLRDVKRESERLARDLERKKDKISKEEIERVIRELKDLNRRLNEELKRAIKRIKELNKRLNELSKRSIDELRRLVEELERRVK

SEQ ID NO: 23974 - protein, 183 aa, Artificial Sequence; identical to SEQ ID NO: 23973
  Synthetic sequence.

SEQ ID NO: 23975 - protein, 183 aa, Artificial Sequence
  Synthetic sequence.
SLKEKLEEVLRRSEENVERLRKENEDVAKKNREAIEEIKKRLDDVLRELRERIERLKKEGVPGKDVERVREELEKLVTELRERVKKVAKELEELHRRLDRELEKVKETSKRLVEDLDRKSKDIPEEVIDRAVEELKKLNDDLNRTVKKVIRESEELTETLRKDVKRVVDDLRRLVEELARRVK

SEQ ID NO: 23976 - protein, 183 aa, Artificial Sequence; identical to SEQ ID NO: 23975
  Synthetic sequence.

SEQ ID NO: 23977 - protein, 183 aa, Artificial Sequence
  Synthetic sequence.
DLEEELKEVLKESEENIERLKRENDRVVEKNKKAVDDLRERNKRVTERLREEIERLKRRGVPGKEVDDVRRRLEEISKRNKETLDDVLRKLEKLHRDLDEDLKEVKKTSRKLVEELRRKRKDIDKKDIKRVIDELRKLNEDLNRRVKEAIKTSEKITDDLRRMSEESEKELRELVRRLEERVR

SEQ ID NO: 23978 - protein, 183 aa, Artificial Sequence; identical to SEQ ID NO: 23977
  Synthetic sequence.

SEQ ID NO: 23979 - protein, 186 aa, Artificial Sequence
  Synthetic sequence.
SEVEEIIRRIDELIKRLAETVKEIVDRLRKLNKKLNDENREIIKEIRDLIRELAKEVKRIKDRDTLEKVLEDIEREVEKLMKRSRDLNEEVLRTSEKLADDARRTLKEIEDRVRELVKEAEDRIRSIEEVRERLERVLRRVEEVIKRLKEELKKVLDESRKNVEDVTRENEKVLDEVRKTIDELRR

SEQ ID NO: 23980 - protein, 186 aa, Artificial Sequence; identical to SEQ ID NO: 23979
  Synthetic sequence.

SEQ ID NO: 23981 - protein, 186 aa, Artificial Sequence
  Synthetic sequence.
SEVEELIKTIERLIKELEKLNEEIIKRLRDLNKRLNERNEEIERTLRKLITDLARMVREVKDRETVERVLDEIRKEIERLVKESKDENDRALDRSDELVRRSERKNEKIEDEVRKLAKDITDKVKDIEEVLRRLEEVLDRVKKKIKTLTDKNREVLERSRENVKKVTEDNERVLRKLKEDIERLRK

SEQ ID NO: 23982 - protein, 186 aa, Artificial Sequence; identical to SEQ ID NO: 23981
  Synthetic sequence.

SEQ ID NO: 23983 - protein, 186 aa, Artificial Sequence
  Synthetic sequence.
SELEEALKDIKRLIDKLRKDNEDIIRRLRETNDELRKLNKKIIDEIRDLIRRLEEVAKRIKDEKTLEEVLKRILDEVRKLAEESKRLNDKVREENERLVEKSRRTNKEILERVERLAREITRRIKDDKDLKKRLEDVVKRVREEIEKLTRDNERVLEESRRTLEKLTRENEKVLREVKKKIDDLRK

SEQ ID NO: 23984 - protein, 186 aa, Artificial Sequence; identical to SEQ ID NO: 23983
  Synthetic sequence.

SEQ ID NO: 23985 - protein, 186 aa, Artificial Sequence
  Synthetic sequence.
SELEDVEEKIKRLIDRLRELNKKIEDDLRKLAKELADLNKKIIREIEELIRRLAEVVKRISDKDTVRRVLREILKRVERLVRESKKKNDDVRRELEELVKRSEDANKEVLKRVRELAEEVRRRIKDVEELKRRLRKVLERVKREVEKSSERNREVVERLRKELERLTRENEEVLKRVKKEIERLEK

SEQ ID NO: 23986 - protein, 186 aa, Artificial Sequence; identical to SEQ ID NO: 23985
  Synthetic sequence.

SEQ ID NO: 23987 - protein, 186 aa, Artificial Sequence
  Synthetic sequence.
SEVDEVIKRLDELIEELRKRNDDIIREIEKLIKRLEEENKEIVDRIRELIKRLEDMVRRLKDKKTVDDVLKEIEDRVRELAKRSRERNEEVLRRVERLVRESRKTNERILRRIEELFDRIRRRMKDDKDVLDRLREVLDRLRKEIERLTRKNEEVLKDVRRRVKRSSEENEKVLKEVRERIERLKK

SEQ ID NO: 23988 - protein, 186 aa, Artificial Sequence; identical to SEQ ID NO: 23987
  Synthetic sequence.

SEQ ID NO: 23989 - protein, 186 aa, Artificial Sequence
  Synthetic sequence.
SDVDEVIKRLRELIRENHKRNKKIVDEIRELIRELKERNKKIVDEIRELIKRLKDIVRRLKDRDTVRRVLKEILDRVEKLVRKSKKDNERMLERVEKLADDSRKINRDSLRKIEKLIKELEDRIRKDEEVLRRVEEVLRELREAIKRDDEENKKVLEEARKTVEDSSRENKRVLEEVRRRLDEERR

SEQ ID NO: 23990 - protein, 186 aa, Artificial Sequence; identical to SEQ ID NO: 23989
  Synthetic sequence.

SEQ ID NO: 23991 - protein, 175 aa, Artificial Sequence
  Synthetic sequence.
SEKERAEEVFRESKKNIDDVKRKLERVLEDSKRTLDELRKEVEKVLKESEDELRKLARSEGEEVKRIVDDLRRLSEKSFEEVRELLERIERVSRKIARDLEEILKDAKRKTDELRKEGMTEELIREIRELNKRLNDTIEDVIRRMKDLNRRLAEVIKEIIERNKKLIEDAARRIK

SEQ ID NO: 23992 - protein, 175 aa, Artificial Sequence; identical to SEQ ID NO: 23991
  Synthetic sequence.

SEQ ID NO: 23993 - protein, 175 aa, Artificial Sequence
  Synthetic sequence.
REKERLKEVVEKSRRNLEKLREDSERVLEKSRRTLERLKKEVEEVLKESEERLRELARSEKEEVEKIVRELKRLSEESMDEIRRLLDTARKLSEKIFEENARILKRLDELTKELEKEGVTEELIKTIEDINRRANEESKRTEKELEDINRKLEEDIKRIIDRNRKMIEDAARKIK

SEQ ID NO: 23994 - protein, 175 aa, Artificial Sequence; identical to SEQ ID NO: 23993
  Synthetic sequence.

SEQ ID NO: 23995 - protein, 175 aa, Artificial Sequence
  Synthetic sequence.
REEERLEEVLRRAEEILKRLEDEVRKVVEDSKKNIEDVRREVEEVLKKSEDRLRKLARDSGEEVKKIVTELTERSKKSVEDVKKLLDDLRELTKELERRARELLKELRERIKRLEDEGVTEELEKRLKEILDRAAEEIRRIIRELEELNKEANDRIRKIIKENEDLIREAEERTR

SEQ ID NO: 23996 - protein, 175 aa, Artificial Sequence; identical to SEQ ID NO: 23995
  Synthetic sequence.

SEQ ID NO: 23997 - protein, 180 aa, Artificial Sequence
  Synthetic sequence.
ELEERIKKANEDSKRTLRELMERVRKANEDSKRKLEEIREKVERANRESKKILDELRKAGIDKRLEEELRKVNEETRRTLERLAEKVEAVNDKTRKILAELEKEVREVNKKIRDDLSKPVDEKVIRELIKELKDVNRALEKKAKELIDELEEVDKDLEDKVRELIRKLKEVNEDLKRKAD

SEQ ID NO: 23998 - protein, 180 aa, Artificial Sequence; identical to SEQ ID NO: 23997
  Synthetic sequence.

SEQ ID NO: 23999 - protein, 180 aa, Artificial Sequence
  Synthetic sequence.
SLKERVKKVLEESERNLEENKKDAKRVNDETRKKLKELEDRADRVNRETERALRELEDNGVSDEIKERMKEVNKKHREILERISREVKRVNEEHKEEVDRLEKEMRDVNKKVKEELSEDRDEKVVREVIEELKRVNDKLNDASRRLNERLKRVVEDVERRVRDLNKELEDVVEELKERTR

SEQ ID NO: 24000 - protein, 180 aa, Artificial Sequence; identical to SEQ ID NO: 23999
  Synthetic sequence.

SEQ ID NO: 24001 - protein, 180 aa, Artificial Sequence
  Synthetic sequence.
ELEERIKRVIDELRRRLEELRRELKRVNDKTEEDLRRLEDNARRVNDTSRKMLERLEDGGVDEKIAKEVRDVNEKHKEDVKRISDEVREVNKRHKEIADRIEEKVRRAEEEIRKKLSKPTDETVVREIIRELEKVIEELEREVRELNRELREVVERVAKKVRDLNRELEEVIRDVKRKVD

SEQ ID NO: 24002 - protein, 180 aa, Artificial Sequence; identical to SEQ ID NO: 24001
  Synthetic sequence.

SEQ ID NO: 24003 - protein, 181 aa, Artificial Sequence
  Synthetic sequence.
SLEDEARELRRKSEKTNDELRRAIEELEKKVRDMIRRSEEHVRDLVRKVKRVIEKLEEDGAPRELLEELRKLLRDVEERAKELHKTLKDLLETVKRRAEDILRKNKELLERISREVERVNSDRKDLEELIKELKKLNDESREEIERLIRELEELLKEIEDRNRKLAETLKRLLEEVEKRAR

SEQ ID NO: 24004 - protein, 181 aa, Artificial Sequence; identical to SEQ ID NO: 24003
  Synthetic sequence.

SEQ ID NO: 24005 - protein, 181 aa, Artificial Sequence
  Synthetic sequence.
SIEEEIKELKDRSKKTNEELKKEIDELKEDSERTNRESRKHVKEVLDRLREILERLRREGAPEELLRELEKLIRDIKDRAEELHKRNEELIRRVEKKAREILKENEDLVREIERRMKEVNSDRKEIKRLIDELTELNKRSKELIKRLIEELKKLNDDSRKENKRLVREVERLAEEVDRRVK

SEQ ID NO: 24006 - protein, 181 aa, Artificial Sequence; identical to SEQ ID NO: 24005
  Synthetic sequence.

SEQ ID NO: 24007 - protein, 181 aa, Artificial Sequence
  Synthetic sequence.
SLEEKAKRLKEESDKTNKKLRELIERLERESRRTNEELRKKIRELLEDARRELDRLRKEGAPEELLRELDELIKTIVRRLEKILKENADLLKEVKDRLEEILKENEDLVRRVERELRKVNSDEKKVEELRRDLERLDRESEKKIRDLIKTLDELNKESDRKIRKLEEELKRLLEEVEKRVR

SEQ ID NO: 24008 - protein, 181 aa, Artificial Sequence; identical to SEQ ID NO: 24007
  Synthetic sequence.

SEQ ID NO: 24009 - protein, 181 aa, Artificial Sequence
  Synthetic sequence.
DIEKKIEDLRRKAKKVIDDLRKRSDELKKRSKDTNDRLREELKKLEEDVRRVIEDLRRRGAPEELLDELRRLLDEVKKRAEELLRRNKKLMEEIDRRNKKSLEDLKRLLDEVEEEAKRVNSDDKDIEKLIRDLEKLLRDVEERHEDLRRKAEELDRDTKEKVDRLIKELKDLLKEVRDRVR

SEQ ID NO: 24010 - protein, 181 aa, Artificial Sequence; identical to SEQ ID NO: 24009
  Synthetic sequence.

SEQ ID NO: 24011 - protein, 181 aa, Artificial Sequence
  Synthetic sequence.
SLKEKLDDLVRKSDDTNKDLEEKARRLVEDAKRVLKELEDKSRRLVEEARKVLKRLEEEGIDKRLLEELERLIDEVRKKNKESLDRLRKLIDDVRKRLEEILERNRRLVKEVEDRARTVNSDDKKIKELIEELEDLDRRSKKAVEDLIKELKKLIDEVREIHDRLEEELRRLIKTVRDKAR

SEQ ID NO: 24012 - protein, 181 aa, Artificial Sequence; identical to SEQ ID NO: 24011
  Synthetic sequence.

SEQ ID NO: 24013 - protein, 182 aa, Artificial Sequence
  Synthetic sequence.
SLEDKVRKLEEEIKKVLKEIREEVERLLEEDRRTLEDLKRRHRESDRESKEVLDEIAKKVDSEKLKRLEEEVEKLNRENKEAVKRLEEKHRRTLEKLRKVLRELEEEARRLLEELRDMSRMRDDKVIKEVIDTLRKRLEELKRRLEDVIREVRKANEDSERESRDVIRKLKELLERLKEKVK

SEQ ID NO: 24014 - protein, 182 aa, Artificial Sequence; identical to SEQ ID NO: 24013
  Synthetic sequence.

SEQ ID NO: 24015 - protein, 178 aa, Artificial Sequence
  Synthetic sequence.
SEEEKLKEVKDRIREVLRKLEEHTDKVKKEVEKVLRDIRRTTDELKKEVRAMLERLRRKKKDAEDLLRELEKIIEEIERELDRVLEENDKMAEEWKKLLDKVLDDNRKSIRDIEKELDDREPTDELVTEVEKLLRDDEETNRDVVKKVREAVKKDADTNRKVIEEVKKVLEDAARRLD

SEQ ID NO: 24016 - protein, 178 aa, Artificial Sequence; identical to SEQ ID NO: 24015
  Synthetic sequence.

SEQ ID NO: 24017 - protein, 178 aa, Artificial Sequence
  Synthetic sequence.
SEEEKLERVERRLEKVLDEIRRHTEDVKRKDEENLDRLRKKIEKLKRELEKVLRDLEEKRKDAEDELRKLRRRAEEAKRRLDEVKKRLEEISRRTKELLDDVLRRNKESVDRIRREIREKRPTDELVKKLEELLEEDKDTNRKVVKEIEDANRRVNEELDRVIEELKRILEELERRLR

SEQ ID NO: 24018 - protein, 178 aa, Artificial Sequence; identical to SEQ ID NO: 24017
  Synthetic sequence.

SEQ ID NO: 24019 - protein, 186 aa, Artificial Sequence
  Synthetic sequence.
SEVDEVRKTLEDLLRRLDEENKDIIRRNKELLDDLDRKVREAIERLKRLLDELRKILEKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 24020 - protein, 186 aa, Artificial Sequence; identical to SEQ ID NO: 24019
  Synthetic sequence.

SEQ ID NO: 24021 - protein, 186 aa, Artificial Sequence
  Synthetic sequence.
SEVERVKEELKRLLEDLDRKNKRMIDEDERLNKELNEENERLIRELEELLKRLKEIRDKLTDRDTLKKIIDEIDKRLKELIERSRRRNREILEESKKLIEESKRTNREIERRAKKLIDDLRRRVREKEEVKREIDKLREEIREVIERLDKKNEDVLRKSEKNVRDLNRENEEVLRRATEAVRELER

SEQ ID NO: 24022 - protein, 186 aa, Artificial Sequence; identical to SEQ ID NO: 24021
  Synthetic sequence.

SEQ ID NO: 24023 - protein, 186 aa, Artificial Sequence
  Synthetic sequence.
DEVDKVTRTLEELLKRLEEENRKMIEDDKRLNEELNKENRRVEETLRKLLKELEDIRKDLKDKKTLDEIIKRIKERVDKLIRDSERLNDEIKKRSKKLIDDSRERNEDILRKAEELIKRLREKVREKKEVKEKIDRLEKRIRDAIRELNERNKKALDDSERNVRELNKRNERLREEVERKIRELER

SEQ ID NO: 24024 - protein, 186 aa, Artificial Sequence; identical to SEQ ID NO: 24023
  Synthetic sequence.

SEQ ID NO: 24025 - protein, 186 aa, Artificial Sequence
  Synthetic sequence.
SEVDEVAKRLRDLLRELEEKLKRAEDRDRKLNDDLNKTNKKLIKELEDLLRKLEEIARRLKDKDTLKKIIDEIERELKRLIDESRRTNKEILDESRKLVEEIEETLRRAKKEAEDLIRRLRERFKDDDEVRRKIDELEREIKEVVDRLRRRLEELLRRSKENVDRLNRENDRVLEEAKRKIRELEK

SEQ ID NO: 24026 - protein, 186 aa, Artificial Sequence; identical to SEQ ID NO: 24025
  Synthetic sequence.

SEQ ID NO: 24027 - protein, 186 aa, Artificial Sequence
  Synthetic sequence.
SEVDEVADRLEKRLKENRDKNKRVEDEDKRLNKELNDTNRRMEEELKRLLTEIDDIRRKLKDKDTLDRIIERIRREAERLIDESRKSNKRIVEESEKLIRRSRRINEETLERLKKLIKDLRARFKDDEEVRKKIDELERRLKEVIDDSKRRNDELERESRENVRELNRRNKELEDEARKEVERAKK

SEQ ID NO: 24028 - protein, 186 aa, Artificial Sequence; identical to SEQ ID NO: 24027
  Synthetic sequence.

SEQ ID NO: 24029 - protein, 186 aa, Artificial Sequence
  Synthetic sequence.
SRVDEVIERLERLLRELDKINRDMIEDDKRLNTELNKENKEVEDRLRRLLEELEEIRKKLSDEKTLEEIIERVERRLEELIERSKRRNREILERSKELIERSKKTNEEILRRAEELIKRLREEVKDIKEALDKIRRLEERARRVIEELDEKNRRALERSKENVKRLDERNERLRKELEEKVRRLRK

SEQ ID NO: 24030 - protein, 186 aa, Artificial Sequence; identical to SEQ ID NO: 24029
  Synthetic sequence.

SEQ ID NO: 24031 - protein, 185 aa, Artificial Sequence
  Synthetic sequence.
DVEEKVKKVIRELREVLKEIEERVRRVLERNKRSLEDLKRKHKESIDRAKEVLDEIRKDRVDEEKLRRIAEKVKRVIDENERIAKEIKEEIKRVNEKSREILERIADELRKVEEEIKDILAKLRDVEEALKRLEDKLREKLRDLRRKLDELRKENEKVNRDLEDKTRRVIEKLKRVITKLKEEVK

SEQ ID NO: 24032 - protein, 185 aa, Artificial Sequence; identical to SEQ ID NO: 24031
  Synthetic sequence.

SEQ ID NO: 24033 - protein, 181 aa, Artificial Sequence
  Synthetic sequence.
SEIEEVEKRLEDVLRKVNKKTEDLMRSVKEIIKRSREHLEKVIRDLEEILKELRELRKRGKDKKELEDRARKALEDLDRALKRNKEMHDKSDDESREVNERLNRTHKEVLDRLREILKRVKDEDVKRRIEEVEERLKRDNERNNKKIEDVNRDNRRVAEELRRRVEDVKRKIEKVLRELKK

SEQ ID NO: 24034 - protein, 181 aa, Artificial Sequence; identical to SEQ ID NO: 24033
  Synthetic sequence.

SEQ ID NO: 24035 - protein, 183 aa, Artificial Sequence
  Synthetic sequence.
DVEELLDRVTKRVEKALRELRKKVRELKEENRKSVEELEETSKRLKKEVDDVERRLEAGNVDEEVLKRLRDILRDIRRKLKEVTDRNRDSARRSREELERVLEDVERIIREAKRRLEEVRRIKDREKLKKVLEEIEKILKEIEDKVRRVIEKSRRINEENKETNRRVIEDVRRLLKKAEEDLR

SEQ ID NO: 24036 - protein, 183 aa, Artificial Sequence; identical to SEQ ID NO: 24035
  Synthetic sequence.

SEQ ID NO: 24037 - protein, 183 aa, Artificial Sequence
  Synthetic sequence.
RVEERLDEVRKKIDEVLKRLRDTTKELEDENEESLRKLKKEVDEVRKKIEEVLKRLEDANAPKEVLDELRRIVEDIKRRLEEVLEELKRIIDRSKEELKKVLRENEDSARRLKERLKEVERIKDEEKLEKVDREIEEILRRNKRTNEKVAEESRKINREAEERLRRVIEELEKILKEIEDRLK

SEQ ID NO: 24038 - protein, 183 aa, Artificial Sequence; identical to SEQ ID NO: 24037
  Synthetic sequence.

SEQ ID NO: 24039 - protein, 183 aa, Artificial Sequence
  Synthetic sequence.
SVEKKLKDVEDEIRKVLRELEETSKKLDKEVDDMLKKLKDSTEEVKKEIDEMLKRLEERRLPERVLTELKKIADEARRRLEEVNRRNEESAKEIKKELEKVTKENRDSIEDIKRKLEEVARIKDDEKLDKVVKDLRKLLEDDKRTNKEVIDRVRRKLEENKETNEKVIKELRDILREIEERAR

SEQ ID NO: 24040 - protein, 183 aa, Artificial Sequence; identical to SEQ ID NO: 24039
  Synthetic sequence.

SEQ ID NO: 24041 - protein, 185 aa, Artificial Sequence
  Synthetic sequence.
SEIEDVARRIRKLLEELRRRIRKIAEDSRRLNRRLEERNTEMEKEIKDRLRKLEEELKRKEDGETVTREIKEAADRLRELLKESKDENEDVARRSEKLLRDAEETLREITERLKDLLKKLRDRTRTEEVKEKIDRLEKEIRDMLKELRERIKRLKDENEKSLEDLRRRNTELEEEVRRVIRELEK

SEQ ID NO: 24042 - protein, 185 aa, Artificial Sequence; identical to SEQ ID NO: 24041
  Synthetic sequence.

SEQ ID NO: 24043 - protein, 185 aa, Artificial Sequence
  Synthetic sequence.
SELEKVAEDIRRLLKRNEEINREMIKRSRELNEELRERNREVTERIRRLLERLKEERKRTTDGETVERRIREVARRARELLKRSEEMNKEVARRSKKLLDDSKKINDDSRRRLKRLLDELRKRRRTDELEKKLRDLEREIRKVLREAKRLNDELRKENKESLERLKRENDKLRKEVETVIREAEK

SEQ ID NO: 24044 - protein, 185 aa, Artificial Sequence; identical to SEQ ID NO: 24043
  Synthetic sequence.

SEQ ID NO: 24045 - protein, 185 aa, Artificial Sequence
  Synthetic sequence.
DEIEEVIRRIKRLLDENRKKNEEMSDRSRKLNERLRKIIKKIIDEITELLKRLEDRARTVTDGETLRREIKEIADRAKRLLDEIRKILEDIRKELEELNRRSEEMNKESKEEADRLLEELRKRSRDRKVDKKIEDLRKEIEDVLKELAERNKENKDRNKKSADELRKEIEDLERKVREVIRELTR

SEQ ID NO: 24046 - protein, 185 aa, Artificial Sequence; identical to SEQ ID NO: 24045
  Synthetic sequence.

SEQ ID NO: 24047 - protein, 180 aa, Artificial Sequence
  Synthetic sequence.
RVEDEIRRLEEEARRVLRELEDLLRRLKKKNDESNKEIRERIERVRRKAEKVLRELERRGVPDEVIRELEERLRRMEKRAEELNKRSKELSDDIVRRLRELIERLKRLIEDVLRKLDRVRDERVIERLIRELRRLLEDVKRKAEDLIRKSEDLNEKWRKELKKLEREIERLLKEVADRVK

SEQ ID NO: 24048 - protein, 180 aa, Artificial Sequence; identical to SEQ ID NO: 24047
  Synthetic sequence.

SEQ ID NO: 24049 - protein, 179 aa, Artificial Sequence
  Synthetic sequence.
EAEKELKRVEDRDKESNDRTKDILRRIEKEVRESNKRSKEILDEIRKRVRDVIEELRRKRSDLEEVIRELEKILREVEEAVDRINRDNERILEELAERAKRLNDENKKISDDVRRRMNEDEETVRRLKDELEEVNERTERAVRDLLRKARKVDDESRRRVEALLRKVEEVLREIKRRVD

SEQ ID NO: 24050 - protein, 179 aa, Artificial Sequence; identical to SEQ ID NO: 24049
  Synthetic sequence.

SEQ ID NO: 24051 - protein, 181 aa, Artificial Sequence
  Synthetic sequence.
SFKETLDEIRKRVKEVLDKLEKILRDIARRVEKVNKENEDRLREINRRNEEVLRRLKKKGVDETLLERNRRANERTNREVKKSNDETREVLKEAKKAIEKLLEELRRVLKEVEDRADKKRDDEDKLRELLERLERLLRELERRVEKIEEDLKRILDEVRKRTKELLERNERILEKLERDAD

SEQ ID NO: 24052 - protein, 181 aa, Artificial Sequence; identical to SEQ ID NO: 24051
  Synthetic sequence.

SEQ ID NO: 24053 - protein, 183 aa, Artificial Sequence
  Synthetic sequence.
SIEDIVREIRERNKDAKRKVEDIVRRNREEIDKVLKRVEKILRDNEKRIREVKEELKERVKSRDLERVEEKLERLLRESKEVFKEVEDRLRDLMRKSDEVARRAEENIKENIRRVEDVARKRLDEKDLDKVRKESEDNLREILRTLKEVHERSKETLKRIEDTLRRVHKKSEDELRRLREEVR

SEQ ID NO: 24054 - protein, 183 aa, Artificial Sequence; identical to SEQ ID NO: 24053
  Synthetic sequence.

SEQ ID NO: 24055 - protein, 183 aa, Artificial Sequence
  Synthetic sequence.
SIEEIAKTIKEEIKEVMDRVREIVERDEREIKKVKEEVDRIAKRNEDEIRKVKDELDKKVKSDRLERLRDKLRKVEEDSRESLKDVRRKLEEVRRESDEVVRDVERRLEEVLREVEDVLRKRLPEEAMKEVADRVRKKLEEIERTLEEVHRKSRKVLTEIIKKLKENHDRSKELLDRIREEVK

SEQ ID NO: 24056 - protein, 183 aa, Artificial Sequence; identical to SEQ ID NO: 24055
  Synthetic sequence.

SEQ ID NO: 24057 - protein, 182 aa, Artificial Sequence
  Synthetic sequence.
SEVEEVLKEIKDLLRRLEEIVRRVLKENRRLLEEDVRRTEEILEELERLLDELRKDIKRLDDRDKVEEIVRRAIKELEDLLRESEERNKRSREESEKLLRDLRETIERIRRRLEELLKRLKDRGAPEELLKRIEDEVRRVEDKLRKLIKRSKEESDKVAEELERLNREARKRIRDVMEELKR

SEQ ID NO: 24058 - protein, 182 aa, Artificial Sequence; identical to SEQ ID NO: 24057
  Synthetic sequence.

SEQ ID NO: 24059 - protein, 182 aa, Artificial Sequence
  Synthetic sequence.
DEAEEILRRLKKLLEDAKRISDRTVEKNREMLKKIEEDSKRSLERNRELLKRIKELAKDIRDDKTLEEMLRELKERLDRSHDENRRLVDRIRDISRRTNEENRRVIKEVEDRLRELLEEAERRGLPREIIERLKEEVDRLLKELRDSNRELKRESDEVVEKLRELNKRSKEEADKVEKDLRR

SEQ ID NO: 24060 - protein, 182 aa, Artificial Sequence; identical to SEQ ID NO: 24059
  Synthetic sequence.

SEQ ID NO: 24061 - protein, 182 aa, Artificial Sequence
  Synthetic sequence.
SEVDEVLKRLRKDLDKVRKDSKKSLEELRRVLEEVERLSDESVKRLEEVLKRLEDLIKDIKDDESLRRLVDEARKELEAINKRNEELIRRVEEELKEILKRNEEIIRRVEEKLRRILREAERRGVPREIIKKLADEVREVLERLKELNRRLEKEARDAKRRLEESNDRLRRKVEEVIKELRR

SEQ ID NO: 24062 - protein, 182 aa, Artificial Sequence; identical to SEQ ID NO: 24061
  Synthetic sequence.

SEQ ID NO: 24063 - protein, 179 aa, Artificial Sequence
  Synthetic sequence.
SEVEKLLDESRRVVEENRRANKKLAEESRKAVRRNREESKRLNEELREVVERARRKVTERDKDKDLLRRIIKELRDILERVAEDHRRLIEEHRKIADEVREKVKDLNRRHKEIMERVAREVKKEESLRRIKRTHEETEKESEKTLRDLEDEHRKTIEELERSLKELRDRIKKVLDELRK

SEQ ID NO: 24064 - protein, 179 aa, Artificial Sequence; identical to SEQ ID NO: 24063
  Synthetic sequence.

SEQ ID NO: 24065 - protein, 171 aa, Artificial Sequence
  Synthetic sequence.
DEVEEVLKKARKDIERWREETRKVKEENKRNIDRIRKKLEEVLRDLKRAIDEIRKSNLDREEVDRVLERLEEKLREMKRRLDENDKRDKERLKKKNKEMEEERRKIEKELEDAGARREVLEEIRKLLRDIKETDRKVHEELERSNEKLRREIEKILRDLEDELRKLRRERE

SEQ ID NO: 24066 - protein, 171 aa, Artificial Sequence; identical to SEQ ID NO: 24065
  Synthetic sequence.

SEQ ID NO: 24067 - protein, 171 aa, Artificial Sequence
  Synthetic sequence.
SEVEEVLRRAEKAIREWEEETRRAKEENEKNIKKVADDLRRLLEDARRTIEEIEKRRADEKTVEKVLTDLEKKVRDVAKRLKENNDEDRRRLEDINRKVEERLEKLRDELRKAGASEEVLKEIKKLIDTARRKDEKVHKELEDTNRDLDRAIEEVIREIKKLLDDLREKAR

SEQ ID NO: 24068 - protein, 171 aa, Artificial Sequence; identical to SEQ ID NO: 24067
  Synthetic sequence.

SEQ ID NO: 24069 - protein, 181 aa, Artificial Sequence
  Synthetic sequence.
SEKEDVLRRIKELLERLHEENREVLTRIEKLLKDNKERNDDVLRRITELLKEVTKRAKDRGKPRDDLERLIRELERTLKELAERVKKLDEDLKKTVDDLRREVERLNEELERMLRELTKLADRVGTEEVRKRVEDVVRKNKEVARELLDRVRKLSERNKRAIDKLLEEVKRVLEEVERALK

SEQ ID NO: 24070 - protein, 181 aa, Artificial Sequence; identical to SEQ ID NO: 24069
  Synthetic sequence.

SEQ ID NO: 24071 - protein, 171 aa, Artificial Sequence
  Synthetic sequence.
DEERDVRREIRKLLRDAEEHSKKLNEESKKTNKRNEEENRKALEDNKRLLKEVEDRIPKTKDLERIKRRNKELNERHKRTLERLKEESRRLNEKHKEDLKKLAEDVERLERAGLPVTELRERIKRLIEEIERLNREFKKKNEELSKKNKELVERSRTESKKLVDEARERAR

SEQ ID NO: 24072 - protein, 171 aa, Artificial Sequence; identical to SEQ ID NO: 24071
  Synthetic sequence.

SEQ ID NO: 24073 - protein, 178 aa, Artificial Sequence
  Synthetic sequence.
DSEEEVRKRVKDLSEENKRLVKTAEKRVRELSKENKELVERLKREVDRIKKEIEELKRRGTTEDADRELRERLEKLKRELEDLNRTLNRRATELEKEVKRLSDELRKRAEELEKKVRRENKVDEKVLREIREIVKKNKRENEEVLRRIRELVKENNDENKRVLDEIEKLLKEIEDESR

SEQ ID NO: 24074 - protein, 178 aa, Artificial Sequence; identical to SEQ ID NO: 24073
  Synthetic sequence.

SEQ ID NO: 24075 - protein, 185 aa, Artificial Sequence
  Synthetic sequence.
SEMDEVRKKLRELVERLKKEAERSRKSHREILKKVRDDLKRSEESHKELLDRLEEVLKRTVRDERKVREIRKELDEHHKRYREELKRLEEELRKHHEKYKEVLEDLKRRLDKLLRELEEVLKKKVSEDKLRRLLEEAAEVIKRLLDEVKRLNEHAKRMAEKILEDVKRLNKHAEDKVRDVEEKVK

SEQ ID NO: 24076 - protein, 185 aa, Artificial Sequence; identical to SEQ ID NO: 24075
  Synthetic sequence.

SEQ ID NO: 24077 - protein, 185 aa, Artificial Sequence
  Synthetic sequence.
RELEEVARRLERLLDELRKKLRESERSVRRLLEELKKELEKLRKRHEDLLRTVKKKLDDTVTDERKLEELTRRLEKHHREVKKRLEDLDRELEKLDEEYKRVLEKLERELEELRRRLEEVRKRNISEEELKRLLEEVEKAIRELLERVERLNRRLEEEIRRVLEDLERIIRHAEEDLRRIEEEVK

SEQ ID NO: 24078 - protein, 185 aa, Artificial Sequence; identical to SEQ ID NO: 24077
  Synthetic sequence.

SEQ ID NO: 24079 - protein, 185 aa, Artificial Sequence
  Synthetic sequence.
RELEEVKKKLEKLAKDLRDTLERSARSVEELIKRLEDELRRSEESHKELLERLEDTLRKRATDEEKVRRLKRRLEKHHEEYRRTLDRIRKELKRLRDEYERELRRIEKELEDLERRLEEVLKRNISEEELRKLLKDATEEVRRIAEEVKKLNDELRRAVEEVLKEVRETNKHVREMIETVREEVE

SEQ ID NO: 24080 - protein, 185 aa, Artificial Sequence; identical to SEQ ID NO: 24079
  Synthetic sequence.

SEQ ID NO: 24081 - protein, 185 aa, Artificial Sequence
  Synthetic sequence.
SELEEVAKRLKELVDDVRRALKESDDSHKELLKRLKEKLDEVRKRLKKLVDDLEETLKRTLRDEDKMRDIKRRLDEETERLKRKLEKIEKELRDHHKRYKETLDRLEEELERLLRELEKVLRKNISEEELERLVREVERVIRKLKEDVKRLNDHAREKVKRVEEELRREEKRVRDEVERVKEEVR

SEQ ID NO: 24082 - protein, 185 aa, Artificial Sequence; identical to SEQ ID NO: 24081
  Synthetic sequence.

SEQ ID NO: 24083 - protein, 185 aa, Artificial Sequence
  Synthetic sequence.
SELERVEDEARKLADDLRRMLEESRRSHEKILREVEEELKKSEESVRRILERVKEVLDRKLTDEETLRRLERRLAELLRRYEEELTRLREELRRHHEEYEKRLRELEERLRKLEEDLKRVLDKNISEDELRELLDRLRKAIKKLLDDVKRLNDHVKELIERIRDEVRRLNRRLEEEARDVERRVE

SEQ ID NO: 24084 - protein, 185 aa, Artificial Sequence; identical to SEQ ID NO: 24083
  Synthetic sequence.

SEQ ID NO: 24085 - protein, 185 aa, Artificial Sequence
  Synthetic sequence.
DELETVREEIERLARELEKELKKSEDSVEKLLRELKERLKEVRKRHKELLDRLRDRLRKTVKDKDKLEKLERELKKHHEDVDKLLRELEDKLRELRERYKRTLDKIREDLEKLKRDAEEVLKRNISEEELRRLVEDVKRVVDEVLERVKELNKRLEEAIRRILEELKKIEKNVKDFIEDIDRRVK

SEQ ID NO: 24086 - protein, 185 aa, Artificial Sequence; identical to SEQ ID NO: 24085
  Synthetic sequence.

SEQ ID NO: 24087 - protein, 185 aa, Artificial Sequence
  Synthetic sequence.
RELEEVKRRLEELLERLRKELERSDKSHKELAKKLRDELERVEREHERLLRELEDTLRKTLTDKKKADELRRELEKHHEEVKELLKKIEEDLRRHHKRYRERLKEIKERLEKLRRELDEVAKKNISEKELTDLLREAKRRVEEVLKEVRDLNRNVKETVDRVLKELEDILRNVEEMIKEIKDKVR

SEQ ID NO: 24088 - protein, 185 aa, Artificial Sequence; identical to SEQ ID NO: 24087
  Synthetic sequence.

SEQ ID NO: 24089 - protein, 172 aa, Artificial Sequence
  Synthetic sequence.
SDAEDILRKVEDLIRRLAEKHRDLLRRSKENAERIKREHDDHHRDIRRVIKEIEDNNLSEEEVKRLLDELKRKSEETHRRSRKNLEEDKRRVEKIHEDSRRDLERIERDVRKKIKDDRELLKTVRDLLETLREINDRVREELRKIHEDVERRNKEVLDRNKKLLEELERKRR

SEQ ID NO: 24090 - protein, 172 aa, Artificial Sequence; identical to SEQ ID NO: 24089
  Synthetic sequence.

SEQ ID NO: 24091 - protein, 181 aa, Artificial Sequence
  Synthetic sequence.
SELEDIERKLKELEDEDRELNRKLNDDTRRLDERNRRLNEELTKKLREVEEEAKELRKRDNDERTVEKIKDRLRRIADELRKELEKITKELEDMSERVKRELEKIRKRTEDVERELRREMEENRVDERVREKIERIAKKLEDDNKESEDRHRRINEENRRRNDKNREDIERILRRLDEELR

SEQ ID NO: 24092 - protein, 181 aa, Artificial Sequence; identical to SEQ ID NO: 24091
  Synthetic sequence.

SEQ ID NO: 24093 - protein, 181 aa, Artificial Sequence
  Synthetic sequence.
KELEEVDDEVRKEAEEVKRYIKESKEKLDRLRREDERLNDRVREKVEDVRRRVEERRSEDNDEETVRELLERLRREAEKLERELEEIKKKTEDMLRRLRKENREMERRLRERSRKLKEKAKKDRVDERVKRKVDKIERELEDAIRRANEEHTKIEEDLRRRNKESKDEIRRILEELEERTR

SEQ ID NO: 24094 - protein, 181 aa, Artificial Sequence; identical to SEQ ID NO: 24093
  Synthetic sequence.

SEQ ID NO: 24095 - protein, 181 aa, Artificial Sequence
  Synthetic sequence.
REIETVRREIEKILDDLRRTVKRIEDEVRKIHEDLRRSLEDSKRNIEEILKDLERAARRDNLDKKVEDDMRKLVEDLKRKHDKLRRDNERVTKELKDRLKKLEDDLRRAIEELRRRLDKGLDKKDIDKLLKELRDLVEKIKKDLKELLERYEEIVRRIKELLKDLNREAEEVVRRLKEELR

SEQ ID NO: 24096 - protein, 181 aa, Artificial Sequence; identical to SEQ ID NO: 24095
  Synthetic sequence.

SEQ ID NO: 24097 - protein, 182 aa, Artificial Sequence
  Synthetic sequence.
DEEERAEREIKKLLDDLRRTLEEVKEAIRRILEDNRRTTKRINDEDRKINDDLRRTLERRNISEDLERDVRRIHKENKELNEKLNEDNKRIMDEIEEKAKRLEDRIREIIKRIKKLLEEMRRDGLDVDKVLKEVEETIDRVKKDIRRALREVEETSKEDKKRLREVLERSKDLARRLKEKLK

SEQ ID NO: 24098 - protein, 182 aa, Artificial Sequence; identical to SEQ ID NO: 24097
  Synthetic sequence.

SEQ ID NO: 24099 - protein, 182 aa, Artificial Sequence
  Synthetic sequence.
SREEEAERRIEKLLRELEKTNRDIHEEIRKILERLRRTLKKVNDEDEKLNRDLEDTLRRRNVSEELADEARKLHEENRRVNERLNREVEEIIERIKRLVDELHKRTEEIKETIKRIVDEMRREGRPVEDVLRRVKEIIDRVKEEHKRMLEEVRKIAKDLEEKIRAVLEESKKLAEDIKRRLT

SEQ ID NO: 24100 - protein, 182 aa, Artificial Sequence; identical to SEQ ID NO: 24099
  Synthetic sequence.

SEQ ID NO: 24101 - protein, 182 aa, Artificial Sequence
  Synthetic sequence.
REEEKAEEDIRRILRDLKETNRRIHEEIKKLLDDNERTLRRINEEDKKLNEDLRRTLEESRADEELRRKVREVHERNRKKNEDLNRRNERIKEELKRKVDELHERTKEIMERIKRLIEEMKREGRPVEEVLKTVEDIVRKVKREHEELLKEIEDLSRENKKDNERMLEESRRLARKLKEELR

SEQ ID NO: 24102 - protein, 182 aa, Artificial Sequence; identical to SEQ ID NO: 24101
  Synthetic sequence.

SEQ ID NO: 24103 - protein, 182 aa, Artificial Sequence
  Synthetic sequence.
SEEEKMEEDIERLLDRLRRINKRLHDEHKKLNEDNERTVRRIDEEDKRINEDLERTLRESNVDEELKKELEEAHRRNRKLNEDLRRRNKRIHDENRKRVRELHERTKEIIERIRKLLEEARREGRDVRKVLEDVERIIRRLEEEHRRALEESRKRSEENKRENEEMLERSKELAERIKRRLK

SEQ ID NO: 24104 - protein, 182 aa, Artificial Sequence; identical to SEQ ID NO: 24103
  Synthetic sequence.

SEQ ID NO: 24105 - protein, 182 aa, Artificial Sequence
  Synthetic sequence.
SEEEKAREDIKRLLEDLRRTNKKIHEDIEDILRELKETLKRVNDDDKRINDDLDRTLKERNIDEELKKRVDEAHRRNRRKNEELDRRAKRLLEEIRRLVEELHRRTERIEREIKRLLDEMSREGRDVEEVLRTVEKIIEDVKKEHEDLLKRVKDIVKKIKEEIEKVLRESEKLAREIKEELR

SEQ ID NO: 24106 - protein, 182 aa, Artificial Sequence; identical to SEQ ID NO: 24105
  Synthetic sequence.

SEQ ID NO: 24107 - protein, 182 aa, Artificial Sequence
  Synthetic sequence.
SEEDELRKRVADILKRLREVNKRLHDEVKRLLKENRDALKEVKDKIRESNRELDEVLKRRRIDEDLERRAREINERDKKMLEELEKESRDLLKELEDILRELHKRVREIEKELEDTLRKVERDREPVEEVLERLKEIVRKAEEEHKDVLRRLKEISDRHKRRLEEAERRNEKLLRDLKEELR

SEQ ID NO: 24108 - protein, 182 aa, Artificial Sequence; identical to SEQ ID NO: 24107
  Synthetic sequence.

SEQ ID NO: 24109 - protein, 182 aa, Artificial Sequence
  Synthetic sequence.
SRLEEMLKRAEDLSRESEELLRRVLEEVKDLSRKHEEALREILKRVKDLVDTVRDLLRRGKADEKVLRRIKEELRKLKEEAKRISDELEDRLRKLKERIDEILERLERRYRKLKKEIEDELPETEEVRKLEEELKRLLEENRRLAKELRDELRRLTKRNKDVVREVERRLEEIMKEIDKEVR

SEQ ID NO: 24110 - protein, 182 aa, Artificial Sequence; identical to SEQ ID NO: 24109
  Synthetic sequence.

SEQ ID NO: 24111 - protein, 177 aa, Artificial Sequence
  Synthetic sequence.
SEDERIKKELRKVEREVDKLLKEHEKILEDLKREVDKLIETHRKILEELKRRVDELKRRGSDKRDFKRLKDENKEALDKTREDADKLRRDNERKLEETKRRARELEEKVKREKEELDREGSKERIRRELEEVLKDIRRKLKELKERNDKVNRDIEELLRELEERNTEVDKEIKKKAD

SEQ ID NO: 24112 - protein, 177 aa, Artificial Sequence; identical to SEQ ID NO: 24111
  Synthetic sequence.

SEQ ID NO: 24113 - protein, 171 aa, Artificial Sequence
  Synthetic sequence.
DEEKEAEDLIEEHRRRSEEIARRADKLSEDHKRKVDEIAKTVEKLIRTLKEIVDRKPPDDELRKILEDVRRRAEDLDREVRKTNEEMRRRLRKIEADVEREMRETERRVREKIKDNKELKDRVERVLEESRELLERLRKKLEDNSKEVEDILRKLRKEVEDVVRKIRKRAE

SEQ ID NO: 24114 - protein, 171 aa, Artificial Sequence; identical to SEQ ID NO: 24113
  Synthetic sequence.

SEQ ID NO: 24115 - protein, 171 aa, Artificial Sequence
  Synthetic sequence.
RDEDEVRKLITRHEKLSRDIAERLKRESKKHRDDVERIAKENEELNRRLREIVKKKPPDKELEDILREARERTERLKERVRKINRELKKRVKEIEDTVERLMDETREEVERKIERNKELKDDVRRVLKKSRDELKRLREELKRNSEEVERILKKLDEDNRRVLKEIRERLT

SEQ ID NO: 24116 - protein, 171 aa, Artificial Sequence; identical to SEQ ID NO: 24115
  Synthetic sequence.

SEQ ID NO: 24117 - protein, 180 aa, Artificial Sequence
  Synthetic sequence.
DKEREVRRRVEELKKDSEDVLRRNREEVEKLHDENRKVNEESDRTAKELVEEAERMLREARKKIPEELLRRVREILKKLEDEVRRVKKTNEDEDEKLKREVEKVEEEHERKLRELDEEVKRRKKTEELLKELKKELDRLREENERSNRRLRKMLEELKRKNEEVNRELRKKLREIKERLR

SEQ ID NO: 24118 - protein, 180 aa, Artificial Sequence; identical to SEQ ID NO: 24117
  Synthetic sequence.

SEQ ID NO: 24119 - protein, 178 aa, Artificial Sequence
  Synthetic sequence.
SEEERLERTVEEVEKALKKLADDLRRDMDRSRKSHEDLLDKLRKELDRVLEEIRKKTTPEEDAKRLLERVEREIRRIKEELRRHHEEYKKRLEDIEKELKDLEDEMRRRLKELRDRIRREGVTEEVEKRLRELLDEARREVERILKDLRELNEHVRRRVDEVRRRLEELLERLDRETR

SEQ ID NO: 24120 - protein, 178 aa, Artificial Sequence; identical to SEQ ID NO: 24119
  Synthetic sequence.

SEQ ID NO: 24121 - protein, 174 aa, Artificial Sequence
  Synthetic sequence.
DEKREVEKELKRVDDEIKRLLRELEEALRRDKEEVDRLDKEVKDALDEVRERIERAGLDKELLERAEKALRENEDRHREAAKKYEKALRELKKRVDDEAERLERALRKIREDLDKTDVGEKVKEDLKRLLEEVEKAVRKVVEDSKRLHDEAKEAVDRNKEHLRRLLEDAKRRAK

SEQ ID NO: 24122 - protein, 174 aa, Artificial Sequence; identical to SEQ ID NO: 24121
  Synthetic sequence.

SEQ ID NO: 24123 - protein, 175 aa, Artificial Sequence
  Synthetic sequence.
SEKERAEEEIERSKRNLERLLEEAKREIDRSRENLKRTLTKVEEVLRKIKEDLKRLNVREDLVKKIDELLKDLERKLRELKKKAEDLHEEVDRALKELVRRARELHKRVEERIEEEKKAVEKLIRELRELNKRLAEEIKRLIDELRKLNKELDDEVEKIIRRAEDLLRDLERETR

SEQ ID NO: 24124 - protein, 175 aa, Artificial Sequence; identical to SEQ ID NO: 24123
  Synthetic sequence.

SEQ ID NO: 24125 - protein, 179 aa, Artificial Sequence
  Synthetic sequence.
SEVEKVIRDLEEINKRLLEEIKRSIEENKRTNEEAERKVKEVIDRLRKLLEDLKRTNSKDDRVVEEVKRRLKRIDEELKKLLRDVERKDEENKRKLEELDRRVKEEHRKIEEDLRRANVDEDRLKRVEDVLRESVKNLKRLVDEVRKANRESNEHLKDLARKVEKVIREIEEEVDRTRT

SEQ ID NO: 24126 - protein, 179 aa, Artificial Sequence; identical to SEQ ID NO: 24125
  Synthetic sequence.

SEQ ID NO: 24127 - protein, 186 aa, Artificial Sequence
  Synthetic sequence.
SELERLVEELRRALEKHKRRLEELKKELKKALDDHRREVKRLIDELKKTLDDVRKASRIDDEEALKKIEEDLKKLLRDIKERLKESTRRMEELLRRVKKDIRESHERLRELLKKIEKELKDLKKDQDERLLEDVKRILDEVRREVEKLDTDADRRLREVKEEVERINREVEKTLRDVEEDLDRLKK

SEQ ID NO: 24128 - protein, 186 aa, Artificial Sequence; identical to SEQ ID NO: 24127
  Synthetic sequence.

SEQ ID NO: 24129 - protein, 186 aa, Artificial Sequence
  Synthetic sequence.
SEVEKLKEDLKRALDEHRKRLEELKKELEDVLRRHEEKVRRLKEKLKRILDEIRRLSRIRDEEALRKIVEDARRLLEEIERRMRESHKEVERLLKRVEDDIERSTRELRKLLEEIRDRLDKLRKDLDERLLEDLDRALDEVRKEVEKLNRDAKRTLDKVREDVKRLDDDLRRTLKRVKEEIDKLTK

SEQ ID NO: 24130 - protein, 186 aa, Artificial Sequence; identical to SEQ ID NO: 24129
  Synthetic sequence.

SEQ ID NO: 24131 - protein, 186 aa, Artificial Sequence
  Synthetic sequence.
DEIEELKKRLRKILEEHRKRVEDLKKENEDLNRRAEETLERLKRELEEMLREIAERSRIRDDKKLEELVDRARELLKRVRDELERLFKELEDRHRRIEEDLKRSTEELERLIREVEDELDKLRKDQDERILEDLKRVIERVEREVRRLNKDLKRALDESRKRIEDWLKELDDVIKRVKREVEKIRT

SEQ ID NO: 24132 - protein, 186 aa, Artificial Sequence; identical to SEQ ID NO: 24131
  Synthetic sequence.

SEQ ID NO: 24133 - protein, 186 aa, Artificial Sequence
  Synthetic sequence.
SEAEKLKKELEEVLERARRRLTELKEENKDANRRHRRRLEELKKRLEDVLKKVKDDADIRDEEMLERLREELERLLREVEEDIRESTKRLRDLHRRIREEIEKLREELEKRLKEVEEELDRLRKDLDERILRRLEEVIRRVDRDIKELIKDAREVLERSKRDVERWNREMKKVLDEVRKRVEEIRT

SEQ ID NO: 24134 - protein, 186 aa, Artificial Sequence; identical to SEQ ID NO: 24133
  Synthetic sequence.

SEQ ID NO: 24135 - protein, 174 aa, Artificial Sequence
  Synthetic sequence.
SEDEDAKRELRRVKEEVDKTLEDSKRVHDESRKRAREWLEDSKRVHREVKERLKELDVTEDLLRDIERLIKESEEKNKRIEEEYRKLLRESEKRNKENKERVEKILRELDDRLRKEGATEELKRELERVLEEHRRSLEKNKRDVERINEELKRRLDRNKEELRKILEDVERRRR

SEQ ID NO: 24136 - protein, 174 aa, Artificial Sequence; identical to SEQ ID NO: 24135
  Synthetic sequence.

SEQ ID NO: 24137 - protein, 174 aa, Artificial Sequence
  Synthetic sequence.
SEEERLRREVKRVEDENRKLLERLREIAERVHRENKRLLDESRRIADKVRRDLDRLPKTEELKKLIDDLRRSLEELERRNRKVDKEIKDRLKRVEEENRKVDKELKDRVKEFEDRKEPLEEVLEELERVLKRLEEEHRRVVKELRDLLRRIKEDHDRLVEEAEEILREIDERAK

SEQ ID NO: 24138 - protein, 174 aa, Artificial Sequence; identical to SEQ ID NO: 24137
  Synthetic sequence.

SEQ ID NO: 24139 - protein, 174 aa, Artificial Sequence
  Synthetic sequence.
SEEEEADKAIRTIAKAIEDLVRDLERALKESKRNIEELAKDLKRANDRIEEELEKANVPEETLRELRKRSEDSNREIEKALRELTKAHEDIEREIRRTLEELRRRLKELREEARKTRVDKELADRLRDLLRDAKRVVDRIKRALEELNKEAKKLVERAKKKHDDLLEDVKRDTK

SEQ ID NO: 24140 - protein, 174 aa, Artificial Sequence; identical to SEQ ID NO: 24139
  Synthetic sequence.

SEQ ID NO: 24141 - protein, 174 aa, Artificial Sequence
  Synthetic sequence.
SEEEDAKRVLDEIREELKKLNDDVRRALKESKENIDRIIEDLDRTNKRIEEELDRLNLDEEELRRLKEKSRTSNEELRRLLKELEDRHRENKRTHEEVEKELEKELRRLAREARETRVDEELKERLKRLLERVREEVKRNKEHLERLNKKVKEDVDRLKKRHKDTLDEVDERRK

SEQ ID NO: 24142 - protein, 174 aa, Artificial Sequence; identical to SEQ ID NO: 24141
  Synthetic sequence.

SEQ ID NO: 24143 - protein, 183 aa, Artificial Sequence
  Synthetic sequence.
KLDEDLEKVIKEVKERLKESLDRHKEVAKRLEEEVKRSEEEHRKVLEEAKRKLEEIKTKTRKDEEMKRVEEELDEIARRSEDILRRIREELKRIHEESERELRDVEREIDKRTEDLRRLRKDIDDRTVRKVERELRDLIRRLEKRNEELIRRVKEIVERMEKTNRDLIRRIRELIKKVEDDVR

SEQ ID NO: 24144 - protein, 183 aa, Artificial Sequence; identical to SEQ ID NO: 24143
  Synthetic sequence.

SEQ ID NO: 24145 - protein, 180 aa, Artificial Sequence
  Synthetic sequence.
SEEEKLKRVLDEFRRAVKELLEDLERANERAKDEVRRLLEDLDRAHERIRRAVEKLKERVKDKGPEKVLEELDRELKKLAEENEKSKEEVERTVRRVHEKNEKIKEDLRRTVERVEEEVRKTRPDKDLEKRIRDTLREIKKRVEDVKRDNKRVLDELRKKIEENKKRNEDVLKEMEDKTE

SEQ ID NO: 24146 - protein, 180 aa, Artificial Sequence; identical to SEQ ID NO: 24145
  Synthetic sequence.

SEQ ID NO: 24147 - protein, 185 aa, Artificial Sequence
  Synthetic sequence.
SDAERVKKESKDLLDTTKRLADRLKELLERLNKETRDRVREVIKEIERLVDEVEKEARKGLDEETKKRVIDKIRKTLEDIKRKLDKLLEEHKTENDRIKKEADELLKEHRDRLEELRRKLDERNLREDIRTDLEDVLRRNKEALEEIRKDIERVNRKDREELREIARTLEKVLRDARRRLEELRR

SEQ ID NO: 24148 - protein, 185 aa, Artificial Sequence; identical to SEQ ID NO: 24147
  Synthetic sequence.

SEQ ID NO: 24149 - protein, 181 aa, Artificial Sequence
  Synthetic sequence.
SIEDDLRRVLERSKRSLEELKRKADRVLEESKKNVRDLERELKRVLEKIKETIDKLRKDGRLDEKLKKEIEDLLREAKERVDRLKKELRDLHEEVKKALEDLERRARDTHRRLKERVDKGLDKEEVERLIRELDRVNEELAREVERLIRELEEVNRRVNEDLKRLIRELERALKELDERVR

SEQ ID NO: 24150 - protein, 181 aa, Artificial Sequence; identical to SEQ ID NO: 24149
  Synthetic sequence.

SEQ ID NO: 24151 - protein, 178 aa, Artificial Sequence
  Synthetic sequence.
DEVDELIKRLEERNEELNRKAKRIIEKLKKENDDLNRKLDEIVRKAREDIEDAERRVNDDKVIEEIKKLIEELRKRIEEELKKAKEAHERIEEEIKEALKRARELNKKLEEELRRRVRGKDLEDKLEEVLRRSKKNIEDVEKELRDVLRAAKKNLDDLRRKLEDVLRRLRDEIRRKKK

SEQ ID NO: 24152 - protein, 178 aa, Artificial Sequence; identical to SEQ ID NO: 24151
  Synthetic sequence.

SEQ ID NO: 24153 - protein, 178 aa, Artificial Sequence
  Synthetic sequence.
SDVDRIITELRDINREVNRRVKRLIEELEELNRRLNEKAKRDMDEIRRLIEEAAKKLRDDRKLEELEKRLEEIRKRLEEELEKAKRLNEELKKRLDDEARDVERKHKELEDELRRRVRGEDLKRKLEKVLKEARDNLEEVKKRLKEVLERSEENLRRLEEELRRVLEEVREMLKRKKD

SEQ ID NO: 24154 - protein, 178 aa, Artificial Sequence; identical to SEQ ID NO: 24153
  Synthetic sequence.

SEQ ID NO: 24155 - protein, 173 aa, Artificial Sequence
  Synthetic sequence.
KDEEKIKRVLDDVERVLKENEDRNRELLKRVRERLEESRDHLRRVLEDVKRVLEELKLDEKTAKELEDTIRRIADELRKILKRTEDELRKIEKKSREKLKRAREELRKLEKKSKDVDVDELVKRIKDLLKRLNEISRRIAEEIKELLRTHDELNERVVRKLRDLLRKAREKRR

SEQ ID NO: 24156 - protein, 173 aa, Artificial Sequence; identical to SEQ ID NO: 24155
  Synthetic sequence.

SEQ ID NO: 24157 - protein, 173 aa, Artificial Sequence
  Synthetic sequence.
SEEEKLKRVLEDVERDLRRNKRENEKSLEESKKVNDDNRRRNKEALDEVKKVLEDLNLPEDTLTDLEDKLRKIKRDSERENERHKEELDRSEEESRRTLKRAREKLEELRKTSKDKSDEELVDEIRKLLERLNEISERIHRRNKELDDELNEISKRIRERIEDLKRRAEERAR

SEQ ID NO: 24158 - protein, 173 aa, Artificial Sequence; identical to SEQ ID NO: 24157
  Synthetic sequence.

SEQ ID NO: 24159 - protein, 177 aa, Artificial Sequence
  Synthetic sequence.
SEEDEIRRLLKENEDSTRRVEEDNKRLNDENEKSTKRVEDDIRRILERVRRELDDLRRRGAVDEELDKEVERVEREIEETLKRLRERNEESKKRNEEKVKKMKEENKKTKDDIRDLKDRVRREEIEREVREDNKRLEELLERSEREVREDNKRLDEALKKIEKEARELVKRMREKAK

SEQ ID NO: 24160 - protein, 177 aa, Artificial Sequence; identical to SEQ ID NO: 24159
  Synthetic sequence.

SEQ ID NO: 24161 - protein, 177 aa, Artificial Sequence
  Synthetic sequence.
REEEEIRRLLKENEESTRKVEEDNKRLNDENRRSTEKVSRDLEDLNRDTRRVMEEAERRGAVDEDLKREVEEVERRNKELLKELRERNRESLERNRKKVEDLKRRNTETRERIKDLARRVRLEEIKREVEEDNERLKELLKRSEKEVREDNKRLRDVLEKSREEHERLKKRLEEAAK

SEQ ID NO: 24162 - protein, 177 aa, Artificial Sequence; identical to SEQ ID NO: 24161
  Synthetic sequence.

SEQ ID NO: 24163 - protein, 177 aa, Artificial Sequence
  Synthetic sequence.
SEEDEIRKLLEKNEKSTEDVERENERLNDENRKSTEDVKREIDRLLKELREVLDEARKKGAVDEDLDRRVKKIEEDIKRRKDELRKRNEESLERNKRKLDDLRRRNEESKRRIEDLKDRVRLDEIRKTVEEDDKRLKDALERSKREVDDDNRRLKKVLDEIRKTVRTMIEEIKKAEK

SEQ ID NO: 24164 - protein, 177 aa, Artificial Sequence; identical to SEQ ID NO: 24163
  Synthetic sequence.

SEQ ID NO: 24165 - protein, 181 aa, Artificial Sequence
  Synthetic sequence.
SEKEKADDLRRKSKESNDTLRKRLDELKKRSEKNNEELERRLRALLKRLEDVLREITKRTGRDTELDKLKDEARELLERLEKRARDLLKEHEDLKREVEEKARRLLKEHEDLERELERRVRKDGVTDELVKEVEDLNRELEEKVKRLIEEMEELNKRLNDKVKELIEEVERLIKELEDRVR

SEQ ID NO: 24166 - protein, 181 aa, Artificial Sequence; identical to SEQ ID NO: 24165
  Synthetic sequence.

SEQ ID NO: 24167 - protein, 185 aa, Artificial Sequence
  Synthetic sequence.
KDIDELIKRSEDLTRDLERKNKEVVDKIEELLREHEKTNREVVKELRRLLDEVRERVERRGRTREAKEELRRLRELLEEIVRRLEELLRRTRETLTRIKERLDELHEEYKRKLEEIKREVDRRPTSEDLERKVRKAEEDNKRAVERSKTHVDEVRKEVERVLRESKRHAEKLAEDVERMIRELER

SEQ ID NO: 24168 - protein, 185 aa, Artificial Sequence; identical to SEQ ID NO: 24167
  Synthetic sequence.

SEQ ID NO: 24169 - protein, 175 aa, Artificial Sequence
  Synthetic sequence.
STLEKLKKDLDDIDRDLERILDELRRRVERIDEELRKIVERLHRRNKEIIERLRKAKLPREELRKVAEKSRKELEEVKRELEDMHRRSREELERVRKRLEEVHKESKERIDEAIRRDGETREIREAEKKHKKVLDDLRRKLEEVEKRHREVEKELRDRLEESRREHEKVIREETE

SEQ ID NO: 24170 - protein, 175 aa, Artificial Sequence; identical to SEQ ID NO: 24169
  Synthetic sequence.

SEQ ID NO: 24171 - protein, 178 aa, Artificial Sequence
  Synthetic sequence.
RELEELEKEVRKRLKEAEERVRDLAKKSRDLNRELKDRLRRIVEENRDVNRKVKEKKDVDKEKLARELEDINRRTEDRFRRLDEELRRVNKDLKRRIRELVEELKEILKRLRDKVRRDKAGRDEDLRRVEEEIRRVIERLKRLLERVEEENRKSRKELRETLERLHRENEKSLREKET

SEQ ID NO: 24172 - protein, 178 aa, Artificial Sequence; identical to SEQ ID NO: 24171
  Synthetic sequence.

SEQ ID NO: 24173 - protein, 184 aa, Artificial Sequence
  Synthetic sequence.
SLKERLDRVEEKIRKVLEELDRSTSRVEKKVEEVLRELKRSNDEVRKEIKKVLDELRKRGLDEEMKRRLEEIAKELEKILRENEERIKRIADELKELLKRARDRHRRIAEELKKELRKIEKRNIDEKVVDEVAKRMTEELKKLDKENKEIEKEVDDILKRLKDEDKKTVDTLRKILKELDDDAR

SEQ ID NO: 24174 - protein, 184 aa, Artificial Sequence; identical to SEQ ID NO: 24173
  Synthetic sequence.

SEQ ID NO: 24175 - protein, 183 aa, Artificial Sequence
  Synthetic sequence.
SEIEEVEKEMDKLAEESNKLNEEALRRVRKLLRDSNELVRELERRVRELIKRAKDLKREGDKDEEKILEDLERSIKRLMDEARKLLEEYKRRLDELKKELDKLHEEYEREVERIIRKLEREPNSEEVRRKIKEIKDRSEENIKRSRDSVREIKKESDENIKRLKRELERIKKRLEEVLRDLKR

SEQ ID NO: 24176 - protein, 183 aa, Artificial Sequence; identical to SEQ ID NO: 24175
  Synthetic sequence.

SEQ ID NO: 24177 - protein, 179 aa, Artificial Sequence
  Synthetic sequence.
KDEEDLAREVKRVIDELEKLNEELNRAAEELIKRAEEINERVNRKVEKVERDLDKLKKRGELDDELLKEIKKRLEEEEKKAEDAHRKLREELKRALDTAREKNKEIEKRLEEVLKDAKDKTGESETLRKLRDDLRKALKKSEDNIEDVRRRLEEVLERARRNLERVRRRLEEVLRKLKE

SEQ ID NO: 24178 - protein, 179 aa, Artificial Sequence; identical to SEQ ID NO: 24177
  Synthetic sequence.

SEQ ID NO: 24179 - protein, 179 aa, Artificial Sequence
  Synthetic sequence.
SAAERLEKAVRDLIEELKRLNEELNKAVKEIIRRLRELNKKLNEDAERLIRKADELKRRGSSEEVLERLRREAERLAREADKLDRKVKRELEKLEEDIRKLNEEVRKKLRKLEEDARRENKVDKEILDKLREELKRALEESEENLRRLRRELTEVLRESRENLERLKEEVERVLKRLAD

SEQ ID NO: 24180 - protein, 179 aa, Artificial Sequence; identical to SEQ ID NO: 24179
  Synthetic sequence.

SEQ ID NO: 24181 - protein, 180 aa, Artificial Sequence
  Synthetic sequence.
SVVEDLEEKVKRLIERIERENRRLNKDADRLVRELDELNERLNRAIRRLIRKAEEARKRDLDEKDKRKTLKEIRDEIEELKRRAEEDHKRLEEAIKRLVEEARRANEDLRRKLKELEERAQGVEERELERLKRELEKVLRESEKNLEDLERKLKEVLDRSRENAKRLEDELREVLERLRK

SEQ ID NO: 24182 - protein, 180 aa, Artificial Sequence; identical to SEQ ID NO: 24181
  Synthetic sequence.

SEQ ID NO: 24183 - protein, 180 aa, Artificial Sequence
  Synthetic sequence.
SVVEDLAKKVEELIRRLEELNKELNKRVRDLIEKLRDINRKLKREVERLIEEAEEVRRRDLDEKDKRRVLRRLEEVLKDLVRRAKKVNRDVAEEMKKLVEDVKRSNEEVKKTLEKLKEDAKGVDKDELKKLEERAREVLRKSEENLKRVEDELREVLRESEETLKRLEEELRRVLDELRK

SEQ ID NO: 24184 - protein, 180 aa, Artificial Sequence; identical to SEQ ID NO: 24183
  Synthetic sequence.

SEQ ID NO: 24185 - protein, 178 aa, Artificial Sequence
  Synthetic sequence.
DEEKKAEDDIRRIHRRNEDLLRRHREITEEIEKRIRELLREHREITKRLERRLRELKKEGSDERVLDKIRKEMEKRLEDSERKLEKIEREARKTLEDTKRELKKSEEEAKKTIDDVRRKTGDTEELKRIKKRLDESLREVEEDLKRSEKRLRELLKRVKEDLDRSRKRLKEILDELRR

SEQ ID NO: 24186 - protein, 178 aa, Artificial Sequence; identical to SEQ ID NO: 24185
  Synthetic sequence.

SEQ ID NO: 24187 - protein, 178 aa, Artificial Sequence
  Synthetic sequence.
DEVRKLEEDVERLRREVEEENRRLEEEVERLRKEVKERNRELNERVKTLIETAKRLKEAGSSEDVLKKLEETVRKLNEDHKKLTKELEDRARALLEDHRRKLEELKERMDRLREDVRAKRLPEEMLRELEKRLKRLADETRRSNKELKERLERLKDESRDNNRELKERADRLLEKLKE

SEQ ID NO: 24188 - protein, 178 aa, Artificial Sequence; identical to SEQ ID NO: 24187
  Synthetic sequence.

SEQ ID NO: 24189 - protein, 175 aa, Artificial Sequence
  Synthetic sequence.
SEEEELRKLERRLEELMKEYKEALDKLREEHEKTLREYEKRVEDLEREHKKVLKKLVDDRGREDDKVRRYKEEVDRLKDHSRKAKETYEKKVRDLVRHSKEFLDELRRKVKELKDRLTDLDDLRRKVDKLRKEVEDHVRELEKKSRKLVEELKDHLRKLEEESRRLNRELEERSR

SEQ ID NO: 24190 - protein, 175 aa, Artificial Sequence; identical to SEQ ID NO: 24189
  Synthetic sequence.

SEQ ID NO: 24191 - protein, 175 aa, Artificial Sequence
  Synthetic sequence.
SKEDLRRELDRVNEESKKHLDKLRKEAEEVLERLDRANKKIIEDAEEILRRIEKKVRTREDERRKTEEDARRAKEDNDDANRRRKEDAKRRRDKEREDEKRDEDDKRRSDKESKDDTQTRERIKREIEENRKRNEEIARKIKEDIERARRDLERLRKKHEEELEKLKKRVEDADR

SEQ ID NO: 24192 - protein, 175 aa, Artificial Sequence; identical to SEQ ID NO: 24191
  Synthetic sequence.

SEQ ID NO: 24193 - protein, 178 aa, Artificial Sequence
  Synthetic sequence.
DEDRIRKELEKAHKETREESEKLNRDVERVLREVRKASKDLNDKFEEELRKLREKVERDLPPDDEERRDEEEAKKTRDEARREHEKTEEEARRLREEAERRHRRYTEKEKRIRDKIRKDGVDRDKVEEDLRRSRKELEDYARDLEDAIRRIEDRLRRYARKLEEDIKRLARKLEERER

SEQ ID NO: 24194 - protein, 178 aa, Artificial Sequence; identical to SEQ ID NO: 24193
  Synthetic sequence.

SEQ ID NO: 24195 - protein, 183 aa, Artificial Sequence
  Synthetic sequence.
SRTERVKEELKRLVEEYKKRSDDSRRRNEKLTRDYREDSRRVEEELKRIKEDVERELRRRDVERKEELKETEKRMKELEERLREEKKKSKEREDRLRKRNEEEDRRSEKETREIEKETRDRGLRDEEAKKDLKRVRDALDRLTKRNEEKDKENEDRLRKMLRENRERLKEVRERAKRIKEELK

SEQ ID NO: 24196 - protein, 183 aa, Artificial Sequence; identical to SEQ ID NO: 24195
  Synthetic sequence.

SEQ ID NO: 24197 - protein, 181 aa, Artificial Sequence
  Synthetic sequence.
KEKEEIRKALKELLDDLERTLERLKREYDKLRKDLEDTDERIAREHKKIADDLDRTLKEARKKLDERELDKLRKEVEEHNKRVKRRRDEIRKETEKNTKRNEDEERKKREELERKKRDLERKDSESERVLEEVKREVDRIKEELRRTLEENRRRIEEIKKRLEDILRESRERARELKEKLR

SEQ ID NO: 24198 - protein, 181 aa, Artificial Sequence; identical to SEQ ID NO: 24197
  Synthetic sequence.

SEQ ID NO: 24199 - protein, 172 aa, Artificial Sequence
  Synthetic sequence.
SEAETILRRVRRRVEEILDRIRRKLEESKREVEKHRRDVKKVLDDVRRTVKRIKERGRTEERVEKEVEKMMREIKKELDDRHRETKKRSEEFERDLKRTEERVREEEDDTRKKVPNREEVDTRLKEISKELEETLRRVTEEHKRLNRELEEVDRRAEKEVRKILKELRDTTK

SEQ ID NO: 24200 - protein, 172 aa, Artificial Sequence; identical to SEQ ID NO: 24199
  Synthetic sequence.

SEQ ID NO: 24201 - protein, 187 aa, Artificial Sequence
  Synthetic sequence.
SKEEELREVLRRIERELERVNEELREENKRIDKELEEVNRELEERNKRINDTVEDLVRERGDNSKEVEDEARDERRRNDEKNKKYKEEDDRNRKRNDDENKRYEEEVKENKRRLDEEEKEVEARGDVKREELRKIAEKLKKNLEEHKKRVREYLKRLEENLKRHRERVEKYARDLKRDLDRLRERLR

SEQ ID NO: 24202 - protein, 187 aa, Artificial Sequence; identical to SEQ ID NO: 24201
  Synthetic sequence.

SEQ ID NO: 24203 - protein, 187 aa, Artificial Sequence
  Synthetic sequence.
SEEEKLEKKAREIEEALRRVNEELKRRNKEIDERLEEVNRRLEKDLKKIEEDARKLVKDKGDTSEEDKRRLEEIRRELRKREKDYRDDAKRNRDENEEANRRYEKEAEDNDRELKKEEEETRRKGEVDEDELREIIERLERNLERHKRRVDKYLRDLEKNMRDHKRKVDEVVKTLEETLRRLEEEVR

SEQ ID NO: 24204 - protein, 187 aa, Artificial Sequence; identical to SEQ ID NO: 24203
  Synthetic sequence.

SEQ ID NO: 24205 - protein, 179 aa, Artificial Sequence
  Synthetic sequence.
SEEERLREKVKRVEDDLRRLNEEYKEKHKRSEERNKKLLKDLKEVHDRVKKAVEDILRDTPLEEEKLRTIREDLKRVHEENKEAEERIRKRHEELNEESRRDHKRHKEKLDRLKEEEEKSDRPEEEVEERIRRALKESREEIDRLERRNEEEDKKSEETVRRMMERNDRVLKEVEERAR

SEQ ID NO: 24206 - protein, 179 aa, Artificial Sequence; identical to SEQ ID NO: 24205
  Synthetic sequence.

SEQ ID NO: 24207 - protein, 179 aa, Artificial Sequence
  Synthetic sequence.
REEEELRRLVKTVEDEVEKLLRRYRDESEKVKRTLEELNKDLERKHKEVLDRIRDILRKVPLDEEKLRRLDKKLKDLHERNRDEHRKHEKETRDLDEDSKRAERETRKKLKEVRDKRRDSDRPREDVERELEETLRDVARKIERLLEKNKRDLDRSKKRVEEMVRRNEKALKDVEDEIR

SEQ ID NO: 24208 - protein, 179 aa, Artificial Sequence; identical to SEQ ID NO: 24207
  Synthetic sequence.

SEQ ID NO: 24209 - protein, 179 aa, Artificial Sequence
  Synthetic sequence.
SEREDLKRTVDEVKKRLEELIDDYRKTSEEVERRLEELLRRLREDHKRVAETIDDILRRVPLDEKKLTRLREELEELHERNKRKEEKIKKEIDDLREKSERDEKRIRDEIKKLEEEEKRSDRPTEEVKERIRRDLERVKRKIEELKKKNEEDLRRADKKVKDMLEENRRTLEKAKRKAD

SEQ ID NO: 24210 - protein, 179 aa, Artificial Sequence; identical to SEQ ID NO: 24209
  Synthetic sequence.

SEQ ID NO: 24211 - protein, 178 aa, Artificial Sequence
  Synthetic sequence.
SKEDEARKEIKRIEDEIERLRKELEDAHRKLREDLKRLRDENKKVLEDIKRRLKELEKDTDVREEDLRRLRKEVRELDEKSKEEEKRTEKRARDLHETNKRDDKRAEDETRKLKKEADDEPVDDRVRKKLEDELRRLKRTVDELKKRNEKALRDVKRDSERHKEELRRALRKAEEDAR

SEQ ID NO: 24212 - protein, 178 aa, Artificial Sequence; identical to SEQ ID NO: 24211
  Synthetic sequence.

SEQ ID NO: 24213 - protein, 186 aa, Artificial Sequence
  Synthetic sequence.
SLKEELDKAIRELKERHKRINEDLERVVRESRKNHEDINRRLKKLLEELEKRVEEIVRREQTDRDRTEEIKREEDKTRKSDKDKEKKSRDEKREYDRREEEDRRKSERDEERVDEEARDFERKNREEDRVIREIKKRLEDLLRRTEERAKEVKDENRKRNEDTREEVRRVEEELKELLRRIEERER

SEQ ID NO: 24214 - protein, 186 aa, Artificial Sequence; identical to SEQ ID NO: 24213
  Synthetic sequence.

SEQ ID NO: 24215 - protein, 181 aa, Artificial Sequence
  Synthetic sequence.
DEVREIIRELKERIDKIAKEIDDENREHRERLKEIAREVKELIKENRKELKRIADERKDRDRSELKKRVDELRDKNRRDNERTKERAKKIKDDNRERNERTDERVKRIRDETKKRKDDIDLEEEIRKRLDEATKRAEDELRKLKEKNKEVLKELDDRLRKLEDEHRRVREEVDKRLDELRK

SEQ ID NO: 24216 - protein, 181 aa, Artificial Sequence; identical to SEQ ID NO: 24215
  Synthetic sequence.

SEQ ID NO: 24217 - protein, 182 aa, Artificial Sequence
  Synthetic sequence.
DEREKIEKRIRELLKEDKEHTRRNEEKIRRLLDTNRRLLEEIAKKIEEIARELKERKKENRTRETKDRKRRETRKKIEDLREEIERLSRKAEKDTERLERENKDASRRNEERLRELEKRIRDKGLNLEEIRKLVEDYRREHEKLKRRNDELLERYRRAHEEIKKRIDELVERLEEILRKLAE

SEQ ID NO: 24218 - protein, 182 aa, Artificial Sequence; identical to SEQ ID NO: 24217
  Synthetic sequence.

SEQ ID NO: 24219 - protein, 182 aa, Artificial Sequence
  Synthetic sequence.
SEKETIEKRIRDKLKDDEDHTKRNEERIRRALKEDEDRLRKIEEEIRRTLEELEREKRSNRTREEKEERRRRREDRDRRRRERIKRESDKNKRREDERKKKNEEKSRRNDKERREERKDIKRRGLDAEDIERLEERYRREHERLKRRNEDLSREYEERHERLKREIDKLEEDLKRETERAAR

SEQ ID NO: 24220 - protein, 182 aa, Artificial Sequence; identical to SEQ ID NO: 24219
  Synthetic sequence.

SEQ ID NO: 24221 - protein, 182 aa, Artificial Sequence
  Synthetic sequence.
SEKEKIKKEIEDARREDEKHTEKNKRDIERDERRDEETLKEIEERIRRTLRELEKDRESNRTREEKKKKREETERRRRKLREDIERKKEENKKKEREREERNKEFNRENKRRAEERKRDIERRGLNAEDIERLEREYEKDHKRLKDENDDLTEKYRRRHREIDERIKDLERELDRRIKEIDR

SEQ ID NO: 24222 - protein, 182 aa, Artificial Sequence; identical to SEQ ID NO: 24221
  Synthetic sequence.

SEQ ID NO: 24223 - protein, 187 aa, Artificial Sequence
  Synthetic sequence.
DVRDRVRELRRRLEEETKKVDDENRKIHEELKRVADESRKNNERLNRELRKEIRRVEKDLGEVREEKRRRVKKTTDDTEKEDEDRNREYDREEKEVEERDRKKNKERKDRKEEVDRRTEEEERRRKPDEEALRRLEETLKEVKDELKTELDDSRREVEEVKRSNKEKNERSERRLKEVRDRLREERK

SEQ ID NO: 24224 - protein, 187 aa, Artificial Sequence; identical to SEQ ID NO: 24223
  Synthetic sequence.

SEQ ID NO: 24225 - protein, 183 aa, Artificial Sequence
  Synthetic sequence.
SLEDSAREIEKRLRDLHRRYREDHERIREDLERLKTEYEKAHRDIKRELDRLREELERANRVREKEKEDTKREEEERHREVEEDKKRKDEELRRAHEEVKKKEDENKERDDRFKEETKRSDRPEKEMLDRLEEHVDRNEKDIKKALDENRKRLDDIRRKIKKALDENREELKRIERRIRELKK

SEQ ID NO: 24226 - protein, 183 aa, Artificial Sequence; identical to SEQ ID NO: 24225
  Synthetic sequence.

SEQ ID NO: 24227 - protein, 180 aa, Artificial Sequence
  Synthetic sequence.
SAEETTEDLKRRLKELDEKVKEVLKRNEDRVRELEEDVRRNLKKNEDDAREVEERLKTSGGGDEEELRKRSEEYKKRMEEVKKRLEDESKKYKDEVRDVKRRLEEERKEVEDRTRTTDVKGEELLKEVEDRVREIIKRIEEKLKRLNDRTREFIERIRRELRKVNEETKKMIKELKEEED

SEQ ID NO: 24228 - protein, 180 aa, Artificial Sequence; identical to SEQ ID NO: 24227
  Synthetic sequence.

SEQ ID NO: 24229 - protein, 175 aa, Artificial Sequence
  Synthetic sequence.
SKAEKVLEKAREVVETIKRLVEEVLRHSEDVVRRITDLVRRLLEENERVVREIKRLADEGSRGESEVKKLSDDMRKRNRDVEREVRELSERDREELRKVKEEIKERLDRIREELERSEVDERVIKKIEDLLKKVDDEAKKMLEEVERLNKEVNDRLKRVLEEAERLHEEVNRRVK

SEQ ID NO: 24230 - protein, 175 aa, Artificial Sequence; identical to SEQ ID NO: 24229
  Synthetic sequence.

SEQ ID NO: 24231 - protein, 174 aa, Artificial Sequence
  Synthetic sequence.
KELEDVIEEVKKLLKTVNEESRRVAEEVRKLIREVSEELTEVIRRVERLVEEVATRVDRKEDLDRVRKRIEELVRRVEEVNRRSKRRIEELEDELRKVDEESRETIERLIDLLRRGLDLDTVLRRAEDIVRKNRKLAEEVLRRVKKIVEENRKIAKEVLDDVRKLVEDVLRRAT

SEQ ID NO: 24232 - protein, 174 aa, Artificial Sequence; identical to SEQ ID NO: 24231
  Synthetic sequence.

SEQ ID NO: 24233 - protein, 174 aa, Artificial Sequence
  Synthetic sequence.
EELERVIEEVRKLVEEAEKKSREVIKTVKELMDDVNRKSKKVLDDVRRLIEKVRREVTNEEELRKLTETIRKLIEDLKRMDEKSEDEIRRLVEELRRLNEKSKRDIERLIELLKRGLDADDALRRVKEIVERNEEVVKELLKRAEDIVRTNEKLVKDVLDTVRKLVKKVKDDED

SEQ ID NO: 24234 - protein, 174 aa, Artificial Sequence; identical to SEQ ID NO: 24233
  Synthetic sequence.

SEQ ID NO: 24235 - protein, 177 aa, Artificial Sequence
  Synthetic sequence.
SEAEDALRKAKRLADEDRKAAKRALEEAKKSAEEVKKAAKRALEEAKRIAEDVKRAADEGRDEEDARRILEEARRAIEELAKRLKKILDDNERETKRLAEELRKINEDTKREIERLEKDARGEEAAREAKKLAKDAADVSRKAAKDAKDLSKEAADVARKAAEDARRLAEEAARKAK

SEQ ID NO: 24236 - protein, 177 aa, Artificial Sequence; identical to SEQ ID NO: 24235
  Synthetic sequence.

SEQ ID NO: 24237 - protein, 182 aa, Artificial Sequence
  Synthetic sequence.
SDAEDVVRKVKRLVDELRRHSKELLKEVEDLVRDLVRHSEEVVKRVEDLVRRLEELVRRGDAREEVLRKVEEDVKRLNKEDKDRVEELRRRVKKLSEDNEKLLEEARERVTRLIEDLRRRSDTEEVRRVLREIREVLKKVAEDSRKVNEDIRRVLEEAKKTSDKVNTDSEEVLRTVARRFED

SEQ ID NO: 24238 - protein, 182 aa, Artificial Sequence; identical to SEQ ID NO: 24237
  Synthetic sequence.

SEQ ID NO: 24239 - protein, 182 aa, Artificial Sequence
  Synthetic sequence.
SRAERLLEDVRRLLEESLRNSERVLEEVRKLIEENLRHSRKVVDEVRRLLEEVLRVVERGDIRREDVKRAEKEVEDLNDENRRHSDDVRKTVEKLDEDNKKLLKEVKERVEKLIKDLKDEVDREDVRRVLEAIKEDLKRVEDANREINRRSEELLREAEKRSRDIDKESRDLVRKVKKDLEK

SEQ ID NO: 24240 - protein, 182 aa, Artificial Sequence; identical to SEQ ID NO: 24239
  Synthetic sequence.

SEQ ID NO: 24241 - protein, 182 aa, Artificial Sequence
  Synthetic sequence.
SRAEEVLKDVKRLVDENRRHSERVVEEVRKLVTENKRHSERVVEEVRRLVEELERARRRGDIREEDLERVKREVEKLNRDNKDHSRKLKRRVDELNKRDKEHSDDLKRRVERLLDELRKESDDKDVRKVLKDIREVLERVEEDSERVNRESKKVLDDVKKESDEADDESRRVLEEVDRKARK

SEQ ID NO: 24242 - protein, 182 aa, Artificial Sequence; identical to SEQ ID NO: 24241
  Synthetic sequence.

SEQ ID NO: 24243 - protein, 182 aa, Artificial Sequence
  Synthetic sequence.
DRVEELLKTVEKLVRDNEKHSRDVVKEVRRLAEENERHSERVVREVRRLVKELEDMKRRGDIREEELKDAERKVKELNKRNKEHSDDLRRRVEELNRDNRRHSEELEETVRRLLEELRKESDRREVREVLKRIEEILKDVKRKSEEVNRESERVLREVEKRSEDADRESKKVLDDVKEKARR

SEQ ID NO: 24244 - protein, 182 aa, Artificial Sequence; identical to SEQ ID NO: 24243
  Synthetic sequence.

SEQ ID NO: 24245 - protein, 177 aa, Artificial Sequence
  Synthetic sequence.
SEEEVLKEIDEVSRDLERKNKTINEEIKKVSDRVAEEVRRVLEDIKRTSKDAVDDVRTRGLDETDIERHRRTSKRLLDELRRLLEEHKRKSERISREDKKILDEHRKFSEEVRKLIKDGADLEKVVREVEESVKESEERSRRLLEEVRRSVKKLEEDVTRLLEENKKSVDDIKERAR

SEQ ID NO: 24246 - protein, 177 aa, Artificial Sequence; identical to SEQ ID NO: 24245
  Synthetic sequence.

SEQ ID NO: 24247 - protein, 177 aa, Artificial Sequence
  Synthetic sequence.
REEEVLEEIRRVVEEVRRENERINKEIRERSEDLRRKVKRILEKAKKVLDDVDERAKREGLDEKVIRDLRRRVEELLDRLRKRVEEHEKFSREISKRDRDIIEELKKTVERIEKLLKDGMDVDEVLKEVEDLVRESVRLSEDLLREVRESVERLVDEARKLVREIERLVKEAVDTVR

SEQ ID NO: 24248 - protein, 177 aa, Artificial Sequence; identical to SEQ ID NO: 24247
  Synthetic sequence.

SEQ ID NO: 24249 - protein, 177 aa, Artificial Sequence
  Synthetic sequence.
KEEEVLKEAEEVSRRAEEKNRRINDEVRRVVRRVEETVTRVLEDVERTSKEAKERVERAGLDRKDIRRHEELSKKLMEDLKELLRDARRKVTRLSEEDKEIIDRHRDKSRKIRKMIKDGSDLDTVVEEIKDSVRKSVERSRELLERVERIVTELEKRVDELVRENEDSVRRIDERVR

SEQ ID NO: 24250 - protein, 177 aa, Artificial Sequence; identical to SEQ ID NO: 24249
  Synthetic sequence.

SEQ ID NO: 24251 - protein, 178 aa, Artificial Sequence
  Synthetic sequence.
SEAEKIVEEAKRLADKARELAERSVRHSEKLARDSEKAAREAVKEAKDLADKARDLAAKRRDEDLLRKIKEDLERAARKIKRLLEELKKRHERDNRESKKLLDKIREDLERALEKAERRAKAKEALDTARKILRDAEEAAKEAHKEANRLNKEAEEAAKRAADEARKILKKAEEDARR

SEQ ID NO: 24252 - protein, 178 aa, Artificial Sequence; identical to SEQ ID NO: 24251
  Synthetic sequence.

SEQ ID NO: 24253 - protein, 184 aa, Artificial Sequence
  Synthetic sequence.
DDLEEIVKRVRRIVEEIRRLVEELVRRDKRIVDEIKRLLEEDKRKVDEIVKEIEEVVRRGGDDKDKLKRRVEELLKDVERHTEELRKEVERLLDESRKLNKEVRDTVEKLLEDVRREIETISREEEEVRRVLKEVKDILKTVRDEVEEANEDAKRLNEEVREEAERVLRDTKRILDEVRKEADK

SEQ ID NO: 24254 - protein, 184 aa, Artificial Sequence; identical to SEQ ID NO: 24253
  Synthetic sequence.

SEQ ID NO: 24255 - protein, 178 aa, Artificial Sequence
  Synthetic sequence.
REKEVLEEVRDIVRRASERSKEALDESREILKTVDDEVRRVLEDSRRLLEEVRKRVEDNNVDEDIRRRVKEVEDRIRESLERTKRTVDKVKEEIRKSLEDTKRANEEIVRRIEELIKRREGDAREIVERVRRLVDTSRRLVEEDVRRVREVVKELRKLLREDVKRVRDVVEELAKEAT

SEQ ID NO: 24256 - protein, 178 aa, Artificial Sequence; identical to SEQ ID NO: 24255
  Synthetic sequence.

SEQ ID NO: 24257 - protein, 176 aa, Artificial Sequence
  Synthetic sequence.
SEMEDAKRKIEDLVRRVKDSLRDAERRIREVVERVERSLKEVEDRSRELLEDVKREGDTEEVKKLVRESERLIDELRRRNEDIKRRIKELIDELRKRNDDIVRRIEKLIEDLKRSTDDESVRDAVREVEDLIRRLTEDNKRLVEEVKRLVDRASEENKKLNDTSKKVVDEIREREK

SEQ ID NO: 24258 - protein, 176 aa, Artificial Sequence; identical to SEQ ID NO: 24257
  Synthetic sequence.

SEQ ID NO: 24259 - protein, 176 aa, Artificial Sequence
  Synthetic sequence.
EELERVKEEIDKLVKEVRRSLKDVERRSAELLKEVEKSLEEVERESKKVLDEVRKAGQTEEVKKLVDRSKKLIDDLRDKNRKIVDTSRKLIEDLKRRNEEIEKEIRDRIRKLSRTTDDKAVKTLLEDVRRLVREATEDNKRVNDESRELVERASRDNRRVNKESRDIVRRLEERTK

SEQ ID NO: 24260 - protein, 176 aa, Artificial Sequence; identical to SEQ ID NO: 24259
  Synthetic sequence.

SEQ ID NO: 24261 - protein, 176 aa, Artificial Sequence
  Synthetic sequence.
SELEEVERRVEKVVKEVRDSLKKVKEDIEKVLRESHKRLRDVEREVRRVLEKVRRRGDTEEVRKLEKEIRELLDELRKKNEEIRKEIEELIKTVKRINEEIEKEIRKLLEDLKDSTDDKTVRDVLRRVRKLVEDATRANEKALDDVRKLVEKSRKLVEDVLERVRRLVKELEERTT

SEQ ID NO: 24262 - protein, 176 aa, Artificial Sequence; identical to SEQ ID NO: 24261
  Synthetic sequence.

SEQ ID NO: 24263 - protein, 186 aa, Artificial Sequence
  Synthetic sequence.
DEVEDVVRKVRDLVRRVREAVRRLLEENRDLVRKLIEDSERLVREVEKLIKEVEDTVKDRKDDEELTRILEELKRRVDKLVEDDKKINKEIDDESKRLVEELEELLREVRREVEELVEDLRRKGGEEREELERVIKEIKDVVREVTKVVEKVIREAEKLNEDVNRRSEEVNKRIKKLVEDVARRVE

SEQ ID NO: 24264 - protein, 186 aa, Artificial Sequence; identical to SEQ ID NO: 24263
  Synthetic sequence.

SEQ ID NO: 24265 - protein, 174 aa, Artificial Sequence
  Synthetic sequence.
DEAEEVKKLIDKVLREVEEVVRRVNKRDKDLLREVEKVVRDVNREDKRVLEEVERSGVSEEVVKELRKLSKETHDESRRLLKELKELSEKTHKESRDLLRTAEEIVRRLKKVLDDGGPVEEIVREIEKVAEDIMRRNEELVKESEDVVRKIVRDNERLAEDSKRVVEEAVRREK

SEQ ID NO: 24266 - protein, 174 aa, Artificial Sequence; identical to SEQ ID NO: 24265
  Synthetic sequence.

SEQ ID NO: 24267 - protein, 182 aa, Artificial Sequence
  Synthetic sequence.
SAIDRVRKTLEKLVERLERVLEESSKAVEDVKEKVERLLRELRERTKRIVDEVEDMVRKANKPDDEVRDRIRRVEKENEDLVREVEDIIRKLEEKNRRLNEEIRRLIEEIRRELKELADRGVDEEELDRLVKKVEDLVRRLEELARKSLKDIKKLLKDIEDRLRKSVEKSRRLAEEIKERLR

SEQ ID NO: 24268 - protein, 182 aa, Artificial Sequence; identical to SEQ ID NO: 24267
  Synthetic sequence.

SEQ ID NO: 24269 - protein, 179 aa, Artificial Sequence
  Synthetic sequence.
DKADEAVKRVKDLIDDLKRRIDEVVKRSREVVRDIEKHAEDVVKESRRVVDEIKKLVTRGDIREEDVRRLVKRLEELNRRHEERSRRLVEELKRLNDKLNEEVRRIKRRIEDLVRRLREEGVIREEVEERVREVLRRVEKRVKEVNEESERTIRELERVSRRVNEESRRSIEEAKRAAD

SEQ ID NO: 24270 - protein, 179 aa, Artificial Sequence; identical to SEQ ID NO: 24269
  Synthetic sequence.

SEQ ID NO: 24271 - protein, 181 aa, Artificial Sequence
  Synthetic sequence.
DAVERAKEESKRVLEDAERVVRRVEEEVRKMERKAEESLKDVRRKSEEVIRKVEEVVRRKGAPREDIKEVEDRNRKLIEDNERHLREVVRELRELLKRLRDELERMKRRNKKLLDELDRVESDKEVREVVEDSRRSVRRVEELVEKVVRDVKKLIEDHERRNRESVRESERSIKELEEKVR

SEQ ID NO: 24272 - protein, 181 aa, Artificial Sequence; identical to SEQ ID NO: 24271
  Synthetic sequence.

SEQ ID NO: 24273 - protein, 185 aa, Artificial Sequence
  Synthetic sequence.
DDLERVLREVKRLVEENEKKVRRIVEESRELVERNKELLRRVVEEVRRLVKEVRDILRNVRGDDELERVLRRVEEEIRRLLTDLRRSNKRVAEELKRLNEELERSNREVERRIRELEERLREKVRDEDKLREVRERIKRLLDRSHEAVRRASEKSKRSLEESHRAVREVEKRLKELLEDVREDVR

SEQ ID NO: 24274 - protein, 185 aa, Artificial Sequence; identical to SEQ ID NO: 24273
  Synthetic sequence.

SEQ ID NO: 24275 - protein, 185 aa, Artificial Sequence
  Synthetic sequence.
DRLEEVVERVERLVRENVKRLEKVAEENRELVERNKRRLEEIVRRVRELIERAKRIVRDNTGDEELREVLRRVADEIRRLLEELDRSNKEVAKRSKESIEDLRRSNKKVEEDIRRLLEKLRRDVRDEDKLRDVERRAKELLEESHRVIRTVEERSKTVLADSHRVIEDVRRRLEELLREVAEEVR

SEQ ID NO: 24276 - protein, 185 aa, Artificial Sequence; identical to SEQ ID NO: 24275
  Synthetic sequence.

SEQ ID NO: 24277 - protein, 181 aa, Artificial Sequence
  Synthetic sequence.
DEADEVVKEVEDRVRKLVRRLEESAKKSKELVERILKRVEDSVRRSEELVERIKREVERRRDEELKKRVKELLKKSTEDNDRLRKDVERLLRESNKENRDLVRDIERELEEIKRTLEDLRRRGKVTEKVEEMLRRVLEEVRRAVRKSSEDNKRSVEEVKRVLEKAEEDNRRVVEEVDRELK

SEQ ID NO: 24278 - protein, 181 aa, Artificial Sequence; identical to SEQ ID NO: 24277
  Synthetic sequence.

SEQ ID NO: 24279 - protein, 183 aa, Artificial Sequence
  Synthetic sequence.
SKLEEVEKMVRKVIEDSRRVNEEVNRRSEEVVRELEKVHREVNDASRRVVEKARRVLKEGEDERLRREVERIIEEIRELNERDRKRVEEIRKEIEDLNRDLNRRSKESEDRLRKLLEDATRNNVTKEADEVVERAERISEENKRRVEDVARKSKELVEDVRRHSEEVVRRVEELVKEVEERVR

SEQ ID NO: 24280 - protein, 183 aa, Artificial Sequence; identical to SEQ ID NO: 24279
  Synthetic sequence.

SEQ ID NO: 24281 - protein, 183 aa, Artificial Sequence
  Synthetic sequence.
SLLEDVKRTVREVVRESRRVHKEVNDDSRRVLKRSDEAHERVNRDSRRVIERIREVLSRGEEERLKKKVEDVEREIKKLNDEDRKTVEDSKRRIEELNKRDKEKVEDSERKLRRLLEEIERRNVTEEVRELAEDARRISEDNRRNSKRVVDRVREISKENEDNSRRVVDRVRKLAEEVEREVR

SEQ ID NO: 24282 - protein, 183 aa, Artificial Sequence; identical to SEQ ID NO: 24281
  Synthetic sequence.

SEQ ID NO: 24283 - protein, 183 aa, Artificial Sequence
  Synthetic sequence.
DDLERVKETVKKVIKRSRDSTKKVADTLREVVRESERVHREVNETSRRVEEEAKRVASRGDDERLKEDLKRVVDRIRKLNKEDKDRVDKSRRDIEKLLKDLEDKNRELEREMRKLLEEIERRNVTEEVDKLADRARRLVAKSEEDNKRVMKEVTDISKENEDNSRRVVDEVRKLVEEVRRRLE

SEQ ID NO: 24284 - protein, 183 aa, Artificial Sequence; identical to SEQ ID NO: 24283
  Synthetic sequence.

SEQ ID NO: 24285 - protein, 177 aa, Artificial Sequence
  Synthetic sequence.
DKVERVVEEIRDLMRRVEELIKKAADDNRKLVKEVEDLIRDAVRDSERLVAEVEKLLTKERSEDLVRTIRELLKRNHDRLRKLEEEIKEMLKRLNEETRTLVEKIERDLKRVEEKVERTGVSDEVRKEVKRVIKAVEKVIEDVERTSEEARRRVEKVIKEVEEKNREVIKRVEDRIR

SEQ ID NO: 24286 - protein, 177 aa, Artificial Sequence; identical to SEQ ID NO: 24285
  Synthetic sequence.

SEQ ID NO: 24287 - protein, 178 aa, Artificial Sequence
  Synthetic sequence.
SEADKLVEEVKDVVREDKRRVKEIVETVRELVRRSRETVRRIVETVEEVVRRLLELLRKGEPKEELEREARELLEELRERLERLHKRSKEVLKRLRDRLRKSLRETEELLRRIKEELEKRNLEEKVEEVLRRVKRESEKVIEDVERELKRVEDDDRRVIEEVKKRLKRVLERVRTESK

SEQ ID NO: 24288 - protein, 178 aa, Artificial Sequence; identical to SEQ ID NO: 24287
  Synthetic sequence.

SEQ ID NO: 24289 - protein, 178 aa, Artificial Sequence
  Synthetic sequence.
READELVDRVKKVVEEDKRLSKELVDEIERVVDELEKVSRELVERVRDLVRRLLEVAAKGEPREELLDRAKKVLDKNREDDKRLNDEARKVLDDNRKKDKKSNDDTKRTLDKIRKDLEDRNAEDKVEKVLKRVEEESREASERNERVIERVERRVDEASKRNEDEIDKVRKEVERVAT

SEQ ID NO: 24290 - protein, 178 aa, Artificial Sequence; identical to SEQ ID NO: 24289
  Synthetic sequence.

SEQ ID NO: 24291 - protein, 178 aa, Artificial Sequence
  Synthetic sequence.
EEVKELVERVRRVVDDLRKKLEKIVEEVRDVVRKDEERSRKLVEDVKDLVRKILEVLRKGEPREELKERVDRELKKNREDDKRSNEDTERLLREIKERLDRLLEDARRLLKEIEDEARKDNLDDDLRRVLKEVDEEVRKVIEDVARVLEEVKRRSDRASRENEEVIKRVTEEVKRVVK

SEQ ID NO: 24292 - protein, 178 aa, Artificial Sequence; identical to SEQ ID NO: 24291
  Synthetic sequence.

SEQ ID NO: 24293 - protein, 184 aa, Artificial Sequence
  Synthetic sequence.
DRVEKLVEEVKRHVTEVLKTVEDLARRIRDHVRKVEDTSRELVKEIKRLVEEILDRVRKKKDKRELLKELLDRLKKAVKKIRDTNRELNKSNEKLVRDIRDTLRKLTDSNRRLLEDIDKKLEEAPEDVVRELRRVLRESNEKLKEVVDRLRKVLEESTKRVEDASRRVERVLEKVEEDVKREAT

SEQ ID NO: 24294 - protein, 184 aa, Artificial Sequence; identical to SEQ ID NO: 24293
  Synthetic sequence.

SEQ ID NO: 24295 - protein, 184 aa, Artificial Sequence
  Synthetic sequence.
SEVEELKERIREIVERIEETVRRLAKRVEDHVREVEKDSKRLADEIRDFVRRITDEVRKKKDDKDRLDKLKKDLDRLLEEIRRRNEELNKSNEDLLREIKERLDKLREELKETVKEIEKKLKDVEKRLVDKLRKVLEEVREEVERVVRELEEVLRRSTKRVEDASRELERVLKEVKETLEREVR

SEQ ID NO: 24296 - protein, 184 aa, Artificial Sequence; identical to SEQ ID NO: 24295
  Synthetic sequence.

SEQ ID NO: 24297 - protein, 184 aa, Artificial Sequence
  Synthetic sequence.
DRVEALVDEVKRHVTELLKTAERLADEVREHVDDVRKKSKELVDEIRRVVEKILDEVRKKKDDKDRLKKLKEDLKRLVEEIRRTNKELNESNKKLLDRIRETAKKMEESNRRLLEEIEKKLKDAPEEVVRELRRVLRESNEELKKVVTELEERLKDSNEEVKKASAEVRKVLEEVRADVDREVK

SEQ ID NO: 24298 - protein, 184 aa, Artificial Sequence; identical to SEQ ID NO: 24297
  Synthetic sequence.

SEQ ID NO: 24299 - protein, 178 aa, Artificial Sequence
  Synthetic sequence.
SLVEKLRRVLEEVRRTSEKVIRDVKEVNKRSEDKTREIVRRLEEVNKESKERLDRAGVPEKLKKDLTDLIRKSEKLLRENEKRNRDLIRESERLIEKNKRDNDRLIKEVEDVIERKKDKKELAEKLAREVKRLVDESKKNMDKSVEDSRRLVRESEENVRKSVEDSRRLVKRAVEETK

SEQ ID NO: 24300 - protein, 178 aa, Artificial Sequence; identical to SEQ ID NO: 24299
  Synthetic sequence.

SEQ ID NO: 24301 - protein, 183 aa, Artificial Sequence
  Synthetic sequence.
RVDEDLRRVLKEVKERNEEVVRRSKEETDRVEEDIERVIRDSERVSEEVKRRVDKAKKDVDEEEARKLEKEMKDIIDEDKELLDRLREALERLKKEDEDLIEESERKTKELEREVKKLEDEGISEELAKEVVKRVRELVDRSRRLMTESVRKVRELVEDIRRRVRESVEKLRRLVEEIERRIR

SEQ ID NO: 24302 - protein, 183 aa, Artificial Sequence; identical to SEQ ID NO: 24301
  Synthetic sequence.

SEQ ID NO: 24303 - protein, 184 aa, Artificial Sequence
  Synthetic sequence.
KEVEKLVKDVERMVEESLKENERLVKKSDELVKESEKRNKELAERSRRLVKEITDRLAEERTEEVEKRIRELLKRSHEEVRRLVETDEKLLRDSHKEARDLVRTDERLAKRVREEVDKLAKKISDEDVLRDLRRVVEEVTEKIKEVNRRSEEANKRSKDRIEEVNRRSEKVNEDVEREIERALR

SEQ ID NO: 24304 - protein, 184 aa, Artificial Sequence; identical to SEQ ID NO: 24303
  Synthetic sequence.

SEQ ID NO: 24305 - protein, 184 aa, Artificial Sequence
  Synthetic sequence.
DELEKAVERVKDIVRKSLELLKRLADRVRDIVREILDEVRRNVEEVRRIVKEIVEEVRRRKDEEVRRKVEEVLKRVRESNEELERRVREKLRKVEEEVKRIKERSDKLLRDVERELEDVRRRLDDEEALKRLERVVREVAEESDRANKELDRVVEEVKERVERVLRESNKVVKEVEDRVREETR

SEQ ID NO: 24306 - protein, 184 aa, Artificial Sequence; identical to SEQ ID NO: 24305
  Synthetic sequence.

SEQ ID NO: 24307 - protein, 177 aa, Artificial Sequence
  Synthetic sequence.
SVKETVEEEVRRVSDEDRRINRDVERVSEESNRRLDKVHKELEEVVKEVLKELDDTGLQRDLVERVKEILKRLLDEDREKVKKVKREDEELLKRLREFSKRVNDTLKELLDRLRRSTDEETARRVVEEARRIVAESKELVKEVVRRSDELVRDVEKHSRDVAKTVRKIVTDVARRTR

SEQ ID NO: 24308 - protein, 177 aa, Artificial Sequence; identical to SEQ ID NO: 24307
  Synthetic sequence.

SEQ ID NO: 24309 - protein, 181 aa, Artificial Sequence
  Synthetic sequence.
SAEETLEKVIRDVEEEDKKAHEDSRRVIETVKEEIDRVHKDSKRKIDEVKERIRREVRDEETMKKVEEELEKLLKEDRDIIKEIKERLDELLKDDKRISDESRKRLKELLDRLREVSRRENLEERVRRIVKEVREIVKRSKERSDEIVKEVKRIVKEALDLSREIVERVERIVREVVERAR

SEQ ID NO: 24310 - protein, 181 aa, Artificial Sequence; identical to SEQ ID NO: 24309
  Synthetic sequence.

SEQ ID NO: 24311 - protein, 181 aa, Artificial Sequence
  Synthetic sequence.
EADERLRKRLKEVNERDKKAHEDSKRAIDRVREEDKRVLDTVREEIKRVKDEIRRALRDEEMVKKVEEELDRLLRELERLSEKSDKDLRELLETDRRISEESHRRSRELIRRVEEVSREPELERLVREVVRENEELVTRSEELSRRIVEEVKRIVDESRKRAKEIVDEVRKRVKELVDTDK

SEQ ID NO: 24312 - protein, 181 aa, Artificial Sequence; identical to SEQ ID NO: 24311
  Synthetic sequence.

SEQ ID NO: 24313 - protein, 181 aa, Artificial Sequence
  Synthetic sequence.
DVREKLEKVLREVERRVEKASRESKETLDRVRKRLKDVSDESKRELERVKKRVDDADKRREELRRIVEEAEKKLRELLKRDKDSNDELEKRLRDLLEKDKESLKELEKRLRDLKRRADEIDDKKVIEELVEEVRRLVTEHERLSRELVDRVEKLVARHEELSKKLVTDAERIVKEVEERAK

SEQ ID NO: 24314 - protein, 181 aa, Artificial Sequence; identical to SEQ ID NO: 24313
  Synthetic sequence.

SEQ ID NO: 24315 - protein, 181 aa, Artificial Sequence
  Synthetic sequence.
SALERLREVLERVLRRVKKVTDDARRVNERVNRKVDRVSEDSERELRRVLKRVREASKDREELRKIVKKVEEDLKRLLEEDRRSNKELRERSKKTLDDLRRSDKKLEDDLKRLKEEAERVDDEEVLRELVERAKKLVDDHLELVERLVRESEKLVEDHLRRSKKIVEDVKRIVEDVERRVK

SEQ ID NO: 24316 - protein, 181 aa, Artificial Sequence; identical to SEQ ID NO: 24315
  Synthetic sequence.

SEQ ID NO: 24317 - protein, 181 aa, Artificial Sequence
  Synthetic sequence.
DEVDKARKEVDRVVKESRKLVEKNVREVEEVVKTVEKLVEDVIRRVEDVVREVKELVTRGDGREERLTRIKEELRDLLRRLKETIDKLKEELERSNEELKRRLDDLNRKLKELLEDLSKRVDEELLDRVRKVVEDVSRKSKKALDESHEVVKRVKDRADEVLDKVRRAVEEVERRIETEAR

SEQ ID NO: 24318 - protein, 181 aa, Artificial Sequence; identical to SEQ ID NO: 24317
  Synthetic sequence.

SEQ ID NO: 24319 - protein, 181 aa, Artificial Sequence
  Synthetic sequence.
DEVEKAVKEVERVVREVKELVDRNIDEVRKVVEDSKRLIDELVEDAKRVVKRVKELRDRGDGREEELRDIIRRLRKKLKELAERLEKLNRDLEKSNRELKKRIDELKRRLDELLKDLAKRVEEELLDRVRRVVEEVKKEADRLLEESHRVVREVSERSKRALEEVKRVVDEVTERIKKDKD

SEQ ID NO: 24320 - protein, 181 aa, Artificial Sequence; identical to SEQ ID NO: 24319
  Synthetic sequence.

SEQ ID NO: 24321 - protein, 175 aa, Artificial Sequence
  Synthetic sequence.
STKEKLDDVLRRVEEKAREVVEDNRRADRDVHRKARKVVEELRRVDEEVHETVKRVDAKEELRRELKKLLEDSNRLTKEVEDRIEKLLRDSNRSTKENEKRIRELEKEMRDLAREGGRRVDEVVDRLRRLVEEVLRHSKKNSRESDEMVRRVTEEVREVVKESKERVDDVLKRVE

SEQ ID NO: 24322 - protein, 175 aa, Artificial Sequence; identical to SEQ ID NO: 24321
  Synthetic sequence.

SEQ ID NO: 24323 - protein, 181 aa, Artificial Sequence
  Synthetic sequence.
KKVEEIMERLRRVAKEIKERVDRLVEKNRKSAKDLLDTIEDIVRKNRDLAEKIKDLARRRRDEKLKREVEEILKELHDRNRKLLEDVRKKLRENEEETEELKKRIEDILRRVADEIRKIEEDGVDKEKLRRVLREVEEVVRRVKKKLDDSVRELREIIRRAERELREVDEEVRKVVEDVKR

SEQ ID NO: 24324 - protein, 181 aa, Artificial Sequence; identical to SEQ ID NO: 24323
  Synthetic sequence.

SEQ ID NO: 24325 - protein, 180 aa, Artificial Sequence
  Synthetic sequence.
RVREELKKVEEEVREVVRRAKEKTRRVLEEMRKVVKDVDDESKRVVDEVKKVLEEVRARGLDTEELKEIEERIKRKLEEINERNRDLLRRVERLVREDERRIDEILTEIKRTVDEIRDLTEEEVVKKVVDDIRKLAKDMDDHSKEVVDRIREVARRIEELNRELVRDLKDEVRRVKEKAK

SEQ ID NO: 24326 - protein, 180 aa, Artificial Sequence; identical to SEQ ID NO: 24325
  Synthetic sequence.

SEQ ID NO: 24327 - protein, 180 aa, Artificial Sequence
  Synthetic sequence.
SVRETLKTVEEEVKRVIDRARKRDERVVREVERVLRDAMRKDEDVNRDVERVLRDVVRRGLDTEKLKRIKEEIDKLSTENRKRIEDLLREIRKLSEESDRRLKEVEKEIRERVEEIRRRTDKDVFKRVVEELRRLVKRVEELVTRTVEEIDRIAKEVTRHSEETVRRLKKLVKTVTDEAN

SEQ ID NO: 24328 - protein, 180 aa, Artificial Sequence; identical to SEQ ID NO: 24327
  Synthetic sequence.

SEQ ID NO: 24329 - protein, 185 aa, Artificial Sequence
  Synthetic sequence.
SSVREVVKEARDIAKENLERVKKTVKENRDLARKVAEDVKKSVEELRKLAEDVEEIARKATGDEDLERVLREVEERIEDLHRRSEEIAREVRKRSRESHERTKEITTDSRRRIEELLKKVKDEGVEEELEKELRTVVREVEEVLRRSEEDDRRVHKEAEDVIKKVEEDDKEVVDRVKKVIRDVRT

SEQ ID NO: 24330 - protein, 185 aa, Artificial Sequence; identical to SEQ ID NO: 24329
  Synthetic sequence.

SEQ ID NO: 24331 - protein, 185 aa, Artificial Sequence
  Synthetic sequence.
SEVEKIVKEAEDLVREVKRRVEDTVRKNRELADRVRKEVDKSVRELRELVKRVLDIAKDLTGDEELERVLRTVRERIKELHERSKKIIEDVRRKSEDSHRKTKKIADDVRRKLDKLRRDIERRGVSEELRRELERVIKKVEEVIRKAEEDDRTVHRELNKIIKDVEDKDRTVVEEVERVIEEAER

SEQ ID NO: 24332 - protein, 185 aa, Artificial Sequence; identical to SEQ ID NO: 24331
  Synthetic sequence.

SEQ ID NO: 24333 - protein, 185 aa, Artificial Sequence
  Synthetic sequence.
SEVDEVVERARRIAKENLDRVKKIVRENRELVEKVRKDVEDSVRTLKKLVDDVTEIARKLTGDEELKRVLDEARERIKRLHDESKKIAEEVRKRSRDSHETLRKITDDSRREIERLLRKVEEDGVSDDMRRKLETVVKEVEDILRRSREEIRTVNEEVEKVIEEAEREDERVVREVEEVIKRVEK

SEQ ID NO: 24334 - protein, 185 aa, Artificial Sequence; identical to SEQ ID NO: 24333
  Synthetic sequence.

SEQ ID NO: 24335 - protein, 185 aa, Artificial Sequence
  Synthetic sequence.
SSVEDVVRKMRKIVEDNKREVEKIVRENRKMAKDNEDLVKESVKDLKRLAKELEDLAKDDTGDETLERIAREVRKRVEELHRRSKEITDRTEERSRRSKRRLDEITKESRREIERLREEVEREGVSEDLERTLRTVVKEVKEVLDRSRDLVRRVNEEVKRVLDRSREEDERVVREVEEVIRRVET

SEQ ID NO: 24336 - protein, 185 aa, Artificial Sequence; identical to SEQ ID NO: 24335
  Synthetic sequence.

SEQ ID NO: 24337 - protein, 185 aa, Artificial Sequence
  Synthetic sequence.
REVDEIVDRLRRIAKENKDRVRELVERNRKLAEEVRRRVEESVKRLRDLVRTIEELARRETGDKRLEDIVRDLREKLRRLHETSKRILEELEERSRRSNDELREITERSKKRVDDLLEDLKRKGVEEDLERKIREVVREAEEVLRESKREMDTVNKEVREVIEDVRKRDEDVIREVEKVIREVEQ

SEQ ID NO: 24338 - protein, 185 aa, Artificial Sequence; identical to SEQ ID NO: 24337
  Synthetic sequence.

SEQ ID NO: 24339 - protein, 185 aa, Artificial Sequence
  Synthetic sequence.
SEVDEIVKEIREIARKNKEDVRRTVEDLRRLVKEVEKRVEDSVRTMRDLVRRLEETARRVTGDEELTKVIEDVRRKIEELHRRSKKILDEVREKIEELHRRTKKITEESRERLKKLEKDIRDRGVSEELERKLKTVIDEAEKVLRESEEDDRRVVEEVERVIKKVEEEDRKAVREVEKVLEDVRK

SEQ ID NO: 24340 - protein, 185 aa, Artificial Sequence; identical to SEQ ID NO: 24339
  Synthetic sequence.

SEQ ID NO: 24341 - protein, 181 aa, Artificial Sequence
  Synthetic sequence.
REVDELLKRIKEVADDIKRLSDENVKEIEKLAREVEKLVRDVVRENEEVAKEIEDLARRRKDEDVERRAEELLERVHRANEEIKKRIEELLRRVNERSKEIVRRIEDLLRRVAEEIKRAEEAGVDKKKLRDVLRELEKVVRDVAKEDEDANRRLKEVAERVKREIDEVDKKLKKVLDDVRK

SEQ ID NO: 24342 - protein, 181 aa, Artificial Sequence; identical to SEQ ID NO: 24341
  Synthetic sequence.

SEQ ID NO: 24343 - protein, 179 aa, Artificial Sequence
  Synthetic sequence.
REEEKLRKVLEDAKKVSKEVNEEDDRVNKEVEDVLREVKKEIDEVLKRATETVERVKRENKDSEELKKTIDDIRRKIKKEIDDVKREIDELLKDARRHSKEVKDEDKRINDEIREILRRRELPVDEIVKRIKELVDRSRKLSEENVRRLKKIVKRVKERVKELLDRIKEMAKEIEDRVR

SEQ ID NO: 24344 - protein, 179 aa, Artificial Sequence; identical to SEQ ID NO: 24343
  Synthetic sequence.

SEQ ID NO: 24345 - protein, 179 aa, Artificial Sequence
  Synthetic sequence.
DEEKKLKEVLDRATKVVKDVAEELDRVLEDVERVSRDVNRRDEKVNRDADRVLREVKDENKDSEKLKREIDEIKKDVERHSREVSEEDRRINKEIREKLRTVKEILEDLRRKIEETLRRKELPVEEIVRRIEEVAKTLREIVRRVLEELKEVVKESERLSRENVRRIEKLAEEIRRRVK

SEQ ID NO: 24346 - protein, 179 aa, Artificial Sequence; identical to SEQ ID NO: 24345
  Synthetic sequence.

SEQ ID NO: 24347 - protein, 179 aa, Artificial Sequence
  Synthetic sequence.
DEDEKLRKVLEELRRVVEEVKRRSDKALEDAERVLRRVKKEDRDANKKAEDELRRVIDENKESEELIREIERLLKEVREHSKEVEDRIDELLKRIEEHSRKVKKDIERLLEEIDREVKRKERPVDEILKRIEELMKEIRKLVKEDVDRIRDLVRRIDEESKENVKEIERVADEIRERIR

SEQ ID NO: 24348 - protein, 179 aa, Artificial Sequence; identical to SEQ ID NO: 24347
  Synthetic sequence.

SEQ ID NO: 24349 - protein, 180 aa, Artificial Sequence
  Synthetic sequence.
KEVEDVLREVEKVVEKIKRDVEKIVKDSKELAKRVEELVKESEDRSKEIVDRVEKLRREGTKDVERIIDRLLEDDKRLSDKTKEDLDRIAREDEKLLDELRRRIDEILKRLEELVKELRRAGAEEEKVEKVLRKVRDVVRRVKEKVEEVHRRSREMLKRVEDRDREAHERSRKVAEDVKR

SEQ ID NO: 24350 - protein, 180 aa, Artificial Sequence; identical to SEQ ID NO: 24349
  Synthetic sequence.

SEQ ID NO: 24351 - protein, 180 aa, Artificial Sequence
  Synthetic sequence.
SEVDEVLETIERIVREVKKLVKRSVEESERLVDEVEKLVEKSVREIKEIVDRIRDMKTKGGKDLEKLLDTMLEKVERLSRKTETEIEKIERDDRELSERTKRELEKLRETVKRLVDELRRAGAEREKVERVLEEARRVIEEVEREDDDAHRKSKEVLKRVLEKDRKALEDAKKVVEEVKR

SEQ ID NO: 24352 - protein, 180 aa, Artificial Sequence; identical to SEQ ID NO: 24351
  Synthetic sequence.

SEQ ID NO: 24353 - protein, 183 aa, Artificial Sequence
  Synthetic sequence.
KEVEDLERRNKELVERVDKLSRENVERNKKLAKELKEISEENVRRNRKLAEELKEVADRGDSRLEELIRRIEEESKDSDRKSEELLRRIKKESEESDRESKDTLEKILRTSEELLRDMERKGLDEDLRRRVKKSHDEVERELRRVDREDETSHEELRRVLEKVKREDRKSHEEVKRRLDEVRR

SEQ ID NO: 24354 - protein, 183 aa, Artificial Sequence; identical to SEQ ID NO: 24353
  Synthetic sequence.

SEQ ID NO: 24355 - protein, 183 aa, Artificial Sequence
  Synthetic sequence.
SEVDEIVKRNDDLAKEVKRLSTENVKRNKELADRVKRLSTENVKTNEKLAKDLERVVRRGVSRLKDLIRKIETDSRKSDEESERRLREIEKESRRSDEESRKRLKEILDRSKKLLEELERRNLDERLRRKVEKSHRDLREVLERVRREDERSHEEANKVLEDVKREDEKSHRDVKKRLDDVRR

SEQ ID NO: 24356 - protein, 183 aa, Artificial Sequence; identical to SEQ ID NO: 24355
  Synthetic sequence.

SEQ ID NO: 24357 - protein, 183 aa, Artificial Sequence
  Synthetic sequence.
SEVDRLLEKLEELVRKVRRDVEENVKKNDELAKEVERLSKRNVERNEELAKEIEDLARRGDSRLEDLIKEIEKESRDSDRRSKEELRRIKEESKRSDDESEKKLKEIEDEVRKLLKDADDRGLSEELKEKVKRVMEKVKRVLDRVREEDEKSHRKADRVLREVEKRDRDSHERLRKVLDDVRR

SEQ ID NO: 24358 - protein, 183 aa, Artificial Sequence; identical to SEQ ID NO: 24357
  Synthetic sequence.

SEQ ID NO: 24359 - protein, 183 aa, Artificial Sequence
  Synthetic sequence.
DEVREIVERNERLAREDKKIAEENVRRNEDLVRRLRELSRKNVEDNRRLAKELEEVAARGDSRLDELIEEIERRSEESDRESRKRLDEIREESERSDRRSKEESDKINEDSKKLLEEADRRGLSEELKKRVKDSHDKLREVSKRSEELDRKSHEDLKEVLKEVRERDDRSHEELRRVLEEVKR

SEQ ID NO: 24360 - protein, 183 aa, Artificial Sequence; identical to SEQ ID NO: 24359
  Synthetic sequence.

SEQ ID NO: 24361 - protein, 183 aa, Artificial Sequence
  Synthetic sequence.
DEVERILERIDELVKRVKELSRRNVERNKELVERVDRLVKDNVDRNRRLAEEVDRLKKEGDSRLKDLIREIERESRESDKRSEELLKRIEDESRESDRDSERKLKEIDDEVEELLKRARERGLEEELTKKVEKVVKDAKKTLEEVKREDEDSHKKANDVLRRVRELDKRSHDELKRVLDEVER

SEQ ID NO: 24362 - protein, 183 aa, Artificial Sequence; identical to SEQ ID NO: 24361
  Synthetic sequence.

SEQ ID NO: 24363 - protein, 183 aa, Artificial Sequence
  Synthetic sequence.
SEVEDVLKKLDDIAKEVTERVKRVLDRNEEIVDEVEKLVEEVVRRNKEIVKEVKRLKDEGLSRLDEALDRVKKESKKSHDTAKDVLDKVRRKDEESRREVEKRLRELEKKLKDLLDEVRKRGINGDLEREVRRVIREVEKVIDDVRREVERSIRKSEKDIREVEKRVEDVNREVEEAIRRVRT

SEQ ID NO: 24364 - protein, 183 aa, Artificial Sequence; identical to SEQ ID NO: 24363
  Synthetic sequence.

SEQ ID NO: 24365 - protein, 184 aa, Artificial Sequence
  Synthetic sequence.
REVEELVKKLKELAERSLTAVERIVEENERLLKRLEDESKRNVDDIERLARELLRRVEEEKTKEVKDTARELVERLKRHSERLIKEIRRLLEELNRKNRKLVEDSNRKTDEVRKEVEDLRQKIDDERVERILTKVIEDLERVDKAAHDILREVNERLREVMERVEKTNRTVNRRLEEVLKEIER

SEQ ID NO: 24366 - protein, 184 aa, Artificial Sequence; identical to SEQ ID NO: 24365
  Synthetic sequence.

SEQ ID NO: 24367 - protein, 185 aa, Artificial Sequence
  Synthetic sequence.
DEVEEIAREMREIVDRVLKLSEKTVRENRESVERLLRLSEETVRRIRDLVRRLEELARDDTGDKDLKKVLDEIRKRVEELLERSKRVSDENRERSERSLRESERIIKELKERVDELVERLERRGTSEEMKEKVERAVEEVKRVLDRVRETDKRVNEEVRKVNEEAERIDEKVVREAREVLKRVRD

SEQ ID NO: 24368 - protein, 185 aa, Artificial Sequence; identical to SEQ ID NO: 24367
  Synthetic sequence.

SEQ ID NO: 24369 - protein, 185 aa, Artificial Sequence
  Synthetic sequence.
RVAERLEDVLRELDRTLKDVARKLEEANRDNKRVLEEVAEILKRVLDDLRRVLDEVAKRLKDEEKLRELKKRAEELERDIERLLREAEKSSREDSKRSKKLLDELERRVRELKKKIKKLLDDKKNVEKVVDDIVKEVRELAERIKEVVTESVKHSKKNVDEMRKLVDDVVKKVKKLVEDVRREIK

SEQ ID NO: 24370 - protein, 185 aa, Artificial Sequence; identical to SEQ ID NO: 24369
  Synthetic sequence.

SEQ ID NO: 24371 - protein, 185 aa, Artificial Sequence
  Synthetic sequence.
SVAEKLRKVLEELRDVLRRVKEISRRSLERLKKVLKELADRLKELNDKLRKTLEELRKDVDDKDLLADITRKAKELSDRSRKLLEDAEKEVRDAAEKNRRLDTELEKAARDLEKKVRELLKDKKDVEELVEEIVKEIKKLAKEVAETVDKVAKENEKLAKEAKEKVEESERDVERLLEELKREAD

SEQ ID NO: 24372 - protein, 185 aa, Artificial Sequence; identical to SEQ ID NO: 24371
  Synthetic sequence.

SEQ ID NO: 24373 - protein, 175 aa, Artificial Sequence
  Synthetic sequence.
DEEKILEDVLRELKKVLDEVRKTNEDANKRLKDVDDKSHEILKRVEERLREVVKRVNVDSEKFKRIKKLVEDAKRELKEIVDDSNRKTKKVNEESRRDIRRLEELVRTVEEELRRRDVRVEDVVRRVRKVAEDVRRSSEETVKRIEDVVRRSEETVRELVKRVEDLVREMEEEAK

SEQ ID NO: 24374 - protein, 175 aa, Artificial Sequence; identical to SEQ ID NO: 24373
  Synthetic sequence.

SEQ ID NO: 24375 - protein, 175 aa, Artificial Sequence
  Synthetic sequence.
SDEEKLRKVERELEEADKESHEINRTVNEDLRRVDRESKEILDRVRKELEEVKDKINVDSDKMRKVEELVRRLEKELERIREESNRLTKKVNEESRRDLEESNKLTDEVREELKRREVRVEDLVRRVRKVAEDSRRSSEDTVRRVERVVRESKRLVDDLVRRARRVVEEIKRTAK

SEQ ID NO: 24376 - protein, 175 aa, Artificial Sequence; identical to SEQ ID NO: 24375
  Synthetic sequence.

SEQ ID NO: 24377 - protein, 175 aa, Artificial Sequence
  Synthetic sequence.
KEDEILKTVVDELRDALREVEERNRTVNEELRRADKESEDRLRKVVRELTEVMKRVNVDSRKMEEIKKLVKEVRERLKKILEESNKLTEDVNRESREDIERLRKLARDVEDELRRRTVPVEELVRRVREVVKRVRDSSRETVERVKRVVERSRRLVERLVRKVEEVVREVEERAR

SEQ ID NO: 24378 - protein, 175 aa, Artificial Sequence; identical to SEQ ID NO: 24377
  Synthetic sequence.

SEQ ID NO: 24379 - protein, 183 aa, Artificial Sequence
  Synthetic sequence.
SDVDRFLREVERLVERARKLSERDERETRKVVKEVRDSSRKSVEDSKRVVEKLEEEARRGGDDKETLKRRVETLLKEVEDMHRRDKEEIDRLLEEVKRNHERSKKEIEDLLDDVRRKLEEIRKKGVEKEKLDKVLEDLRRVVEEVKRRNDEVLKRLKEVVDEVTKRNRKALEDAKERLKKVTE

SEQ ID NO: 24380 - protein, 183 aa, Artificial Sequence; identical to SEQ ID NO: 24379
  Synthetic sequence.

SEQ ID NO: 24381 - protein, 183 aa, Artificial Sequence
  Synthetic sequence.
SEVDEVAKRVREIVERLRDLVRKVVEDNERIAREVKRSSDETLKEIRDIVRKAKEVADRGGDDEDRLREELERLLREVHKKSEDDRRRLEKLLRDVHEKNKEVKKELKRLLDEVRKEVERIKERGVDERKIDKVLKELEEVITDVRRTLDDVDRKLREVVKKVEEINRRANEELERVIREVRR

SEQ ID NO: 24382 - protein, 183 aa, Artificial Sequence; identical to SEQ ID NO: 24381
  Synthetic sequence.

SEQ ID NO: 24383 - protein, 183 aa, Artificial Sequence
  Synthetic sequence.
DDVERLLKKVEDIVRELRESSRKSVEEIKRIVKEVKRLVDEVVKENERIVEEAEDVMRRGGDDKDKLRRRLERLLEEVHRRNKDVKDRIRELLKEVHDRSKRDKEEIRKLLEELERDIREIKKKGVEREKLDEVLKRARDVLREVEKENDKANKELEEVAERVKKTLDDVDKKLEDVMRKVTK

SEQ ID NO: 24384 - protein, 183 aa, Artificial Sequence; identical to SEQ ID NO: 24383
  Synthetic sequence.

SEQ ID NO: 24385 - protein, 181 aa, Artificial Sequence
  Synthetic sequence.
KEEEIVERVREKIKRVLDEVREIDKRAHDELRRVLKEVEDIVRKVHEDLKRVLEEVRREVKGDKRIDDELREIEERSRRSVEDAKRLLKEIEKRSRDSEKRSEDVLREIEERITRLEDLLRRGLDVKTVVETVDKIAKEVRDLSRRSVEENRKLAREVREVVRKVVEDNRRLAREVRERVR

SEQ ID NO: 24386 - protein, 181 aa, Artificial Sequence; identical to SEQ ID NO: 24385
  Synthetic sequence.

SEQ ID NO: 24387 - protein, 181 aa, Artificial Sequence
  Synthetic sequence.
DEDEKVEKVTREVEKALDEVRKIDEEAHRRLKRVLDEVRRIDETVHRDLKRVLDEVRERVRGVRELEERLKRIEEESRESLRRSEELLKEIEDRSRESLERSKKLLRDVERTIDRLRELLKRGLDVETVVERLRRLVEDIRRKSRESVERNRELVKEAKDVSRKSVEENKKLVRDITREAT

SEQ ID NO: 24388 - protein, 181 aa, Artificial Sequence; identical to SEQ ID NO: 24387
  Synthetic sequence.

SEQ ID NO: 24389 - protein, 184 aa, Artificial Sequence
  Synthetic sequence.
SVDEIVERVERELKRVLDEVREIHDRARDELRRMHERSERIIRKVEEELERALKEVRDRGVPREVLKRIEEIVKRVKDKLRELLKRSKELVERIERENREVLRKIEETARKVEEELERLRREGVDDKVVREAVREVERVVTELLEESRRSVEKTERLVRRSEELIRKIVKEVKKVAREIREEVR

SEQ ID NO: 24390 - protein, 184 aa, Artificial Sequence; identical to SEQ ID NO: 24389
  Synthetic sequence.

SEQ ID NO: 24391 - protein, 184 aa, Artificial Sequence
  Synthetic sequence.
SVDEILRKVKEELDRVLEEVTEIHRKAKEELDRAHDTSERIHREVKRELDRVREEVERQGVPEEVLRRIEEIVRKLKEENDKVLDDSRKKVEKLKRENDRVLEEIKEIVDEVKKRLDELRERGIDEKVVKEVVDEVRKVVEEIRKKSKDSVDKTKRVVEESIRTSDEVVKKTEKLVREIEKEVR

SEQ ID NO: 24392 - protein, 184 aa, Artificial Sequence; identical to SEQ ID NO: 24391
  Synthetic sequence.

SEQ ID NO: 24393 - protein, 184 aa, Artificial Sequence
  Synthetic sequence.
SVEEIVRKVTKELRDAHRRTEKILRDVDKELKEVLDRVRKIHRDVKERLEKVLDDVRKRGVPKEVLDEIRKLVEDVKRENDKLLKEIKKIVEDLHRKNRDLKRKSEELVRRVEEELRELRRRGVDEEVVTRAVERVKRAVKKSEDDVRRIVDENRKLVKEIEDRSRESVKKTEELIERIRKRVE

SEQ ID NO: 24394 - protein, 184 aa, Artificial Sequence; identical to SEQ ID NO: 24393
  Synthetic sequence.

SEQ ID NO: 24395 - protein, 183 aa, Artificial Sequence
  Synthetic sequence.
NVEDILRKAEEEVRRMLAENERIVEEAKERAKRMLDESRKRLEEVLRRAREVLEEVDKRKKDERLKETIKEVEDRVEKLLREVEKHSKDVKREVEELLRRNKKKLDELRDEVRKLLEEVKRSTSEDVVRAVVEELRRLLEESIRHVRKVVREIEKLLREDIELVKEVVRRIERLLRELDKEVR

SEQ ID NO: 24396 - protein, 183 aa, Artificial Sequence; identical to SEQ ID NO: 24395
  Synthetic sequence.

SEQ ID NO: 24397 - protein, 181 aa, Artificial Sequence
  Synthetic sequence.
RKVDELRKEVRRVVKESRDKAKRVVEEVKRLVEKSRRDVKRVVDENRRVVEEMRRKVKDRRTEDVKREIRETLEDLERKNRKLLEDSEREARDLKRRIDELLERSREEVKRLKDEIKELRDRGLGDKEVKDAEDELDKAHEDTKKILDEVKKELDDAHDETRRILEEVNKESETVLEEVER

SEQ ID NO: 24398 - protein, 181 aa, Artificial Sequence; identical to SEQ ID NO: 24397
  Synthetic sequence.

SEQ ID NO: 24399 - protein, 181 aa, Artificial Sequence
  Synthetic sequence.
SLARRVEEEVKRVVDESEEKVRRVVKVNKEMVDDVRRLVKEVVDENEEVVKEVRDTVTKRKTEEVKERIERLIREVRKKNEEILRRIERLVEDVERKNREILRDSERTVRELEKRIKELEDNGLGREDVRRVEEELKKAHDDTKKILDDVDERSREALDEVRKELDRVNKRSDKALKDVRK

SEQ ID NO: 24400 - protein, 181 aa, Artificial Sequence; identical to SEQ ID NO: 24399
  Synthetic sequence.

SEQ ID NO: 24401 - protein, 181 aa, Artificial Sequence
  Synthetic sequence.
SKAEELVKRVKEVVDKVRKLVEEIEEKVKRVVEKSRRDVTEVVKKNREVVKRVKDTVRRRKTEEVKTRIKKEVDDVRKENEDLLRESKKRLDEVKDEIRRVEEEVEELVRRLEKRIDELRKNGLGEEIVRRAREELERVLDEAKRILEKVTRELDEAHKETEKILRDVNRESDKALEEVER

SEQ ID NO: 24402 - protein, 181 aa, Artificial Sequence; identical to SEQ ID NO: 24401
  Synthetic sequence.

SEQ ID NO: 24403 - protein, 178 aa, Artificial Sequence
  Synthetic sequence.
SEDEKLDKVRKRLERAHEESKKISDKSEKDTRDAHRKTEEILDRVRKEMEEVLKRVRDRGISEELLDRADKVVEDVRRTLKKVLDDSRELLKKLEKLNRDVEDRSRRLLERVKEKLDRKEEPAEEIVKDVERVVKESEDLVRRIVEINERIVRESERLVKEVKDRVRDMVRRLAEEAR

SEQ ID NO: 24404 - protein, 178 aa, Artificial Sequence; identical to SEQ ID NO: 24403
  Synthetic sequence.

SEQ ID NO: 24405 - protein, 182 aa, Artificial Sequence
  Synthetic sequence.
SVEDIIRKVEKEVEEVVEKVERILDTVRRRSEKVLRENKEILEEVKRRADKVLRDVERNSKDKDLERVLEEVKRRVEELLDRNRKVLEEIEKRNRDLLREVEESIRRLKKEVDDLSEEVRNKPEEVAKRLEDRVREIVRTLEDLVREIVRRSEESVRRSRESAKRVVDTVKRIVDELEKRVR

SEQ ID NO: 24406 - protein, 182 aa, Artificial Sequence; identical to SEQ ID NO: 24405
  Synthetic sequence.

SEQ ID NO: 24407 - protein, 182 aa, Artificial Sequence
  Synthetic sequence.
DVEEIIRRVSDKARKVLDRNRKILEDVKRRSEEVLEENKRIVDEVDEIIDEVLKRVKKRSKDERLEKLLEDIRREVRRLKEENRKVLEEIKRTNEKLLEENDRKLKRIEEEVRELEERVRDKPREVVDRAVKRVEELVKRSERSADEVRKRSTESVKESKRSAKKVVEDVRRLVEELERRVR

SEQ ID NO: 24408 - protein, 182 aa, Artificial Sequence; identical to SEQ ID NO: 24407
  Synthetic sequence.

SEQ ID NO: 24409 - protein, 180 aa, Artificial Sequence
  Synthetic sequence.
SEEDIIREAERIAREALKRARKIAEDARRISEKALEDARRIAKEAHDISKKALEDAARKRRREDVERALEDVERKDRKLLRELEEALKRVARESEESLKELKRLLEKVEEDIRRLADAARRGLDAKRAAEEAKRLAEEAEEAAKRVADRNRKLAKEAADLAREVAKRSEELAREAAKKAQ

SEQ ID NO: 24410 - protein, 180 aa, Artificial Sequence; identical to SEQ ID NO: 24409
  Synthetic sequence.

SEQ ID NO: 24411 - protein, 180 aa, Artificial Sequence
  Synthetic sequence.
REDEKIEEVKRRAEEVLKESKKIIEDVLKKSEEVIKEVREILEKAHRISAKVLDEVRKTRDDKSVEDILREVEKRDKDLERELERVIEEVKRRSDTSVERVKRENDRSKREIEKLDDLVKRGLDVDEVVERVERIVTKNLRLAERVVEENEKLVEDLRRLVADVVRTSKKLVDDVRERVR

SEQ ID NO: 24412 - protein, 180 aa, Artificial Sequence; identical to SEQ ID NO: 24411
  Synthetic sequence.

SEQ ID NO: 24413 - protein, 180 aa, Artificial Sequence
  Synthetic sequence.
SEDEKVDEATKEAERVLREVRKIIKRAHDRSRDAEREVKRTLDEVRRETKRVLEDVDRTRRDETIRKLLEEVERRSRKSAEDLKRVLERLRREDEKLVKDLEDALRELKERIDRLRDLLKRGLDVDEVVRRVKEIVRRLEELAKEIERRSDEIVEEIRRLVKKVVDENRKIVKKAEEDAR

SEQ ID NO: 24414 - protein, 180 aa, Artificial Sequence; identical to SEQ ID NO: 24413
  Synthetic sequence.

SEQ ID NO: 24415 - protein, 180 aa, Artificial Sequence
  Synthetic sequence.
DEDEIIDEAKKRADEVLKRSEDILRRAREEVEKVLEEVRKIIEDVHRRSRKVLEDVRRKAKREDVEKAIEDVEREDKRLVEELKKVLEEIRRTIERLAEELKRVNDESRDRIRKLEELVKRGLDVETVVRRVDEIVKRNEELARRLVEEAKKIVDDLRRLAEEIVKRSEDLVEKLKEDAR

SEQ ID NO: 24416 - protein, 180 aa, Artificial Sequence; identical to SEQ ID NO: 24415
  Synthetic sequence.

SEQ ID NO: 24417 - protein, 177 aa, Artificial Sequence
  Synthetic sequence.
SIEDVLRDVARKLRTVVDEARKILDEVDKATEKVLREAERVIREVAKRDKKVVDEVRKGGLPEDVVRRIEKLSEDNAERLTRLLKRVEELVREINKRNRDIAREIEELVRKVEEELERKKVAEDLLKLVEDVVRRIRKLAEDVKRENDKLVERIREVAEDVLRHSEETVEEARKAAE

SEQ ID NO: 24418 - protein, 177 aa, Artificial Sequence; identical to SEQ ID NO: 24417
  Synthetic sequence.

SEQ ID NO: 24419 - protein, 177 aa, Artificial Sequence
  Synthetic sequence.
SSEEALKEVERRLEDVRREVKRVAEEIKKKDDKVNDDAREKLERVNRETKRVLEELAREGLPEEVVKELKELVDKINTDNRRIEKRIKELSDENKRDIDRLEKRAEELLARIKEELEKRDVVEELKDKVRRLLEELKRLLEELDKHSARTIKEIRDLIETLRRINEKVIEDMKRRRD

SEQ ID NO: 24420 - protein, 177 aa, Artificial Sequence; identical to SEQ ID NO: 24419
  Synthetic sequence.

SEQ ID NO: 24421 - protein, 184 aa, Artificial Sequence
  Synthetic sequence.
SELDEAKRLVDEVVRRLEELLREDKKLVAEVEREVRELLERNARLLKEVADRIRRLKEEGGDNREELTRRLEKLVRDVEEHSKEVKKRIERLIREVEKHTDEVLERVKKLVEDVKRELEKLRNEDEKVVREIERLLRELEKALEDVERELRRSKDRLRKLAEEVKKVLDDSRRELERLREELRT

SEQ ID NO: 24422 - protein, 184 aa, Artificial Sequence; identical to SEQ ID NO: 24421
  Synthetic sequence.

SEQ ID NO: 24423 - protein, 179 aa, Artificial Sequence
  Synthetic sequence.
KDIEDAVRDVRRKVKELIENSERVVRTVEKLVRELIDHSRKVVREVEKLAKELIELKRRGDIREEDLKRVKKRVRDLNERNKEEVEKLKRTVKKLNDDDKRKVETLKEDVDREKKRLRERGVDEEVLKEVDRVLREAEKRSKEINEESKRVLDKAERDSRRIDRKSEEVVKRAEEEVRT

SEQ ID NO: 24424 - protein, 179 aa, Artificial Sequence; identical to SEQ ID NO: 24423
  Synthetic sequence.

SEQ ID NO: 24425 - protein, 179 aa, Artificial Sequence
  Synthetic sequence.
EEIERVLRRVTERLKELERHSEEVLREVERLVKEDEDLAREVVKRVEELIRTLRELKKRGDAREKVLKEVKETVKKLLDELEEHTRRVKEKVERLNRDNERVVRELRKEVEELLDELRKRGVDRRVLEEVREVVDRAEKKIKELDDRSREVLKEVEKRSRDIIREIEEKLKDVEERVKD

SEQ ID NO: 24426 - protein, 179 aa, Artificial Sequence; identical to SEQ ID NO: 24425
  Synthetic sequence.

SEQ ID NO: 24427 - protein, 179 aa, Artificial Sequence
  Synthetic sequence.
SKAEEVAKRVEDLAREDIKLAERAAREVERLARENIKLAREVAKRVEELARRLIEAARRGDAREEVAKRAADTVRKLLEELRRENKKSAERAKELAERARKHTEEALREVKKLLEDARREGADEKALKDAEDAARKAAEDSERAIERAERAAKDALKKSEDAAEEAKRAADKALEDAAR

SEQ ID NO: 24428 - protein, 179 aa, Artificial Sequence; identical to SEQ ID NO: 24427
  Synthetic sequence.

SEQ ID NO: 24429 - protein, 182 aa, Artificial Sequence
  Synthetic sequence.
DEVRDLVRRVRELSEELIRRVRTLLREVEELSRRLIEESERLLREVRKIVEELIRRVERREPEEVLRELIDRARRKLEKLAEDVKELNKRHEDRLRELEKRIKDLNKKHKDALDEIKKRVREAGVEERVVKEAEEVVERANRESEKLLEDVKRVVEEANKTSEDILRAVEEIVRRVLEELKK

SEQ ID NO: 24430 - protein, 182 aa, Artificial Sequence; identical to SEQ ID NO: 24429
  Synthetic sequence.

SEQ ID NO: 24431 - protein, 182 aa, Artificial Sequence
  Synthetic sequence.
SSKEVLERVAEKLKEVNERLKDVLRRVAEKLKRANEENKKVLERVRDILREVLRRLREKVTDKDKIRELETRIKKLLDDLERSSKDDSRRSKDLLRKLEELVRDLSKRSKELLKELEDLVRRGDGSVEEAERVVEKSVEEARRLAERVKEEVDRSVKHSEDNVREMRRLVEEIVKRVEEAAK

SEQ ID NO: 24432 - protein, 182 aa, Artificial Sequence; identical to SEQ ID NO: 24431
  Synthetic sequence.

SEQ ID NO: 24433 - protein, 182 aa, Artificial Sequence
  Synthetic sequence.
REKEVLDRVEEILRDANRRNEKVLREVAEIIRTVIEDNKRVLKEVADELRRVLEELRDKVKDKDRIKKLEEEIRKLLDELRRSSDKVTKESEELLRRLEESSRRDSEKSKRLLDRLEELVRRGDGRVEEMEDVVRRSLDHSRRNVEEAKKAVTKVVEDNKDNVRRIKEVVARVVEKAREEAR

SEQ ID NO: 24434 - protein, 182 aa, Artificial Sequence; identical to SEQ ID NO: 24433
  Synthetic sequence.

SEQ ID NO: 24435 - protein, 181 aa, Artificial Sequence
  Synthetic sequence.
SEVEEVLRRSRESAKKSKEHSRELLEKVKRIIDDVKRLVREVLKRSRDSIKRVEDLTRRGDIDEDTVRDVVRRNKRLLDELRRAVEDAVRKIDEELKRNERDVERVVRENEELLKDLLRRRDTEKVKEAVKESRDLLRKVEETNRRVNDEVRKLLEDIRRDVERAVEESERLLEDIVRKVK

SEQ ID NO: 24436 - protein, 181 aa, Artificial Sequence; identical to SEQ ID NO: 24435
  Synthetic sequence.

SEQ ID NO: 24437 - protein, 175 aa, Artificial Sequence
  Synthetic sequence.
SDVERVLTEIRKLVEDIKRDVERVVDESRKLVEEAERDVERVITEVEKLVERIKREVRDDDLRRLAEEVAERVKRIVDKNRENVRKSAEDNKELIKENRRHAKEVEDRVREALERGGERARELLKRVRELIKEHNRLNRESLKTSRKNIEDHHEDNKRSLEEARRIIEEVREAAR

SEQ ID NO: 24438 - protein, 175 aa, Artificial Sequence; identical to SEQ ID NO: 24437
  Synthetic sequence.

SEQ ID NO: 24439 - protein, 180 aa, Artificial Sequence
  Synthetic sequence.
KELEDVEKEVEEVAKRVEDSIRRNREVVEKVKDEVRRLLDRNDELVDRVAKEITEAIKKGKDDREVEKRVTEVKKHSEDLLRDVERLVEEVKRHSREVTKRNRDLVTDVRRKLEEVVRRRDEEKVKKVLEDVRRRLEELIKRSEDSAREVEKRLEDLRREVEESLERVERTLEDLVRRVK

SEQ ID NO: 24440 - protein, 180 aa, Artificial Sequence; identical to SEQ ID NO: 24439
  Synthetic sequence.

SEQ ID NO: 24441 - protein, 186 aa, Artificial Sequence
  Synthetic sequence.
SELERLEERVRRIEEEVKRLLEEHREVSDRVAKENRRSNEESKREVRRIEEEVKDLSRKGGDDRRRILEEVKRLVRELEKLLEEDITKSRKSVEDVRKHAEELLRTVRKLVRDLEKLLKEVLDRMGNSEEVKKVVEDVKRRLDDLIRKAEKVVRDSERELKKLVDHSKEVVDRVRERLKELIEEAR

SEQ ID NO: 24442 - protein, 186 aa, Artificial Sequence; identical to SEQ ID NO: 24441
  Synthetic sequence.

SEQ ID NO: 24443 - protein, 186 aa, Artificial Sequence
  Synthetic sequence.
SEVEDLERRVKRILEESDELVKRHEEKSRKIVKDLEDLLRRNEDTVEKILRELEKRIRDGGDDKETLLRTVRERVKDLERHSKEVRDRVRELLERLDRDAKRVEEEDDRLVDELEKDLRRVLEEMGNSERVTRVVEKVRRLLEESKRRSKEVVKRSKDLLKEAEDRADESVRELRRKLKELEEKAE

SEQ ID NO: 24444 - protein, 186 aa, Artificial Sequence; identical to SEQ ID NO: 24443
  Synthetic sequence.

SEQ ID NO: 24445 - protein, 180 aa, Artificial Sequence
  Synthetic sequence.
SELEDIRRLLEKLDREVKELLKRSRDLAKEMEERVRKLVKESEDELRKLAEKVDRIKKNGGSEEMVEKLIREAEKLVEDSRKKSKDLIDELRELVRKSRRDSERLIKRARDLVREIAKRVTEDEAREVLKDVRRKVEELRKELTKVDKEIEEIVRELEKRLREVNERVRTIVDELAKRLK

SEQ ID NO: 24446 - protein, 180 aa, Artificial Sequence; identical to SEQ ID NO: 24445
  Synthetic sequence.

SEQ ID NO: 24447 - protein, 176 aa, Artificial Sequence
  Synthetic sequence.
SMLEELDKEARELLKEVRRLVEDNDRLLEELLRRARELLERNDRISEKVADEVRKIDDEKRVRELADESRKISREILEEVRRLVKELKDDSKRILDEVRKRVTDLDERVRRLLAERPTERMREVAKKVKDILKRAEEEVRESLERVRRELERVIRELEDSLRRNDKTLRDLIEERR

SEQ ID NO: 24448 - protein, 176 aa, Artificial Sequence; identical to SEQ ID NO: 24447
  Synthetic sequence.

SEQ ID NO: 24449 - protein, 176 aa, Artificial Sequence
  Synthetic sequence.
SDLERLDELLKRVLEKARKLVKENDEHSEEVRKTVEKVVRDNDKLAEDLADKVEKIRDEDTVRKLAEDLKRISEKLLREVEELVRRNDELSKKILDDVRKLVERLIREAEDLLRKKDEERVKEVLDRVDEILKRVIKAAEESLKRSHEINRRLIKAAEDSLRRVKKILDELEERVR

SEQ ID NO: 24450 - protein, 176 aa, Artificial Sequence; identical to SEQ ID NO: 24449
  Synthetic sequence.

SEQ ID NO: 24451 - protein, 176 aa, Artificial Sequence
  Synthetic sequence.
STLDKLRELLRRVEETVREVLERNDEHSKEVKRRVDKLLRENDEHSKELADLVRKIKDEDTVKKLVEENKRRSEELLKTVEELVRRNDELSKKLEEDVRRLVRELEERAKRALDRRPTREMEKVLTDARRSLRRLEERVRESLERSHRINRKLRKDVRESLERSKRILDKLREEVR

SEQ ID NO: 24452 - protein, 176 aa, Artificial Sequence; identical to SEQ ID NO: 24451
  Synthetic sequence.

SEQ ID NO: 24453 - protein, 176 aa, Artificial Sequence
  Synthetic sequence.
SVLEELRKLVEKVLREVDKLLKDNNRHSEEVEKTVKRLLDENDRLLEELADRVEKIKDEDTVRKLVKELDDRSKDILREVKKLLKENDDLSKRLLDEVKKLVDRLEERVRDALRKDDKEEAKKVLTEVRRTLEELERRVRKSLKDSHDINRKLEKEVRDSLKRVKDRLDELIKRVR

SEQ ID NO: 24454 - protein, 176 aa, Artificial Sequence; identical to SEQ ID NO: 24453
  Synthetic sequence.

SEQ ID NO: 24455 - protein, 177 aa, Artificial Sequence
  Synthetic sequence.
RKAEEVLKRAKKIVDEVDKKNRESLERTRKIVEDVNEENREVLDRLRRRAEELKKEVDDERVKRMLDEILKEVKKRIEEVVRRNEAVIEESRRLVEELSERNRELVKRLEEVVRREDSDDVVRRIEEVIEKARRENDESVRRDEKLMKEVKDENKKTVDDIRRLLKDIEDKVREAKR

SEQ ID NO: 24456 - protein, 177 aa, Artificial Sequence; identical to SEQ ID NO: 24455
  Synthetic sequence.

SEQ ID NO: 24457 - protein, 177 aa, Artificial Sequence
  Synthetic sequence.
SKLEEVVKRLEEIVRRVKRADEESLKRTRKIVEEVNRDNRRSLKESRDRVDELKKRVDDDDVVRRLDRLIEESEKLVRDVERDNKRIIEESEELVRRSAEMNRKTLEEVKDLVRKSDTDEVVKRIEEVAKRNEELNRETVKRDEDLVREAKRRNEETVERDKRLVEKITKEVDETKK

SEQ ID NO: 24458 - protein, 177 aa, Artificial Sequence; identical to SEQ ID NO: 24457
  Synthetic sequence.

SEQ ID NO: 24459 - protein, 176 aa, Artificial Sequence
  Synthetic sequence.
SLIETIRDLAKKLKEESDKSVETDKRLVEELRRRSKKTVDDIDELVKRLERMVEDDKRKEALKKKLEDLIRTIETILEKSRRDLKELIDRSRRLLEESRRLVEEVERRVRELLKDKDTEDAKRVLEELKRIIEDLLRKNKKSLDDTEREVRRLIKENETVVRKLEEIVKRLEEKIR

SEQ ID NO: 24460 - protein, 176 aa, Artificial Sequence; identical to SEQ ID NO: 24459
  Synthetic sequence.

SEQ ID NO: 24461 - protein, 176 aa, Artificial Sequence
  Synthetic sequence.
SLLEEIAELVERLRRESKESVKRDEELVDELKKRSEETVKEDKRLAEELDRLAKKIPDKDTLKEKADRVREESKRLVKESRDLLEEVRRRSEDLIRRSRKLVTDVIREVERLLAERPVEEMKKVLDDLRREIKKLEEENERSLERTRDIVRKLDRTNEESARESEKIIREVVKEVK

SEQ ID NO: 24462 - protein, 176 aa, Artificial Sequence; identical to SEQ ID NO: 24461
  Synthetic sequence.

SEQ ID NO: 24463 - protein, 176 aa, Artificial Sequence
  Synthetic sequence.
SLLERIKEEVEKLRKESEESVETDERLVEELKKEVKDLVEKDRKLAEDLKDEVDKDKRTEALDKRLKEVIRESEEILKRLREKLKELIRRSEKLLEDSRRLLDKLRREVEELLKERDEERAKEVLRDLRRTVKELTDENEKSLERTRREVEKLIRELEESLRESRRRVKRLLEKVK

SEQ ID NO: 24464 - protein, 176 aa, Artificial Sequence; identical to SEQ ID NO: 24463
  Synthetic sequence.

SEQ ID NO: 24465 - protein, 176 aa, Artificial Sequence
  Synthetic sequence.
SLLEEIERRVEELEDRSRKSVERDKELAKEVDDRNEESVRTDEELAKRLADLVRKRDRDEELRKKLEEVIRESERLLEELHRENERVIRESKRLIEESKRLLEKLDRDVARLLEERPTERMEEVLKRLKEIVKELEERNRESLERTRRILEEVDRKNEESLKRSREIVRELDERVR

SEQ ID NO: 24466 - protein, 176 aa, Artificial Sequence; identical to SEQ ID NO: 24465
  Synthetic sequence.

SEQ ID NO: 24467 - protein, 176 aa, Artificial Sequence
  Synthetic sequence.
SLVEEIERRVEKLAEEVKRLVERDRKEVEKLEKESRDTVREIEELADRLRDAVEKERDEDSLRKKLEELIRTIEEILKESRRLLEELIRTSTEILKRLKEKLEELIRRVEELLKRNPDDEMRKVLTRLREEVRRLLDELRRSLEDTKRTVEDLERKNKTVVDELRKTVAELERRAR

SEQ ID NO: 24468 - protein, 176 aa, Artificial Sequence; identical to SEQ ID NO: 24467
  Synthetic sequence.

SEQ ID NO: 24469 - protein, 188 aa, Artificial Sequence
  Synthetic sequence.
SIDEVLKRIREISDDAKRKIKEVVEEIKKNADRLRREIERVLDEIRKVIRELLERIKRVEAPEEKVREILRRVERILEEVEKEIDRIRKRVEELTKRHVDEAEKLVKHNEEVLRDVERRIKELKDRGGVDEDLERLLREVERRTRRHEEELERLLRHNNKVSKEVREELKRLLDRVREMLEDVDRKLK

SEQ ID NO: 24470 - protein, 188 aa, Artificial Sequence; identical to SEQ ID NO: 24469
  Synthetic sequence.

SEQ ID NO: 24471 - protein, 188 aa, Artificial Sequence
  Synthetic sequence.
SVEEVRKEVKRISDEAREEIERVLERIKENAKRLIEDIRRVLEEIEEIIRRLEDEIRRVELPEERVRELLERVRDILRRVAEEIEKIEEEVKELTKRHEDEIRRLLKENKDVLDEIEERADDLRKKGGVDEDLEELLRRLERISRESRKRLEELLKHNNKESEEVRKRLKELLDDVRRVVEEVRRKLK

SEQ ID NO: 24472 - protein, 188 aa, Artificial Sequence; identical to SEQ ID NO: 24471
  Synthetic sequence.

SEQ ID NO: 24473 - protein, 188 aa, Artificial Sequence
  Synthetic sequence.
SIDEVLEELKRISTEAVERIRRVAERNRKSVEEVRKRIEEVAKRIREIATRLLERIRRVELPEKDVERLLREVEEEVRRVEDTIERLLEENEEIMRDSVRKIEKLVEDNRRVLEELTRRIERLKDNGGIDEELKKLLDELEKISRDSDERLKESTKKVRDVNRESDKKLKELLKRVEDVLEKVDRELK

SEQ ID NO: 24474 - protein, 188 aa, Artificial Sequence; identical to SEQ ID NO: 24473
  Synthetic sequence.

SEQ ID NO: 24475 - protein, 188 aa, Artificial Sequence
  Synthetic sequence.
SVDEVLERIRESAETILEEIRRVLERNKRSAETILEEIRDVARKIEKRIRDVLKKIEDVELPEEKVRELLEELREILERVKKAIEDLLRRNEEVMRDSKRKIEKLLKDNKDIMERVTREIKRLKDEGGVDEELRKLLEEVKKINDDSRRKLEKSTRDVKKVNDDSRRELERLLRKVEEVIRRVDEELR

SEQ ID NO: 24476 - protein, 188 aa, Artificial Sequence; identical to SEQ ID NO: 24475
  Synthetic sequence.

SEQ ID NO: 24477 - protein, 184 aa, Artificial Sequence
  Synthetic sequence.
KLEELVEEVEKVVREVKKELEDVVRTVREVVKRSKDDLREVVKEVERINRELEERLRRLATDERVEKTIRELIKRSRDSLRRAKDEVKKNLDENERLLREVEKRVEKLMRELEELLRRVREVVERNRDLTELLERVKTLIKEIRDRLRRLLEEVKRLVEESKKDLKRLLDENKRLVDEATKTAK

SEQ ID NO: 24478 - protein, 184 aa, Artificial Sequence; identical to SEQ ID NO: 24477
  Synthetic sequence.

SEQ ID NO: 24479 - protein, 184 aa, Artificial Sequence
  Synthetic sequence.
SLEELLKEVEKVIRDVKRELEKVVRDIEENVRRSAKRLREAEEEVERINRRLEEELKKKTTREEIKELVRKLIEDSRRSLEKARRDIAENEKRNKESLDRAKRTVEKLLEDLERLLREVEKVARNNRDLTELLKRVRDLIRRIRETLEKLLKENHDLSKRSKEDVERLLKENADLVKELTDRAE

SEQ ID NO: 24480 - protein, 184 aa, Artificial Sequence; identical to SEQ ID NO: 24479
  Synthetic sequence.

SEQ ID NO: 24481 - protein, 184 aa, Artificial Sequence
  Synthetic sequence.
SLEDLLREVKRVIEEVKRELEEVVRRVKEIVERSVRDLRRVVDEVRRINTELEERLRRLTTEDRVRDKAEKLIRESEESLRRAEKRVRENIRENERLLEKVKRTVEKLLRDLEELLKRVKEVADRNRDLTELLRRVEELIKEIRKELKRLLDEVKDLVDKSKENAKKLLEDNKRLVEKIARDAT

SEQ ID NO: 24482 - protein, 184 aa, Artificial Sequence; identical to SEQ ID NO: 24481
  Synthetic sequence.

SEQ ID NO: 24483 - protein, 184 aa, Artificial Sequence
  Synthetic sequence.
KLEELVREVEKVVDDIRKELEEVVRRVEEVVRRSKRTLEDVVRRVKKINDDLEKELRERSKDEEVRRKVEELIRESKKSLDEVRRNAERNAEENRRLLREVEETVKRLLEELEKLLDKVRKVVANNRDLTELLEDVKRVLDEIRETLERLLRKVEELVERSKRNAEELLKRNEDLAKKVRDDAK

SEQ ID NO: 24484 - protein, 184 aa, Artificial Sequence; identical to SEQ ID NO: 24483
  Synthetic sequence.

SEQ ID NO: 24485 - protein, 178 aa, Artificial Sequence
  Synthetic sequence.
DVEDVLRKIEEIIRRVLEEIKTVLDEIRKNNEKLKEDVDRVLAEIEKDSEDLKRKIKDIEDLIRELDESTDRVRKLAKRIKEKSEKSLRDAERLVKRLEEELKRILEEVEDLVRKKKESGELAETILRRVEELVEEIRRRLKEILDRDHELSKRLKEELKKILDDNHKLSRDAAERAR

SEQ ID NO: 24486 - protein, 178 aa, Artificial Sequence; identical to SEQ ID NO: 24485
  Synthetic sequence.

SEQ ID NO: 24487 - protein, 178 aa, Artificial Sequence
  Synthetic sequence.
SVEDVLREIKETSDDAARKADEVLKEIEKNNRRLKKEIDRVHEHTKEDSRRLKEEIKDIEELIRELDKSTDKDRKLVEKAKRDSEESLRDVERLAREVKEKLKRSTDDVRRLVEEKKESGDLMREMLERNRKLIEDLKRELEDILRRDHRLSKELLARLKESNEENHRLSKEIRERRK

SEQ ID NO: 24488 - protein, 178 aa, Artificial Sequence; identical to SEQ ID NO: 24487
  Synthetic sequence.

SEQ ID NO: 24489 - protein, 178 aa, Artificial Sequence
  Synthetic sequence.
RVEDVLRKVEEIIRRLKEEIDRVLEKIRETSERAVKDIRDVLRRIREDSKRLKEDIKDAKDAIRTLDRSTEEVEKLVKEAEKELKRSSDEVEKLARDLKRKLKEILDRARRLVREKRESGEDAERIVEEVRKLVEEIRKELEDILRKNEKLIEDLKRELKKILEENHRLSREIRERRR

SEQ ID NO: 24490 - protein, 178 aa, Artificial Sequence; identical to SEQ ID NO: 24489
  Synthetic sequence.

SEQ ID NO: 24491 - protein, 178 aa, Artificial Sequence
  Synthetic sequence.
SAEDVLREITKTSERAREDIKRVLDEIKRTSDEAVKTVTDIHEHTRKTSEDLKRKIKDIRELIRRLEESTDKDRRLVEEVKRRLEDSSRRAEELARRAEKRLKESTEKVKDLVDKKKEAGEVLRKILEENRELIERLKKELKELLDRNRKLIEDLLREAEKSNEDNKELIKKAEEDAR

SEQ ID NO: 24492 - protein, 178 aa, Artificial Sequence; identical to SEQ ID NO: 24491
  Synthetic sequence.

SEQ ID NO: 24493 - protein, 177 aa, Artificial Sequence
  Synthetic sequence.
SVEKVLEDITRELRRADEESKRALDHSAEVLKDLERRVKEVLDESREIIKELERRLRELKEVKDVLRRLEEENKELVRDIRRLLEEAIKENTELSKRSRETLDKIEKDVKKIVDDGVSDEEAKRVLDEVEKLVRELKKRNDELNEKTERLVRDLRRRLKDSLDKSRDLVRRLEEKAK

SEQ ID NO: 24494 - protein, 177 aa, Artificial Sequence; identical to SEQ ID NO: 24493
  Synthetic sequence.

SEQ ID NO: 24495 - protein, 177 aa, Artificial Sequence
  Synthetic sequence.
SVEEVLDEVRRIIEELLRLSEEMLRHSEEVIRDLERVSREVLERSKRIIDELLRELKDLDEVRKTLEDLIRKNTELSKTSKKVLDDARRENKKLSDDSRRVLRKLEEDIRRLVEEGVSDEVAKRAVEDVRRVVEDLERRNRTLNEKTKRLVEKLTRDNERSLKESKKVVDELREEAR

SEQ ID NO: 24496 - protein, 177 aa, Artificial Sequence; identical to SEQ ID NO: 24495
  Synthetic sequence.

SEQ ID NO: 24497 - protein, 177 aa, Artificial Sequence
  Synthetic sequence.
SVEEVLDEIRKRIEDLKREVDEVLDRSRRIIETLKERVDRVLKHSRELIKRLKDKLRELEEVKKTLDEIIRKNEELVRDIRKELKRALDKNKELVKEIRRELKEIIEEVKKLVDKGARDEEMKRALEEVKKLLDRLREELKRSLDESRKLVEELERRLRESNEESERLIRKLEREAD

SEQ ID NO: 24498 - protein, 177 aa, Artificial Sequence; identical to SEQ ID NO: 24497
  Synthetic sequence.

SEQ ID NO: 24499 - protein, 177 aa, Artificial Sequence
  Synthetic sequence.
SVEDVLREVEKIIRELDRKSEKVLEDSKRVIEDLKRKVEEVLRHSETLIRDLERRLKELEEVKRVLDKLRRDNERLVEDVKRELDEIIRKNKELSERSKRELERLRKAIEDLVRAGASDELAKEMVDRVRELVKKLEEENRRSLEESKKLVEELARRLERSNTESKRLIDKLREEAR

SEQ ID NO: 24500 - protein, 177 aa, Artificial Sequence; identical to SEQ ID NO: 24499
  Synthetic sequence.

SEQ ID NO: 24501 - protein, 177 aa, Artificial Sequence
  Synthetic sequence.
SVEEVLKDIEKKIRDLDRKVKEALRHSEEVIRRLEEEVKRVLDDSERILRDLKEKLRDLEDVKRELDRLLEENKRLVDDIRRVLEELERRNRELVDRIREVLKRIIEEVEKLVRDGASEELMRRIVEKVEELVKELDKRLRESNEDSKRLVEDLSRRAKKSLEESRELVRELKKRAK

SEQ ID NO: 24502 - protein, 177 aa, Artificial Sequence; identical to SEQ ID NO: 24501
  Synthetic sequence.

SEQ ID NO: 24503 - protein, 177 aa, Artificial Sequence
  Synthetic sequence.
SVEEVLDRIRKIIKELLDRSEEALRHSEEVIKDLERKVEEVLERSREVIRELLERLKELREVKKVLEELLRRNKELVDRIRKDLKKAIDENKKLSDESRRVLEEVRKKAKKLVDDGVDDEELKTMLEEVKKVVEELLRRNRKSNEDSKELVKELTRRLRKSLEDSKELVRKLEEEAR

SEQ ID NO: 24504 - protein, 177 aa, Artificial Sequence; identical to SEQ ID NO: 24503
  Synthetic sequence.

SEQ ID NO: 24505 - protein, 177 aa, Artificial Sequence
  Synthetic sequence.
SVEDVLREIEEILRRLEKESDDALEHSRRVIKRLEEESDRVLEESRRVIEELERKLRDLEEVKRELEKLIRKNEKLSKDSKDVLKKLIEENRRLSETSKEVLRELRKRVEDLVRAGADDEEMKKLLEDVKRLVDDLRRKNEESNRRSKELVDKLDKENKDSLKESRELVEKLEREAR

SEQ ID NO: 24506 - protein, 177 aa, Artificial Sequence; identical to SEQ ID NO: 24505
  Synthetic sequence.

SEQ ID NO: 24507 - protein, 180 aa, Artificial Sequence
  Synthetic sequence.
SVEEVVREVEEKLRKLIDDVRRVVEENRRNTERLRKRVTEVVKRNEDILRRLEEDIRRVERAEEAKEVLKRLKEETDRLLERVEEVVRRTKKKTEDLLRDVERLLREIKKELEDLLRNNVSEEVAKTALRKVEDLLKKLKERAEDSSRDNHRISKELTEELEESSKRVKTLVDELRKTVK

SEQ ID NO: 24508 - protein, 180 aa, Artificial Sequence; identical to SEQ ID NO: 24507
  Synthetic sequence.

SEQ ID NO: 24509 - protein, 178 aa, Artificial Sequence
  Synthetic sequence.
SVEEVLKESREISTRLAEEVKRVLDEIRRILERVKRINEKVNKDIEEILRRVKKTVGEKKRELVKKLEDEVRKILETNKRLSEELEERVRRLLEELERLLRKVVKENEDTVRDLARIEDERVAEKILKEDRDTVERLRKRVEDLLRDVRRLVEDSERKSRDLLRRVEELVRELKKRVD

SEQ ID NO: 24510 - protein, 178 aa, Artificial Sequence; identical to SEQ ID NO: 24509
  Synthetic sequence.

SEQ ID NO: 24511 - protein, 178 aa, Artificial Sequence
  Synthetic sequence.
SVEEVLKESKRVSEELNELNKKVNDDIRKILEKVNRENKKVNEDIERELRKLEEEVGRKKEELLREVVKEVRRLLKENERLSEKLRKEVEELLKRNEELSKRVVDDNKRTVDEARRIDDEEVAREILRDDKRTVEESKRESKRLLERVKKLVDRSAEESKKLLEDVKRLLEELRERAR

SEQ ID NO: 24512 - protein, 178 aa, Artificial Sequence; identical to SEQ ID NO: 24511
  Synthetic sequence.

SEQ ID NO: 24513 - protein, 178 aa, Artificial Sequence
  Synthetic sequence.
RVDEVLDESKKVSDRLHESIRRVLEKIEEILRRVNEENRRVNEEMKRILDELARTVGEKIREELEKVKKRAEDLVKTNEELSEDLKRRVRKLLKELEDLLRKVNEENKESLDRLKRIEDERVAREILKADRETVRRLEKRAKDLLDEVRDLVRESEKRSRELLKEVEDLVRKLTEEAR

SEQ ID NO: 24514 - protein, 178 aa, Artificial Sequence; identical to SEQ ID NO: 24513
  Synthetic sequence.

SEQ ID NO: 24515 - protein, 178 aa, Artificial Sequence
  Synthetic sequence.
RVEEVLKRMRDILRRVNEINRRVNRELERSSREILERIREILDRIRRILERLEERVGDKKKEEVDRVKDEARKLLRDLEETLKRDHDRDRKMLKENEDLSREVEKRVEELVRDLARIEDEKVARDLLREVEELVKESEELSEELLRRSRRSNEESLRKAEKLLETVRRLVEELEKKTT

SEQ ID NO: 24516 - protein, 178 aa, Artificial Sequence; identical to SEQ ID NO: 24515
  Synthetic sequence.

SEQ ID NO: 24517 - protein, 182 aa, Artificial Sequence
  Synthetic sequence.
SEAEAVEEEVRRLVEESEKRSKELLEDVERLVEESERRSKKLLDDVRKLVDDLKKELRRVRDRETMKKLLKELEDRVRRIIERLAELSKEVEDRVREIIKTNEEISDRLRKKVDELLEELKRRGVDDRVIERLKRILKEAHDKNKEVSDRIRKILEELHRKNRKVLEDIKRILDDVRREVER

SEQ ID NO: 24518 - protein, 182 aa, Artificial Sequence; identical to SEQ ID NO: 24517
  Synthetic sequence.

SEQ ID NO: 24519 - protein, 182 aa, Artificial Sequence
  Synthetic sequence.
KEAEDLLREVEKLVRESKKLSEDLLREVRKSNERSKRESERLLREVERLVRELKDLRDKVRDRRTLEKLLEDLERTAREIIKEIEKISRDDKKDVERIIRENERISEELEKRVREILEKIKRDGLDDRIIERIKRILEKVHKINREASKRIKESLDRAHETNKRVLDRIRKIVDDVRREVER

SEQ ID NO: 24520 - protein, 182 aa, Artificial Sequence; identical to SEQ ID NO: 24519
  Synthetic sequence.

SEQ ID NO: 24521 - protein, 173 aa, Artificial Sequence
  Synthetic sequence.
RLEEVKEELKRIATKLKEEIKENIRRLEESVEKIAKELAENIKRLEDILRDVKRKLRDERIVKTVEDIARRVVEDNERIMEEDKDVVRRLVERNEEIVRRVDETVKKIVELIDRGEPGEELVERLRRVVEEVRERLKDSSRELRKINEDSRKKVEDSSREVKKVVEELERRDT

SEQ ID NO: 24522 - protein, 173 aa, Artificial Sequence; identical to SEQ ID NO: 24521
  Synthetic sequence.

SEQ ID NO: 24523 - protein, 174 aa, Artificial Sequence
  Synthetic sequence.
KELEDVARKVEDLLRRIEKTNRDAIRESERLVRELKREVEKVEEESRRLLEEVERRIRDEDVIRRLREISERSKRELKKLLETITRISDKSVKDNEKLLRDTREVVRRVDEVLKNNGDAKKLLDEVRKVIEDNRKRSEELLEENRKVVEDVSRTLERILRENERVADEVDKEER

SEQ ID NO: 24524 - protein, 174 aa, Artificial Sequence; identical to SEQ ID NO: 24523
  Synthetic sequence.

SEQ ID NO: 24525 - protein, 174 aa, Artificial Sequence
  Synthetic sequence.
DELERVTEEIDKLSKDLERRVREVLEESRRLVEDVERVVREVLEEARRTAKDIADKVKNERILDEVREMTKRHEEELRRLLEELKRISEESKEELKRLLKENREAVEKVRRELENKGDVDKLLEEVRKISEDSKERLKEILKRNEEVARRVKRELKRLLETNREIIRRVEERER

SEQ ID NO: 24526 - protein, 174 aa, Artificial Sequence; identical to SEQ ID NO: 24525
  Synthetic sequence.

SEQ ID NO: 24527 - protein, 178 aa, Artificial Sequence
  Synthetic sequence.
RELEELLDKVRKIVEESKKRNEDLLREVREIVERSKEKIKKVLDEVRKIIETVRKSRLSDEKVRRLLEELRRKVEKLLDDDRKLAKELRDRLRELKKTNEDLARRLREELERILRDKPDVKEVEKVLRDVEELIRDSERASDRVLKDVEELIKDSERMSKKAEEDVDRLLRELDKDVR

SEQ ID NO: 24528 - protein, 178 aa, Artificial Sequence; identical to SEQ ID NO: 24527
  Synthetic sequence.

SEQ ID NO: 24529 - protein, 183 aa, Artificial Sequence
  Synthetic sequence.
DSVERVAEEVRKLLEDIKRVSDEVTKRLRDLLEDLKRVSDKVRKDIERLLEDLEREVRRKGGEELKKKVDKVTRELEELLRRNEEKVKEVERRVRDLLRRNNEKVKRAVKELRDLLESLRRIEEDRVLEEALRRVEELARRIKEHSKRVLETVRRLVEEIKKHSRKVLEEVRERIKRIKDELR

SEQ ID NO: 24530 - protein, 183 aa, Artificial Sequence; identical to SEQ ID NO: 24529
  Synthetic sequence.

SEQ ID NO: 24531 - protein, 183 aa, Artificial Sequence
  Synthetic sequence.
SEVEKAEKDVRDLLKDLRRVSEKVKRAVEDLLRDLKRTSDKASEDAKRLLDDLRRKVEERGGDRLRDEVREAEKEVEKLLRENNTEVDKVRKELEDELRRNEEMVRTVERRLRELLERIKRIEEDRVVKEILDEVEKLIREIKKHSEDLLRKVRKDIKRVKDHTKRVLDRIRKLIEDIKRRLE

SEQ ID NO: 24532 - protein, 183 aa, Artificial Sequence; identical to SEQ ID NO: 24531
  Synthetic sequence.

SEQ ID NO: 24533 - protein, 181 aa, Artificial Sequence
  Synthetic sequence.
DEVKELLDRVREEIRRDKERVKKLLEDSKRLNERDKREVKRLLEEVRELIKRLEDIIRKSDKDDELEKIVREIERRLRRVIEESEEHVKRTVDTDRKLLEDSKRHAEESARRLKEVLEDAKRKGLEEEVVKDLERLLRDLERVNDEVEKRLRDLTEDSKRFNDEVAREIEKLLEDVARTVK

SEQ ID NO: 24534 - protein, 181 aa, Artificial Sequence; identical to SEQ ID NO: 24533
  Synthetic sequence.

SEQ ID NO: 24535 - protein, 181 aa, Artificial Sequence
  Synthetic sequence.
REAEELLKRVEDLIRRLKDMIRKLLEDSKRLNERDVETVKRLLEDVERTIREIKDEVRRDKDKDRLRDLVRRVEERLRELLERSKDHVRRTAETDRELLDRLRRLVEKVERELRDMLRELEERGADERIVREVEKLLEKIKRDVDRVRRELERLTEESKRINDKAVRDIEELLEDLKRAVK

SEQ ID NO: 24536 - protein, 181 aa, Artificial Sequence; identical to SEQ ID NO: 24535
  Synthetic sequence.

SEQ ID NO: 24537 - protein, 185 aa, Artificial Sequence
  Synthetic sequence.
DELERLLEDVERVSRETKKLLKKLLDDAKRVIDKNREDSRRSLEEVERVIREAKELLKDGQEKEKLLRDVERIVKEVIEKNREVVDRVRDIVREIVERIERLVRKNKEDVDRVRREAEKRSRTKDTERRVRDVVKKIRELSEDVEREAKKVIDRLKELLEDIERENRRVEEEIKKLLEDVERTAR

SEQ ID NO: 24538 - protein, 185 aa, Artificial Sequence; identical to SEQ ID NO: 24537
  Synthetic sequence.

SEQ ID NO: 24539 - protein, 182 aa, Artificial Sequence
  Synthetic sequence.
KLVERLVKEAEDLTEEHKERLDRLLKENEKISRESKKRLKEILEENERVVEEVKKLLRDGQPKEELVKTVRKISEDSKRRLEELVRRNRKVSKESKERLDEILKTNEDMVREVEERLKREVDDRKKVDEVRRRLEELHKELEKVVRDVKRTSEKLVRDSEDMARKVVKTSEDLLRELEEEAR

SEQ ID NO: 24540 - protein, 182 aa, Artificial Sequence; identical to SEQ ID NO: 24539
  Synthetic sequence.

SEQ ID NO: 24541 - protein, 182 aa, Artificial Sequence
  Synthetic sequence.
SRAEDLVRRVEEMTRKHKKDLDDLLRENEEVSRRSKERIRKLLKDIKDVVDDVERVLRAGDDKKRLVEEAEKVARDVERDLRRLVKENRDISRTSKERLDDILRTNREVIERVDDALRREVSDRDKVEEVRERLKKLHTELEKRVREVKRDSERLVEDSERTVEELLRRVRKLLKEVRDSVK

SEQ ID NO: 24542 - protein, 182 aa, Artificial Sequence; identical to SEQ ID NO: 24541
  Synthetic sequence.

SEQ ID NO: 24543 - protein, 182 aa, Artificial Sequence
  Synthetic sequence.
SEAERLVEEAERVTREHKKRLDDLLKEVRRVSEDSKRKLEKILKENEDVVEEVKELLKAGDDKDKLLEKVRKISEDSRRRLEKLVEENKEMADRVRKALDDILDTNRRVVEEVKRRLEREVSDKEKVDRVRRELDRLHKELAEVVERVKRAVDKLLRDSEEEVKRVEERSERLLKEVADALR

SEQ ID NO: 24544 - protein, 182 aa, Artificial Sequence; identical to SEQ ID NO: 24543
  Synthetic sequence.

SEQ ID NO: 24545 - protein, 182 aa, Artificial Sequence
  Synthetic sequence.
SDVDKLVDDVRRETEKHKKTARDLLDELRKVSEESRRRLKRLLEEITEVVERIKRVLEAGRDKDELLERIEKVVREVREKLKELVKRNEDVVREVKRRLEELLRTNKKIVDEVKRMLDERVSDEEEVRRAKEELDRLHKEVEDVVRDVTRELDRLLKRSREVVERVREEADRLLEEVERTLK

SEQ ID NO: 24546 - protein, 182 aa, Artificial Sequence; identical to SEQ ID NO: 24545
  Synthetic sequence.

SEQ ID NO: 24547 - protein, 182 aa, Artificial Sequence
  Synthetic sequence.
SEVDELVERAERISRESKKTIKKILEDNERVSKRHKDELKKLLDELKRVVDEVRKVLERGTPKEELVKEVEEVVRRVKETLKRLLDTNHKISKESKERLRKLVEDNKRVVETVKKLLEDRVSDKEKVERALRELDRLLEESKRVVDEAEKTSDKLNKEVEEMARRVEEEVDRLLKEVRDDAK

SEQ ID NO: 24548 - protein, 182 aa, Artificial Sequence; identical to SEQ ID NO: 24547
  Synthetic sequence.

SEQ ID NO: 24549 - protein, 182 aa, Artificial Sequence
  Synthetic sequence.
SEADELVKEIEDVSRRSKEELTRLLEEAEKVSREHKKTLEELLRRIEKVVRDIKEVLRGGTPREELLKTIRKLVEDVRRELERLLRTNHEVVRRVEDRLRKLVEDNERVARKVKDELRRRVSDEKKVREVEKLLDKLLEESRKRAKEVLRALRELNREVAEVVRRVEERLRRLLKEVEEAVR

SEQ ID NO: 24550 - protein, 182 aa, Artificial Sequence; identical to SEQ ID NO: 24549
  Synthetic sequence.

SEQ ID NO: 24551 - protein, 182 aa, Artificial Sequence
  Synthetic sequence.
SDVDKIVEEIERISRDSERRIREIVERNKKVSEDHKRELERLLKEMEKVVEDVKKVLKDGDDKKKLKDEARRVVERVKDDLRKLLETNHEISKRSREELRKLVEDNERVVRKAEKDLKDRVSDKKKVDEARKKLRDLLERSKEVVKEAERRLEKSNRDVRREAERVRKALDDLLKEVDEAVR

SEQ ID NO: 24552 - protein, 182 aa, Artificial Sequence; identical to SEQ ID NO: 24551
  Synthetic sequence.

SEQ ID NO: 24553 - protein, 182 aa, Artificial Sequence
  Synthetic sequence.
SRADELVERAKRMTDEHKKTAEDILRENKRVSDEHKKTLEKILRENEKIVDEVAKLLEEGRDKEELVRRVEKVSRDSKRRLKELLETNHRISEESERRLRELLRTNREVVEEVRKRLKDEVSDKDKVREVEEELKRLHKEVEDVVDTVRRTSEKLNDEVRKVVETVTRRSEELLEELRRRAK

SEQ ID NO: 24554 - protein, 182 aa, Artificial Sequence; identical to SEQ ID NO: 24553
  Synthetic sequence.

SEQ ID NO: 24555 - protein, 182 aa, Artificial Sequence
  Synthetic sequence.
KEVEKLVTEIREMTERHKRTLEELLKEAEEVSRRHKEDLKRLLDENRKIVEEVARVLEKGEPKEELEKRVREVSKRSEETLRTLLETNHRVVKRVEDELKRLLETNRRMVETVKDLLRKTVSDKDKVERVLREADRLHEEVRKVVEKVREELRRLNEEVRKVVEEVRRDSERLVREVEERAR

SEQ ID NO: 24556 - protein, 182 aa, Artificial Sequence; identical to SEQ ID NO: 24555
  Synthetic sequence.

SEQ ID NO: 24557 - protein, 182 aa, Artificial Sequence
  Synthetic sequence.
SRVDELVDRARKMTEKHKEELKRIVEENRRVSKEHKERLEDILRRNAEIVERVKEVLKRGTPREKLVKDVREVSRDSKRRLDDLLRTNHKISEESKRRLRELLRTNEEFVRTVEDLLRREVSDEDKVRRALEELKKLHDELAKEAKRVEELLDKSNEEVEKVVRDVREASERLLEELERTAK

SEQ ID NO: 24558 - protein, 182 aa, Artificial Sequence; identical to SEQ ID NO: 24557
  Synthetic sequence.

SEQ ID NO: 24559 - protein, 182 aa, Artificial Sequence
  Synthetic sequence.
DEVKKLVDDARRLTEKHKTDLERLLDEARKVSEEHKKRLEELLREIAEVAKEILKVLRKGEDRERLVKEIEKVVRDVKRKLDELLKTNHDVVRRVEDELRRLLKTNKEVVDTVRDELERRVDDREKVKRVEETLERLHKEVEEVVRRVKKALRDLNDEVRRVVDEVRRRLEELLKRVEEEAR

SEQ ID NO: 24560 - protein, 182 aa, Artificial Sequence; identical to SEQ ID NO: 24559
  Synthetic sequence.

SEQ ID NO: 24561 - protein, 187 aa, Artificial Sequence
  Synthetic sequence.
REVDEVEERVTRLLKKVRDVAEESRRRSEELLKKSRDVVEEVKKEVDKLLEEVRDMVRRVKDKGVEEKLRKLIRDAEKILKELRKRLEENIRENEELLRRNEERLERLIRELEDLLTKLRKMLKDNAEGRVLKKLVEEVKKLADEIERELERTSKEIEELSRRSEEDLRRLVRKLREVVRKIEEDLR

SEQ ID NO: 24562 - protein, 187 aa, Artificial Sequence; identical to SEQ ID NO: 24561
  Synthetic sequence.

SEQ ID NO: 24563 - protein, 187 aa, Artificial Sequence
  Synthetic sequence.
REVERVERELERLLEEVREVAERSERESKKLLEDTRRVVRKVKEDVRRLLEEVRDVVRKVKDKGVEEELRKLIKELEDLLRRLDETLEKNIRDNERVLEDNRRILEELIRELEEMLRRLKKSLEDNAEGDVIRRMVEEVEKLARRIKETLERTVRRLEELVRRSEKNLRTLVEEVRKAVERIKETLR

SEQ ID NO: 24564 - protein, 187 aa, Artificial Sequence; identical to SEQ ID NO: 24563
  Synthetic sequence.

SEQ ID NO: 24565 - protein, 187 aa, Artificial Sequence
  Synthetic sequence.
SEAERVEEDVRRLLKRVEEVIKRSEERSRELLKKTEDVVREVRKRVKKLLDEVKDTLDKVRDKGVEEEARRLIEELKEILERLERNLRKHIKDNRTLLRKNKEDVTRLKEELEKIVEDLKRLLDDNVGGEVLDRLVEELRKLVEEIERDLERTVREIEKLVKDSDRNLEDMVRELRRVAERIKEELR

SEQ ID NO: 24566 - protein, 187 aa, Artificial Sequence; identical to SEQ ID NO: 24565
  Synthetic sequence.

SEQ ID NO: 24567 - protein, 187 aa, Artificial Sequence
  Synthetic sequence.
REVDEVRRRAEELLKEVRDVVTESEKESRRLLEDTRRVVEDVKRRVDRLLEEVRDLLREVSEKKVEEEARKLIRELERIVEDLERKLDRDIRENERLLEENKRRLEKLIRELEEILRDLDRKLRDNAEGDVLRELVKRLEDVAREIKKRLEDTLRKLEEVSRRSKENLRELVERLRRIADEIRERLR

SEQ ID NO: 24568 - protein, 187 aa, Artificial Sequence; identical to SEQ ID NO: 24567
  Synthetic sequence.

SEQ ID NO: 24569 - protein, 186 aa, Artificial Sequence
  Synthetic sequence.
DEVDRVREEIERLLREVEEVLERSERESRRLLREVEEMLERSDEEVRRLLKEVEEVLRDELTDEDLMRKIRETLKKILEDNEELVRRIKRRAEEALERDREVVEEIRKRAEKVLEEVERLLRDKKESGEVLEEILRRAKEEVEKLKRELERTVERLAELVEELKRELERSTREVRKTVEELKRRIK

SEQ ID NO: 24570 - protein, 186 aa, Artificial Sequence; identical to SEQ ID NO: 24569
  Synthetic sequence.

SEQ ID NO: 24571 - protein, 186 aa, Artificial Sequence
  Synthetic sequence.
DEAEDLERRARELLEEVERVLEESIRRSEETVKEVEDMLRRSTEEVERLLKRVEDVLREELSDEKRLEEIKRKMEEILKRNRELVEEIRKELEESLRRNRELVERAKRTLERIVRKVEKVIREKKDDGELLKRLIDEVRRLAEKIKEELKESSKRDEEKVEKLKKELKDSTDAVRELVERLEREIK

SEQ ID NO: 24572 - protein, 186 aa, Artificial Sequence; identical to SEQ ID NO: 24571
  Synthetic sequence.

SEQ ID NO: 24573 - protein, 174 aa, Artificial Sequence
  Synthetic sequence.
DEVEELVKEVEERIKKVHKENEDVLRESEELMKRLHEENERLLREVEELVRRIRELRKRGDLREEDVKRVLKRIEELVERARRENKKASDRNRDLIRRVKKTNDDVLREIEELVKEIDVREARERIRRLLTESRKSVEEVEKRLRELSKRSEESVERVERTARRLLKELEDMTR

SEQ ID NO: 24574 - protein, 174 aa, Artificial Sequence; identical to SEQ ID NO: 24573
  Synthetic sequence.

SEQ ID NO: 24575 - protein, 174 aa, Artificial Sequence
  Synthetic sequence.
EEVKRLVEKVRKLIEDSKRRNRDVLRRVEELVRRVHRRNEEVLRRVEKLVEDIKELLRRGDLREEEVEKIKRRLRELAREVEEENRRVAEDIRRLLDEVRRENERVLREIRELLKEIPVEEAEREIERLLEESKRSVEEVEERIRRLIRESEESVREVKERIDELLKDADRATK

SEQ ID NO: 24576 - protein, 174 aa, Artificial Sequence; identical to SEQ ID NO: 24575
  Synthetic sequence.

SEQ ID NO: 24577 - protein, 174 aa, Artificial Sequence
  Synthetic sequence.
REVEELVKDVERLMREVHRRNEKVVEEVEALIRKSKEDNERVAREVERLVREVEKMLRRGDIREEDIKRVLKEIEDLLEEVERRNRRVLEEIERLLREVTEDNREVVRKLERLAEEIPDREAKERIKDLVRKSRDSVREVRERIRRLLEDSKRSVDDLARRIRELLRKAAEKAR

SEQ ID NO: 24578 - protein, 174 aa, Artificial Sequence; identical to SEQ ID NO: 24577
  Synthetic sequence.

SEQ ID NO: 24579 - protein, 174 aa, Artificial Sequence
  Synthetic sequence.
DEAEELVDRVRKLAEDVHKKNEDVLRESDALVKDSDRRNREALRRVEKLVEDVEELLRRGEIREEEIDKVLKEIARLLDELRKENKDLSRRNEELIERVERENRRVLTEIDKLVKEIPVEEVKRRIKELLKRVEESVRTVEEELRRLSKESEESVKRVEDRIRELLKRLRDAAR

SEQ ID NO: 24580 - protein, 174 aa, Artificial Sequence; identical to SEQ ID NO: 24579
  Synthetic sequence.

SEQ ID NO: 24581 - protein, 174 aa, Artificial Sequence
  Synthetic sequence.
DEAEDLVRKVRKLIEESKKENEDLLREVRELVARVHEENERVLREVEKLVEDIRRLLRRGDLRREDVRRVEEEIKELLKEVRRINKEVLEEVKRLVDEVKRRNEDVLRKIEDLVRRIPVREVKKAIEDLLKESEDSVREVEEEIRKLLKDLEKSVRDVERAIEKLLDELRKDTK

SEQ ID NO: 24582 - protein, 174 aa, Artificial Sequence; identical to SEQ ID NO: 24581
  Synthetic sequence.

SEQ ID NO: 24583 - protein, 174 aa, Artificial Sequence
  Synthetic sequence.
REVEELVREAEELVRRVHKRNEDALRRSKKLVEDVHRKNEEVLKRVERLVERIEELLRRGDLREEDVERVLREIKKLIEEVEEDNERVSRENKELVDRIREENERVAKRLEDLVREIPDKEAAERIKRLIDEVRKSVEEVERRAEELSRELRRSVKEVRDALKRLLDDLRRATT

SEQ ID NO: 24584 - protein, 174 aa, Artificial Sequence; identical to SEQ ID NO: 24583
  Synthetic sequence.

SEQ ID NO: 24585 - protein, 174 aa, Artificial Sequence
  Synthetic sequence.
REVEELVKEVRRRVREVHERNRRVLEDSERLVREVHKRNEEALRRSEELIKRVEDMRRRGDLREKDIERISETNEKLVKEIKDENEEVSRRNEKLVDEVRRRNEEVLKELEKLLRDIPDERAEREIRRLLEEVKKSVEDLTRKARKLSRDLERSVREVEERARDLSRRLREKTR

SEQ ID NO: 24586 - protein, 174 aa, Artificial Sequence; identical to SEQ ID NO: 24585
  Synthetic sequence.

SEQ ID NO: 24587 - protein, 174 aa, Artificial Sequence
  Synthetic sequence.
SEVEKLVKDVEDLAREVHKRNKELVDEVRDRVRRVEERNKRVVDEVREEVKKLIDLLRRGDLREKDIRRMLERAKELIDRVKEDNDRVARTLEDLVRKVKEENEKVLTDIERLVEEIPDEEAKDRIRELLKRVEESVEKVKRDIERLIERSKESVRRLEERIKELLRELEEAAR

SEQ ID NO: 24588 - protein, 174 aa, Artificial Sequence; identical to SEQ ID NO: 24587
  Synthetic sequence.

SEQ ID NO: 24589 - protein, 174 aa, Artificial Sequence
  Synthetic sequence.
SEVEDLVRKVKKLMEDSDRENKRLVDEVRERVEEVKKRNKEVVDEVRERVKRLEEMLRRGDLREEDIKRVEKEIEDLVKEVKDTNKRVADELRKLVEEVKKRNRDVAERIKELVKEIPDKDAAEAIKDLIRKSEKSVDEVRREIERLIKESEDSVKRVTDEIRKLLKRLRDTTT

SEQ ID NO: 24590 - protein, 174 aa, Artificial Sequence; identical to SEQ ID NO: 24589
  Synthetic sequence.

SEQ ID NO: 24591 - protein, 181 aa, Artificial Sequence
  Synthetic sequence.
SELEEILKTVKKLVDDHKRLSEEILRRVRKLVEEHKRKSEEILKRVTDLAEDVKDKIRKDRSKEDLERIVREARERVRRMLEEDRENLERIVRTIEKVLRDDKEHLKDVERRIRKLLEDARRRGLPREVEKELDRLLKELERVSRESEKELRRLLKELEEASRESEERLRRLLRDVEEALK

SEQ ID NO: 24592 - protein, 181 aa, Artificial Sequence; identical to SEQ ID NO: 24591
  Synthetic sequence.

SEQ ID NO: 24593 - protein, 175 aa, Artificial Sequence
  Synthetic sequence.
DEIETVKEELKKLLERLEESSRKVERDLEDLLRRSEESTREVEKRLKELLEDVRRKLREKKELVREVEEEVRKLLEESRRSLEENRRLIEKLAKESRDSLREVEKRVRELLKKLDDGADVKEVLDRVRELARTHHELNRELLREAEESSREHHRLNEELVDRVRKLVKEVEDRAR

SEQ ID NO: 24594 - protein, 175 aa, Artificial Sequence; identical to SEQ ID NO: 24593
  Synthetic sequence.

SEQ ID NO: 24595 - protein, 175 aa, Artificial Sequence
  Synthetic sequence.
SEIERVKKALRKLLEDSRKSSEDLARELKRLLEESRKSTEKVERDLTDLLREIEEKLRDAKETVEEAKREVDRLLEESRKSLRDNERLVERLIRESERSLRENEDEVRRLEELLDRGKDLDTILERVERSSREHHKLNERLLETLRRSSEEHHKRNEELVRRVERLLEEVERRRK

SEQ ID NO: 24596 - protein, 175 aa, Artificial Sequence; identical to SEQ ID NO: 24595
  Synthetic sequence.

SEQ ID NO: 24597 - protein, 175 aa, Artificial Sequence
  Synthetic sequence.
SKIERVKEEIRRLLDTLKKSSETVIREIEKILKESRESSKKVEDDLRRLVREVEKKVREKKELVEKLKRVVDKLAEESRRSLEDNERRLTELIRDSERSLEEVKRRAEEVEKLLEDGKDVDKVLRDLEDLVRRHHERNKELLDRVRKSSEEHNRTNEELLKEVERLARKVIKDTT

SEQ ID NO: 24598 - protein, 175 aa, Artificial Sequence; identical to SEQ ID NO: 24597
  Synthetic sequence.

SEQ ID NO: 24599 - protein, 175 aa, Artificial Sequence
  Synthetic sequence.
DEIEEVKRRARELLREATESSKEVAKALDELLERDRDSSRRVKEDLKRLLEEVRRKLRKDKKTVEEVERRVKKLADESDKISEENERRVDKLKKESEESLRRLRDKVRKLEKKLEDGKDLEKVLRDVEKLMREHHELNRELLKRVEDSSRTSHELNKRLVDTVRKLVTDAAEKAK

SEQ ID NO: 24600 - protein, 175 aa, Artificial Sequence; identical to SEQ ID NO: 24599
  Synthetic sequence.

SEQ ID NO: 24601 - protein, 175 aa, Artificial Sequence
  Synthetic sequence.
SEIEEVDERIKALLKRSTESSKRVEDEARRLMKEDKDSSKEVEDRLRDLLRKVREKLRDSKETVEEVERRVTELAERSRRISRENAERLKDLLRKSKESLERNRRDAERVRKLLRDGMDLKKVLDDLKRSSEEHHRLNEELLKRAEDSSRTSHRLNRKLVEEVRRLVEKVLEEVR

SEQ ID NO: 24602 - protein, 175 aa, Artificial Sequence; identical to SEQ ID NO: 24601
  Synthetic sequence.

SEQ ID NO: 24603 - protein, 175 aa, Artificial Sequence
  Synthetic sequence.
DEIEEVKKTLKKLVEELEESTRRVEEELKKLLKESEDSTRRVEDELRRLLEEVERKLRDDKKTVRDVEEKVRRLAEESRESLRRNREEVKRLLEESRKSLEDVKRTIERILKLLDDGKDLDEVLKDVERLVKEHEDLNKELLKKVEKSSRDHHELNKELVRRVEELVREAIKKTT

SEQ ID NO: 24604 - protein, 175 aa, Artificial Sequence; identical to SEQ ID NO: 24603
  Synthetic sequence.

SEQ ID NO: 24605 - protein, 175 aa, Artificial Sequence
  Synthetic sequence.
DEVEKVKEEIRRLLKRLEDSTRDVERRLEELLRESTESSKEVEERLKRLLDEVRKKLKDKKDDVRRVEEEVRKLAERSRESLERNRRRVEKLMKESRDSLREVEKRAKEVEKLLDDGKDVKKVLEELRELVRKHEELNRKLLEEVRESSERHKKLNKELVDEVKRLAEKITEEAR

SEQ ID NO: 24606 - protein, 175 aa, Artificial Sequence; identical to SEQ ID NO: 24605
  Synthetic sequence.

SEQ ID NO: 24607 - protein, 175 aa, Artificial Sequence
  Synthetic sequence.
KEIEDVKRALEKLLEDDKRSTEELKDRLARLLEDSKRSSDKVIEDLDRLLKEVRDKLREREESVKEVEDRVRKLAEESRDSLRKNEDLVRKLLEESKKISDDNRKKVKRALELLERGADLDEILKRVEDSSRESHKKNEELLRRVRRSSEEHKRLNEELLREVEELVKEIVKEAK

SEQ ID NO: 24608 - protein, 175 aa, Artificial Sequence; identical to SEQ ID NO: 24607
  Synthetic sequence.

SEQ ID NO: 24609 - protein, 175 aa, Artificial Sequence
  Synthetic sequence.
SKIEEVKKALRRLLEDLKRSTDRVKEEAKKLLDESRKSSEEVKRELERLLEEVTRKLRDKKEVVKEVRERVKRLMEESERSLRENEETVKRLLEESEKSLRRVEEEVRRLEKKLEDGADADKMLRDIERLVEEHKRLNEKLLREVRESSKRHNEKNEELVKTVKKLVEDAEERAK

SEQ ID NO: 24610 - protein, 175 aa, Artificial Sequence; identical to SEQ ID NO: 24609
  Synthetic sequence.

SEQ ID NO: 24611 - protein, 175 aa, Artificial Sequence
  Synthetic sequence.
SEIETVKKELERLLDESRRSTETVEREVEDILRKSTESSEEVKDRLDKLLKEVRDKLRELKETVKKVEDEVRKLAEESKDSLRKNRETAKELLRRSRESLDKNRRDVEKAKKLLEDGKDLREVLERVRKSSEDHKELNKELLERLRRSSKEHNDKNKRLVDEVRRLVEEVIRRAT

SEQ ID NO: 24612 - protein, 175 aa, Artificial Sequence; identical to SEQ ID NO: 24611
  Synthetic sequence.

SEQ ID NO: 24613 - protein, 175 aa, Artificial Sequence
  Synthetic sequence.
REIEEVKERLKKLLKDVTDSTDKVRKDLEKLLEDDRRSSRKVEEDLRRLLKDVRDKLREEKELVKRVEEDVRRLLEESKDISRENEKTVKRLAEESRRSLEDLRRRIEEIIKKLDDGMDLEKVLREAEKLAREHERTNEKLLKDVEKSSRDSHKRNKEIVDRVKKLAEDIIRKTK

SEQ ID NO: 24614 - protein, 175 aa, Artificial Sequence; identical to SEQ ID NO: 24613
  Synthetic sequence.

SEQ ID NO: 24615 - protein, 175 aa, Artificial Sequence
  Synthetic sequence.
SEIERVKKRLEELLREVEESTRRLEERLKRLLEEAKRSSEEVEKELRRLLEEVRRRLRRDKKLVRELERRVKELLEDSRRSLEELKKRVRKLAEDSKRLLEEVKREVEKLKKKLDDGMDLDDVLRRVEELAKRAHDENERLIREVEELVRRHNKRNKELVDEVKRLVEKVIEEER

SEQ ID NO: 24616 - protein, 175 aa, Artificial Sequence; identical to SEQ ID NO: 24615
  Synthetic sequence.

SEQ ID NO: 24617 - protein, 175 aa, Artificial Sequence
  Synthetic sequence.
DEIERVKEELERLAKEDKDSTDTVKRELERLLEESKRSSDKLREDVERLLREVRERLRDKKEKVRDVEEKVKRLLEESEESLRENEKTVRKLAEDSERISRENERRIRDALRLLDAGADLKRILEEVKRSSEESHKLNEELLDEVRKSSEEHNKLNEKLLRDVERLVRKVLTETK

SEQ ID NO: 24618 - protein, 175 aa, Artificial Sequence; identical to SEQ ID NO: 24617
  Synthetic sequence.

SEQ ID NO: 24619 - protein, 188 aa, Artificial Sequence
  Synthetic sequence.
DELDKLLRDAEEVVRRVKEENKRLVKRDEEVVRRIHELNRKLLEDIRKVVEDVKEEIKEGRPDKELKRLLDDLKRKAEEVVRRSRELLKELEKLSRDVIRTSRELLERVKKIVEDLIKKLEDDMTSEDAKRKVKRVKDELKRLVEEVEEVSRRSEERSRKTLEDVRDSSRRLEEELRKLVKEVEEAVR

SEQ ID NO: 24620 - protein, 188 aa, Artificial Sequence; identical to SEQ ID NO: 24619
  Synthetic sequence.

SEQ ID NO: 24621 - protein, 188 aa, Artificial Sequence
  Synthetic sequence.
DELEKLLEDIRDVVRRIKETLEKLVKEDRDVVEKVKEDNKRLLKEMEDVVRKVKEEIRSGLPREVLERVLERVRRIAEEIIRRSRKIVKDVEKKSTDLKRRLDEILKEAKERVEEIAKEVKKKVTEERLERRAEEMEERLRRLVEEVREVVERVKEESDRTVEEVRRSSDRVEKEVERLVREVEDKVR

SEQ ID NO: 24622 - protein, 188 aa, Artificial Sequence; identical to SEQ ID NO: 24621
  Synthetic sequence.

SEQ ID NO: 24623 - protein, 178 aa, Artificial Sequence
  Synthetic sequence.
EELERLMRRSEESLKRSEDTVRELIREAREILKRIKEELKRLLEEAERILEEVKKTVRDLRDKKEVLRKLLEDLRRLVEEIERRLKKLLDELREVVREIKERLKKLNDDHRELIKEVAAEVDSKDLIKTARDTLRESERVSKELEERLKKIVEEVERLVEEVKKELERIVKDAERDVK

SEQ ID NO: 24624 - protein, 178 aa, Artificial Sequence; identical to SEQ ID NO: 24623
  Synthetic sequence.

SEQ ID NO: 24625 - protein, 178 aa, Artificial Sequence
  Synthetic sequence.
DELRKLARDAEEILKRSEEEVRKLKKRSDDSLRRSREEVKKLEDEIREIVDRIKKRVEERPEAKEELRKLLKELEDLVREIEERLETLNREHKKLIEEIERRLEKLNEDLDRVVKDLARKVDVEELKRTLEEIVERSKRVSDRLRERLKRTLDDSRRISDDLRRRLKKLVDDIRREVK

SEQ ID NO: 24626 - protein, 178 aa, Artificial Sequence; identical to SEQ ID NO: 24625
  Synthetic sequence.

SEQ ID NO: 24627 - protein, 177 aa, Artificial Sequence
  Synthetic sequence.
KEIEDVKEELKKVLEEDRDSLRKVEKEHRRLAEEVKRKVRELEESLKRIVEEVERIAREAKKGEVLKELRKRIRDLLEELKRVLKEVEDRARESIERNRRVSEKSERDIEKIMKELEDGKDLETVIREVRRILEESKRLNDKSREEVRKLVEELKDIVRRIEETVRRLLEEAKERLR

SEQ ID NO: 24628 - protein, 177 aa, Artificial Sequence; identical to SEQ ID NO: 24627
  Synthetic sequence.

SEQ ID NO: 24629 - protein, 183 aa, Artificial Sequence
  Synthetic sequence.
DSVDRLRRRVDEVLKTVEDALRRNKKDAEDLLRRIEEVLERLERRSEKLLKEIDEVLKRVPEKLVRDARRRLEELREHSKRLVDDLRRDLRRILEKNRELNDKIRKDLKRLKDKVEKLAKDGVSDEILTRAVEEIDELLRKLKRELDESTKESRKRVEELEKRLRDNTKRVKKDVDDLKRRVS

SEQ ID NO: 24630 - protein, 183 aa, Artificial Sequence; identical to SEQ ID NO: 24629
  Synthetic sequence.

SEQ ID NO: 24631 - protein, 178 aa, Artificial Sequence
  Synthetic sequence.
SSIERLEEESRKNIKELEDSVKELKEEVDRLVEELERSVRELAKIVEDVVRELKKRARKREKEVKEVVERARKLIDEVRRENERVIEEMRRLLKEVEDDNRRVVEESKKLIEEVKNGDDDEEVKRVLEESHRLVREVHERNKRVAERVRDLVRRVHEENERVAEEIRDLVRRVEEEVR

SEQ ID NO: 24632 - protein, 178 aa, Artificial Sequence; identical to SEQ ID NO: 24631
  Synthetic sequence.

SEQ ID NO: 24633 - protein, 186 aa, Artificial Sequence
  Synthetic sequence.
SEIEDVVKKLRDLSERNVRDIDRLVKEIDELLKRDKEEIKRVVDDIKRRVREIKKIIEEDRDKEKLRELVRKVEEDLEEIVKEVKRHSDELAKRLREIVERVKRHSEEVIKTLRELVDRVRKRVREEKEMLDRLRKVVDELVKENKKAVEDLKKRVEDVIRESKRVVEEARRVVDELKKELRDELK

SEQ ID NO: 24634 - protein, 186 aa, Artificial Sequence; identical to SEQ ID NO: 24633
  Synthetic sequence.

SEQ ID NO: 24635 - protein, 188 aa, Artificial Sequence
  Synthetic sequence.
SEIEKLVEEAKRLVKEAEDRLRKLSKESEESVRRVVKTLKDLVRELERLVEEVRKIIERNEGKEELEELVDRAKRKLEEVLKRVTELVKRHHEKNEKSLRDVEDLARRVKRKLEDILREVRERVTSDEMRKRVKELEEAVKELTKEIKEVVDRHRETVERSSRKVKTVLDDLRRVVEEILRRVEDAAR

SEQ ID NO: 24636 - protein, 188 aa, Artificial Sequence; identical to SEQ ID NO: 24635
  Synthetic sequence.

SEQ ID NO: 24637 - protein, 188 aa, Artificial Sequence
  Synthetic sequence.
KKIEDLVEEIKRLSDENRRRVERLSEDSKRSLEENKKKLKELVERIKKLLEEVSDKIRKDEDKDRLRELVKRLKEKLRELLEEARESSERHHRENEKSLKEVEDSSREVRKTLEKLVEDVRRDSTSEEAEERLRRAEDTVRRLVERNREVLEEHERTLRRSSEESKRALKEVERVVREVLKRVDEELQ

SEQ ID NO: 24638 - protein, 188 aa, Artificial Sequence; identical to SEQ ID NO: 24637
  Synthetic sequence.

SEQ ID NO: 24639 - protein, 188 aa, Artificial Sequence
  Synthetic sequence.
DELEKLVRDLEKRVKEVKDELKRSSEESERSLDEVRKTLKKLVEEMRELLKEVKRIIERNEDRDELKKLVEEAERRLREVLERVRKLVEEHHRRNEELVRRSRELVDDLRRELEELEKDVRDKSTSEEARERLERLRKRVEELLREVEKALEDDEKTVRESSKRIKKVLKELEDTARELVKEVRETAR

SEQ ID NO: 24640 - protein, 188 aa, Artificial Sequence; identical to SEQ ID NO: 24639
  Synthetic sequence.

SEQ ID NO: 24641 - protein, 188 aa, Artificial Sequence
  Synthetic sequence.
SELEKLVRDLERLSEDNKRRLKESSKESKESLDRVRETIKRLVEEAEELLKRVVDTIRRTEDKEKLDKLVEELKRRLEKLVRELKELVDRHHKRNEELLERSRRSSEDVKKKLKEVLEDVARKSTSEEARERLERLREKVEELARDNERALREDERTVRESSERLRKVLEEAKDRIDKLVKAVEDAAR

SEQ ID NO: 24642 - protein, 188 aa, Artificial Sequence; identical to SEQ ID NO: 24641
  Synthetic sequence.

SEQ ID NO: 24643 - protein, 188 aa, Artificial Sequence
  Synthetic sequence.
SELEKLVEEAKRLSDKNEEDLRRSSRESRESLKENKERIERAVKRLADLVRDVKEKIKRTESKEDLKRLVDELRERLKRLLEKVRKSSEEHHRENERLLRESTKSSEDVVRRLDEIAEEVARRSTTEEMKERLERLRDTLKKLKERNKEVLREDRETVTDSSRRSEEVVREAEERVERLLREVEEAAR

SEQ ID NO: 24644 - protein, 188 aa, Artificial Sequence; identical to SEQ ID NO: 24643
  Synthetic sequence.

SEQ ID NO: 24645 - protein, 188 aa, Artificial Sequence
  Synthetic sequence.
DELEKLVRELEELVKRVKEELERSSKESEDSLRDVKKKIEDLERKLDKLLKEVTDEIRRNESREDLKRLVEEARRTLEKVLDDIRKLVEEHEKKNKKLLDDSRELVERLKERLEEVEKDVRDKSTDDEMRKRLEDLERKVRDLARRVEKALEEDERTVRESSKRIRELLKRLEDKVRKIEKDVDDARR

SEQ ID NO: 24646 - protein, 188 aa, Artificial Sequence; identical to SEQ ID NO: 24645
  Synthetic sequence.

SEQ ID NO: 24647 - protein, 188 aa, Artificial Sequence
  Synthetic sequence.
SELERLVREVRELSDDNRRKLERSSRESERSAKEVERTLEKLVKELRELVERVKRDIERVRDESRLKELVDRARKTLEDVLRDVKRLVDEHRERNRELLERSEKSSRDVEERLKDVVRDVREKSTTEEMKERLKELEKEADDLRRENEELLDRDRRTVEESSKRVEKALRDLEREVRRILREVEETMR

SEQ ID NO: 24648 - protein, 188 aa, Artificial Sequence; identical to SEQ ID NO: 24647
  Synthetic sequence.

SEQ ID NO: 24649 - protein, 188 aa, Artificial Sequence
  Synthetic sequence.
SKLERLVEELKRLSDENVKDLERSSRESEESLKRNKEEIERVVERLRELLEKVVRDIKDDEGRERLDKLVRDLEEALKELVKRVRKSSEDHKRRNEELLRRSEESSRRVEEVLRRVLEEVTRDVTSEEAKERLDRLREAVEKLREDNKRALDRDRETVERSSKKSEDAVRRAEEDVRRLTETVRRAKK

SEQ ID NO: 24650 - protein, 188 aa, Artificial Sequence; identical to SEQ ID NO: 24649
  Synthetic sequence.

SEQ ID NO: 24651 - protein, 188 aa, Artificial Sequence
  Synthetic sequence.
SEIEDLVRKLRELLRDVKKKLKESSKRSEDSLRRVKEEIDKLVEELKKLLDEVKKEIERTEDKDELRKLVEEAARTLKRELDRIEEEVRRHDELNKKLLDESRKLVEDAARELEKLVEEVRRRSTTEEAEKKMRELEEEVKKLLEEVDRALKDDERTLRKSSKDIKKVLDDLRRTVKKLKEDVEETMR

SEQ ID NO: 24652 - protein, 188 aa, Artificial Sequence; identical to SEQ ID NO: 24651
  Synthetic sequence.

SEQ ID NO: 24653 - protein, 188 aa, Artificial Sequence
  Synthetic sequence.
DEIERLVEELRKLSERNKRELDRSSEESRESLKRVKEELKKIVEELRRLLEEVKDRIRKDESREDLERLVKELEERLRKLLDEVRELVERHDERNKKLLDESRKSSKEVKDELRKLLEDVERKTTSEEARERAKRLEKEVRDLAKENEKALEEDERTVRRSSEEIADLLRKVEKVVRELLEEVRRAAK

SEQ ID NO: 24654 - protein, 188 aa, Artificial Sequence; identical to SEQ ID NO: 24653
  Synthetic sequence.

SEQ ID NO: 24655 - protein, 188 aa, Artificial Sequence
  Synthetic sequence.
SSLEDLVRRARELSDRNREKLKRSSDESRESLKRNEEEIRRLVEELRELLERVRDLIRKLEDKDTLTELVERLKRELERVLEEVKKSSEEHDRRNRKLLEESRRSSKRVKEELKKLVEDADKEVTSEDAKRDLDRLRREVERLIRDNERLAEEDARTVEKSSRDSKKLVEDLEREVEKLRREVERDRK

SEQ ID NO: 24656 - protein, 188 aa, Artificial Sequence; identical to SEQ ID NO: 24655
  Synthetic sequence.

SEQ ID NO: 24657 - protein, 188 aa, Artificial Sequence
  Synthetic sequence.
SSIEDLVRRLRELSKRNTEELKRSSEESEDSVREVEDRVRELVKRLRELLKRVEDLIRKIEGKEELEKLVRDAKKTLDDVLKEITDLVKEHNDRNRRLLEESEESSRRVKEKLKKVLEDVRRESTSEEMEKRAKELEEEVRDLTRRNEDALRRDRDTVKRSTERVDKVLKDLEREVRDIKRRVDEATK

SEQ ID NO: 24658 - protein, 188 aa, Artificial Sequence; identical to SEQ ID NO: 24657
  Synthetic sequence.

SEQ ID NO: 24659 - protein, 188 aa, Artificial Sequence
  Synthetic sequence.
RELDELVKELRKLVEEVKDELRKSSKTSKELVEEIKERLERLVRELKRLVDEVRKTIRRLEGEKELRDLVRKAKKRLEDLTREVEKLVREAHERNKKLLEESERLVDRLRERLEELARDVATKSTSEDARRKLEELKETVRELLREVEKALDEDRETVKRSSEEVEEMLKDLRRRVTELDERVEREAT

SEQ ID NO: 24660 - protein, 188 aa, Artificial Sequence; identical to SEQ ID NO: 24659
  Synthetic sequence.

SEQ ID NO: 24661 - protein, 188 aa, Artificial Sequence
  Synthetic sequence.
DEIEKLVEDAERLSRENEKRVRKSSEESKKLVKEALDELKKLVEELEKTVRDVDREIERNEDRDELRRLVEDVRRRLEELLRDVRRLLEEVHRTNEKLLEDSERSSREVKKDLKRLVEDVRRKSTTEEAKKRMEDMERRVRELEKRNKKVLDEDRETVRKSSKDLEDAVRELEERVRRLAKKVKESAD

SEQ ID NO: 24662 - protein, 188 aa, Artificial Sequence; identical to SEQ ID NO: 24661
  Synthetic sequence.

SEQ ID NO: 24663 - protein, 188 aa, Artificial Sequence
  Synthetic sequence.
RELEELVKRLRELSRENEERLRRSSDESRKLLERNKERVKKVVDDLRRLVEEVKKEIERDRDRKRLEELVRRAKEVLERLLRDVRKSSEEVHDRNRKLLEDSRRSSKRVKEDLERVRRDVAEKSTSDDARRRLKELEEEVKRLAKRNEDLLREDERTVRESSRRSEDVVRRAEEMVRRLLEEVERARK

SEQ ID NO: 24664 - protein, 188 aa, Artificial Sequence; identical to SEQ ID NO: 24663
  Synthetic sequence.

SEQ ID NO: 24665 - protein, 188 aa, Artificial Sequence
  Synthetic sequence.
SELEKLVDELRKLSDENRRRLEKSSRDIEKLLKEIRDRIEELKKEIEDLLKEVKERIERLEGRDELRRLVDELRDRLRRLLEEIKRLVEEARKRLKEVLDRSEKSSRDVKRTLRKVLEDARRRSTTEEAEELLRRLEKRVEELARENEEMLKRDEDTVEEVRKRVTDVLRELKRVVEEVRRKVEEEAK

SEQ ID NO: 24666 - protein, 188 aa, Artificial Sequence; identical to SEQ ID NO: 24665
  Synthetic sequence.

SEQ ID NO: 24667 - protein, 188 aa, Artificial Sequence
  Synthetic sequence.
SKLEKLVKDAEELSRRNEEELRRSSDESRKLLEKNKRRVERLVEELRKLVKKVRDDIRRERDEEKLRKLVEDVKRRLRELLEEVRRSSEEVKKRNRELLERSTKSSKEVEDVLRKVLEDAARDSTTREAEELLRRLEEMLRRLTKKNRELLRRDEETVRRSSKRSEEVVRRAEEEVERLVKDVEDTRT

SEQ ID NO: 24668 - protein, 188 aa, Artificial Sequence; identical to SEQ ID NO: 24667
  Synthetic sequence.

SEQ ID NO: 24669 - protein, 174 aa, Artificial Sequence
  Synthetic sequence.
KDEERAKKVVEEIKKRVTEIVRRHHKTNEDLVRRVRESSEKHHRRNEELKERVTRKIRKEELLRKLKKLLDESSERSKRLVDELEKEVRKSSEDLRELLKRLTDRLEEVKKLIEDGADIETLVRELEELLKRLEDEVRRLTKRSKEVIDRIHKLNEDLTRESERVLKEVEDRDR

SEQ ID NO: 24670 - protein, 174 aa, Artificial Sequence; identical to SEQ ID NO: 24669
  Synthetic sequence.

SEQ ID NO: 24671 - protein, 174 aa, Artificial Sequence
  Synthetic sequence.
RETEEVKKELDKLVEEAERAVREHHKENDRLVKRLEEVIRRHEKSVRELVEKVRREVRDESVVRELEEVAKESLERLRKLLEELVKRAEDSSREVEKLLRDLRRDVEELKKMVENGVDLEKIVRRARELVERLKERLKELTRRSEELVKDLERKIERLSRELARIVKEVLDRDK

SEQ ID NO: 24672 - protein, 174 aa, Artificial Sequence; identical to SEQ ID NO: 24671
  Synthetic sequence.

SEQ ID NO: 24673 - protein, 174 aa, Artificial Sequence
  Synthetic sequence.
SREEEAKKRLEELLREVEKVVRDHHRENEKIREEVERVVEKHKKRNRELVEAVRKRIRDKDVVKEAEDLLRKSSKDLEELLRTLEELIRRASERLREILERVERVVRELKKLVESGMDVREAVERLKEIVERVRRKVEKLTEDSRRVLEELKRRIEKLTRDSERVLKEIEDRTR

SEQ ID NO: 24674 - protein, 174 aa, Artificial Sequence; identical to SEQ ID NO: 24673
  Synthetic sequence.

SEQ ID NO: 24675 - protein, 174 aa, Artificial Sequence
  Synthetic sequence.
SDKEEVKKEIKKLKEDIKRAVDEHRKVNKRILEEAEKSSREHEKENRDIVRRVREEVEKREVVRTLEERIRRSSDTSRELLRELKERLEDSTRKVEELLRRAEKVLDEALKLIEAGEDIKEVVKELKKILEKLKRELEDLSRKSEDVLRRLHELNKRLTDDSRRVLDEVREDTK

SEQ ID NO: 24676 - protein, 174 aa, Artificial Sequence; identical to SEQ ID NO: 24675
  Synthetic sequence.

SEQ ID NO: 24677 - protein, 185 aa, Artificial Sequence
  Synthetic sequence.
SEVDRLLKELEDVLKKVEDDIRRHIKRNEDILRESKKLADKLITEIEDMLRKVEEMIRNNSSEDTLRELLERLRDLVKKIRDRVEESDDRLRKLVEESRRNLEELLERLKRLVEKIKEDLERTVDDEEAVKRLEDTARRVEEEVRRLIRELEDTSRRVLEESRKISKELDERLRRVIEEVEKAAK

SEQ ID NO: 24678 - protein, 185 aa, Artificial Sequence; identical to SEQ ID NO: 24677
  Synthetic sequence.

SEQ ID NO: 24679 - protein, 185 aa, Artificial Sequence
  Synthetic sequence.
SELEKLIKEIRDILKESEDAIKENLDRNEEALKRVAEEIKRLIDELRKMLEDVKRMIRDDSSEETLKKLLDDLRKLVEEIRRRLKRLLDELRRLVEESREDLERLDEELKRIVDRIDKDAEEKVDDRRAVERVREELEKVIRDSRKLSRDLEEASRRVEEDVRRLIEELERRLKEVIKAVEDAAR

SEQ ID NO: 24680 - protein, 185 aa, Artificial Sequence; identical to SEQ ID NO: 24679
  Synthetic sequence.

SEQ ID NO: 24681 - protein, 185 aa, Artificial Sequence
  Synthetic sequence.
DEVEKLAEELREILKRSEEMIRENLKRNRDLLRRSKEEVDKLKDELEEMLRRVRRVIEDNSSEETLKRLLEELKDLVRRIREELKRSDDELRKLVKESKDNLRDLDRRLREVVEEIRKRLEDEVDDRELVKDLERKAREVIRTSEELSRRLAKTSEEVLEESERVVEELERRAERVEEEITKAAK

SEQ ID NO: 24682 - protein, 185 aa, Artificial Sequence; identical to SEQ ID NO: 24681
  Synthetic sequence.

SEQ ID NO: 24683 - protein, 185 aa, Artificial Sequence
  Synthetic sequence.
SEVEDLLRKLEEILRRSKENVERNVRENREMLKKVEKTIRDLIRRAEKLLREVEEAIRNNSSEETAKKLLEDLEREVKKIRDTLKKLLDDLKKLVEDSKRDLEEVDKRLEDVVRKIKDELRRRVDDEDAVRRLEKELERVIKTSRDISERLERESRRVEEEVRKLIEELSRRLEEVRERVKEATR

SEQ ID NO: 24684 - protein, 185 aa, Artificial Sequence; identical to SEQ ID NO: 24683
  Synthetic sequence.

SEQ ID NO: 24685 - protein, 185 aa, Artificial Sequence
  Synthetic sequence.
REVEEALKDLERILKESEDNVRRNIKKNEDLLRRVEERIRELLDEARRLLERVKEVKKDNSSEDELRELLERLKKAVEDIERELKKLLEDLDKAVRESIEDLKKSDRDLEEVVKKIKEDLRDRVDDKDLVERLKEELERVTRDSRRVVDELRKRSEKVREDVRRLIEDLRRRLEKVIRDVEEDAR

SEQ ID NO: 24686 - protein, 185 aa, Artificial Sequence; identical to SEQ ID NO: 24685
  Synthetic sequence.

SEQ ID NO: 24687 - protein, 178 aa, Artificial Sequence
  Synthetic sequence.
DETERIIRDLERVLEEIARLAKKNIDDSRRVLKELAEKLKRDSERAKKLLEDVEEIIRRNEKDKRDVVREVEKVLKESKKSSEDVARELKDVLRKSRKSAKDLERTVKKVLEDMKEKVDRRLDEDVDRVVRKVLEDLRRLLEEVKKVNDDSEKEVRRLLEENERKNRRVEEEVKKLLK

SEQ ID NO: 24688 - protein, 178 aa, Artificial Sequence; identical to SEQ ID NO: 24687
  Synthetic sequence.

SEQ ID NO: 24689 - protein, 178 aa, Artificial Sequence
  Synthetic sequence.
SELEDIIRRIEEVLKRNEELNRKNIKESRDLLEEIRRKAKEDSDRVKEVLRRLEDEVRRNELPKEELERKLKEVLDRSKRSSEELKRDVERVLEDSERSVREVVKRDEDSLREIEKLVKERADEEVKRKVDKVVEDIKRVSEESTRANDESRRALEKVVKENEDTNREVVKRVRDAEK

SEQ ID NO: 24690 - protein, 178 aa, Artificial Sequence; identical to SEQ ID NO: 24689
  Synthetic sequence.

SEQ ID NO: 24691 - protein, 178 aa, Artificial Sequence
  Synthetic sequence.
SELEEIIDRIRTVLERNRELNERNIRESKRLLDEIKKRVEDDNERSKDIVRRVETEVRERRLPEEELRRKLAEALERSKDSSRKLAETLRRLLEDSKRSAREVVERDRKSLEDIKKLVEDRADERVDEVVEKVLDEMRKVSRTSEESNRKSEEEVRKVLKENNDMNRESVERLRRTEE

SEQ ID NO: 24692 - protein, 178 aa, Artificial Sequence; identical to SEQ ID NO: 24691
  Synthetic sequence.

SEQ ID NO: 24693 - protein, 186 aa, Artificial Sequence
  Synthetic sequence.
DEVRRVIEELERLLEENRRHSKEDNERSKKINKENHDHSKESTDRAEKLLREVEKLIRETEDKDTIKKIIEEIIRTAEDLVRRNERKAERSIEELERSLRRNATLSEKIIRDARRLIEELVKRKGKDTDRVRDVDRTVKRVVKESRRSTRENEKTNTDVVRSTDESLKEDKKEVDRVIEELDRAVR

SEQ ID NO: 24694 - protein, 186 aa, Artificial Sequence; identical to SEQ ID NO: 24693
  Synthetic sequence.

SEQ ID NO: 24695 - protein, 186 aa, Artificial Sequence
  Synthetic sequence.
SEAEKVIEDAKRLLKENEDHSKEDNDRVRELLEEVKRHSEESTRRAEKILEEIRELVEKVSEKDKISEEVERVIEELRKLVDENRRRIEKIIRDSEKSVERNRRLSEEIIRRLEELIRDLIRKKGKDTEEVKRVEDEVRKLVKASRESTERNERTNREVAERLKKSLEEDRERVRKVVEDLRRAEK

SEQ ID NO: 24696 - protein, 186 aa, Artificial Sequence; identical to SEQ ID NO: 24695
  Synthetic sequence.

SEQ ID NO: 24697 - protein, 183 aa, Artificial Sequence
  Synthetic sequence.
DELRKVLKESEDSLERLRRTLEESIKRSRDSLRENTELVKDSLRRSEESLERVEKSNTDSEEAKKIADDVVRENRELVKRVRKHSKDVVDTNRKLVDDVRKIVDRVVRENEKVLREVRRDMRENKEMLKRLEDEIRRSIEELRKALRRVEEEHRKVIEASKDLVRRLEEAHKEVIDRLKEKLR

SEQ ID NO: 24698 - protein, 183 aa, Artificial Sequence; identical to SEQ ID NO: 24697
  Synthetic sequence.

SEQ ID NO: 24699 - protein, 183 aa, Artificial Sequence
  Synthetic sequence.
DEIERVIEESRKSLDDLRRKAEESIRRSEESLREVEERLKRSIREAEESLKKVENSNKDSKELKDLVEKVVRDNRKLVEEVKRIVEKVVRDNERVVDEVRRRVEEVVKENRKRLEEVRRELKDNDEVVRELKKMIDKSERDLEELLDRVRRKHERVIEELKKLLKRVKDAHERVIRELEKTRK

SEQ ID NO: 24700 - protein, 183 aa, Artificial Sequence; identical to SEQ ID NO: 24699
  Synthetic sequence.

SEQ ID NO: 24701 - protein, 185 aa, Artificial Sequence
  Synthetic sequence.
SEVEDLIRRVRKSNKESEDVLRESIERSEESNERSERTARRIIEEAERILEEMEESLKKGLPEKDLKKIADELRERLKRLLERVKRVVDEDRRTNEELVRRVEKIVKEDEDRLKELLDEVRRLDLPEEVVRRLEEEVKRVAEHTRKLLKDVRKKHEESIRHSEEVLDRLEKKLREIMKRVTERTK

SEQ ID NO: 24702 - protein, 185 aa, Artificial Sequence; identical to SEQ ID NO: 24701
  Synthetic sequence.

SEQ ID NO: 24703 - protein, 185 aa, Artificial Sequence
  Synthetic sequence.
KEVEDIIEDVKRSLEESKRMADKSITDSRRSNEESKRIVEEIKRKIDEILERIERKARKGEPKEDLDRIVKELKEELKRLLEEVTRVLEEDADRNRKLLKEVEKIVKEDRERLEKLLDEVRKLDLDEKVVRELEKRVKEVVKTTEDVLREVERTHRESIKHSEDLVRRLEERLRRVAKEVERTRK

SEQ ID NO: 24704 - protein, 185 aa, Artificial Sequence; identical to SEQ ID NO: 24703
  Synthetic sequence.

SEQ ID NO: 24705 - protein, 185 aa, Artificial Sequence
  Synthetic sequence.
SEVEKAIKEARDSLRESKRLLEESIKRSEDSLEESRRVVEEIKKRLEELLREVKESVDQGQPEDDLRKIVEEAKRRLKELLDRVREIVERDERRNRELVKEVRKIVEEDLKRLEDLLRRIRNLDLDEKKVRDLERMVKRVMEETEKALEDVERRHEKSIRDTRRVLKELEDTVRKVLKEVDRERQ

SEQ ID NO: 24706 - protein, 185 aa, Artificial Sequence; identical to SEQ ID NO: 24705
  Synthetic sequence.

SEQ ID NO: 24707 - protein, 185 aa, Artificial Sequence
  Synthetic sequence.
SKLEKVITEVRDSLRRSRKMAEDSIRRSEELLKELEDLLKKVRDTLRKILKDIEDLARKGLPKEELTRIVDELEKRLKRLLDEVDKALKRLVKENERLVEEVREIVERDKKTLDKLLEDIERLDLPKELVDDVRREVEKVVEDTRRVLEEVERTHKESIDRLRKLVERVRREIEEIARRVKETRD

SEQ ID NO: 24708 - protein, 185 aa, Artificial Sequence; identical to SEQ ID NO: 24707
  Synthetic sequence.

SEQ ID NO: 24709 - protein, 183 aa, Artificial Sequence
  Synthetic sequence.
SVVEKLKDEADKLVKRNEDLARRLEEVSKDTIDRLEDVLRKLREVLKRLRRRLEEVLKRVDREELKRDVEEVEKELEELVRKIEKEVKDVVRTSRELVERVKRTLEDDIRRMEDLARKLSRLTDREKFEEVIKRLRDSSKRSEDKIRKVLKDSRDLLEDVRRKIEDVIRRMEKLIKEVEDRVR

SEQ ID NO: 24710 - protein, 183 aa, Artificial Sequence; identical to SEQ ID NO: 24709
  Synthetic sequence.

SEQ ID NO: 24711 - protein, 181 aa, Artificial Sequence
  Synthetic sequence.
SVVEELERVMRELKKRNEELSRENHESVKEAEKRNKRLSEELEKVSRDVIKDLERVVEEVEEVKDEVKRVIDESKRSLEEVKRHSERVVKRLRDLNKDSEDHSREIVRTMEKLLEDARRLTDEREIRRIIEELKRLSDENEERIRRISEEIKDLSRRNEETVRRVIEENRKLLEDATRRTK

SEQ ID NO: 24712 - protein, 181 aa, Artificial Sequence; identical to SEQ ID NO: 24711
  Synthetic sequence.

SEQ ID NO: 24713 - protein, 181 aa, Artificial Sequence
  Synthetic sequence.
SLREKLKEVIRRLEEENRRVSEENHRSVREVEEENRKVSDELRKVAEELKRRLEEVVRRVREVEELVRELVERMERILRRVEDHSRRVVEELRKLNEESERHSRDVIRKLRELLERAKRLTDSREIEDIIRRVKKLSKENKETIERISREIRELSKRNEEEVRRVIRRLEELLEELERTAK

SEQ ID NO: 24714 - protein, 181 aa, Artificial Sequence; identical to SEQ ID NO: 24713
  Synthetic sequence.

SEQ ID NO: 24715 - protein, 181 aa, Artificial Sequence
  Synthetic sequence.
RVIEKAEEVVDRLKKRNKEVLKENHDSVREVEKENRELLEKAEKVVRELEERLKEVVEEVSEVTEDIRRVREELKKILEDVARHSKETIDLLRKLNKESEKHSEKTMRDLEKLLEELRRLTDEREIERIIKEAEELSKRNEEVIDEISKRIKELSERNRERVEKVIEEAKELVKRVTDKVK

SEQ ID NO: 24716 - protein, 181 aa, Artificial Sequence; identical to SEQ ID NO: 24715
  Synthetic sequence.

SEQ ID NO: 24717 - protein, 178 aa, Artificial Sequence
  Synthetic sequence.
KDEEKAEDVVRRLTEEVRRVHEKTRDVVRRVTERSNDVSRRSKEEVRELLERADDLARKGKISEELVRRVKEELERVVREDEELNEDLKRKLDDLLRRDEKLVREIERRLEEVVKLVRDGMSVEDLIRELKRLVDELRERSEDLIRKAERVLERLEEESRRLLKELRDLLEDVTRKAE

SEQ ID NO: 24718 - protein, 178 aa, Artificial Sequence; identical to SEQ ID NO: 24717
  Synthetic sequence.

SEQ ID NO: 24719 - protein, 178 aa, Artificial Sequence
  Synthetic sequence.
SETEKAREVVRELEKRNDEVHKETRDVVRRLEETSDEVSKDSERKVDRLREEVKKVRDDGKVDDKLVKDVEDKLKKVTDEDRRLNEEAKKELRRVVEEDRRSVEESRKRLEEVVRLVEDGKDVEELIRRMEKLTEDNERRSRKLIEELKRLLEDLREKSERLIRELERLVKELRDRAE

SEQ ID NO: 24720 - protein, 178 aa, Artificial Sequence; identical to SEQ ID NO: 24719
  Synthetic sequence.

SEQ ID NO: 24721 - protein, 178 aa, Artificial Sequence
  Synthetic sequence.
SEKEKAREVVKKLKKRVDEAHKKTKDVVEELRKRNRDVHRTTREVVRDLLKKVKDVERRGEVSEEVVRRVEERLREVVEEDEKSVRESERVLDEVEKDDRRLVEEIRRRLEDVVRMVEAGKDVETLIERLRELIDELRRRSEKLIKELREVTKRNKERSDRLIKELEDLVKKLKDDAT

SEQ ID NO: 24722 - protein, 178 aa, Artificial Sequence; identical to SEQ ID NO: 24721
  Synthetic sequence.

SEQ ID NO: 24723 - protein, 186 aa, Artificial Sequence
  Synthetic sequence.
DEVEKLIEDLKRIVERDEREIRELIKELDDHVRKDEKIARDLERRLKEILDEVRKMVTDNSSEETVTRLLREVEELVRKIEKDARDSLESNRELAERIKERAERSLRELEKRVTEIEERLKERLREKKELLEKVKRVLEEVRRRSRETLERLREVLERSIRDSERTLEKVREMLERVRKEIEKLRK

SEQ ID NO: 24724 - protein, 186 aa, Artificial Sequence; identical to SEQ ID NO: 24723
  Synthetic sequence.

SEQ ID NO: 24725 - protein, 186 aa, Artificial Sequence
  Synthetic sequence.
SEVEELDKRLRDHVRRDEEIVERLIRELKRHVERDREEARRLIEELRRLLEEVKRMMEDDSREDDVRRLLEEVRELVARIIERAEDSLRSNEDLVRKIEERLRRSLKSNRDLVKEIKKILDRDLREDRKLVRDVEKSLEESIRRSEETLKTVKDVLDKSKEDSKRTVEDVERVLREAEKEAKRATD

SEQ ID NO: 24726 - protein, 186 aa, Artificial Sequence; identical to SEQ ID NO: 24725
  Synthetic sequence.

SEQ ID NO: 24727 - protein, 186 aa, Artificial Sequence
  Synthetic sequence.
SEAEKLIKELEDHVKRVEDRARELIDELRKHVEEDERRARKLIEELRRLLKEVKRMVDDNSSEEVVKRLLEEVRRLVEEIERRARKSLESNKELVKEIRERVTRLLESNRELVRRIEEVLDRDLREDEDLVRRVRKVLRRSEEDVRRLIEEVERVLKRSEEESRRTIREVEEVLKEVERAVEELAR

SEQ ID NO: 24728 - protein, 186 aa, Artificial Sequence; identical to SEQ ID NO: 24727
  Synthetic sequence.

SEQ ID NO: 24729 - protein, 180 aa, Artificial Sequence
  Synthetic sequence.
SLEDRVREVVERSERDLRRSTDEIRRVVEEAEKALRRLVREVEEVVREVKERLERVVREGRVDRETVRRVIEDIERALDEVRETVRKIIEDLRKILEDVRRHSERVIRENRKLLEAARNGDEDTVRKVIEDSDRSLEENKRLVKKVIDEIKERLKEMKKRAEEIIERLKKLLEEVEERAR

SEQ ID NO: 24730 - protein, 180 aa, Artificial Sequence; identical to SEQ ID NO: 24729
  Synthetic sequence.

SEQ ID NO: 24731 - protein, 180 aa, Artificial Sequence
  Synthetic sequence.
DLTKRVEEVVRRSRERLERSTRDIKRKAEEVKERLKKSSKEVEKVIREVETELERLRREGKVDEDTVREVLERIRRLLEEVKEHSKRVLDDIERLLRDLEEHSKEVVRRNERLLREIKDGDEKKVEEVLRRSEKSVRDNKKRVEEVAETLKKILTDNRRLVKRVKEELDKLIRDVEERAR

SEQ ID NO: 24732 - protein, 180 aa, Artificial Sequence; identical to SEQ ID NO: 24731
  Synthetic sequence.

SEQ ID NO: 24733 - protein, 179 aa, Artificial Sequence
  Synthetic sequence.
SEKEDVERVVERVKREADELLKENHKSVKDVDERVKETVERNHRSVRKAEEDVKRVEREDKRLKELVEELRRRLKELNDRSKKLSRESAERLKKLNKESEEVIREVKRRAEEIVEMVKRGDVEVREVAKELEDIVRRIKELVERSNRELKKIVEDNERVVEESDRRIKEILERITEASR

SEQ ID NO: 24734 - protein, 179 aa, Artificial Sequence; identical to SEQ ID NO: 24733
  Synthetic sequence.

SEQ ID NO: 24735 - protein, 179 aa, Artificial Sequence
  Synthetic sequence.
SEKETVEEVVDKVRRDLDKSLEDNHKSVEEVRRRVEKTLRENHESVERARKRARDLEREDRELKEMVERAEEELEKLNRESADISRRSEERLEELNRRSKRLTDESKRKLEEIKDVVRRGDIEVREVVERAKRILEDNKKKIDESNERLERIVRENKEMVERSDRRIEEIVERIERETR

SEQ ID NO: 24736 - protein, 179 aa, Artificial Sequence; identical to SEQ ID NO: 24735
  Synthetic sequence.

SEQ ID NO: 24737 - protein, 179 aa, Artificial Sequence
  Synthetic sequence.
DEKEEVEKRAEEVRKKVDKLLKENHESVEDARRRVDKTLRENHESVEEVKRRVDEVRREDERLERVVREIKKRLKKLNDESKKLSDDSKERLKRLNEESEKVARDIKRELKRIVELVRRGDVRAEDVMEELDRLVEDLRRKVEDSNRKIKRIVDENKREVEKSNRKLRELLKELEDRAR

SEQ ID NO: 24738 - protein, 179 aa, Artificial Sequence; identical to SEQ ID NO: 24737
  Synthetic sequence.

SEQ ID NO: 24739 - protein, 179 aa, Artificial Sequence
  Synthetic sequence.
SKKEDAERVVREVTREVRRLLKENHDSVREVLKRVDETVERNSRSVKEVLRKVREVEREDRRLREVVKEIEKRLRDLNERSKKLSKESKEELKKLNDESRKVVEEIERRLKELVDLVRRGEVDLKEVVDRARDLIRDLTRKVKESNERLEEIVERNEREVRKSDEDLKRLADDLERKAT

SEQ ID NO: 24740 - protein, 179 aa, Artificial Sequence; identical to SEQ ID NO: 24739
  Synthetic sequence.

SEQ ID NO: 24741 - protein, 179 aa, Artificial Sequence
  Synthetic sequence.
REKEEVERVVEDVRRRLDESLERNHKSVRDALREVDRTVEENSRSVEKVRKRLKEVEREDKELEDLVRKIKEDLDRLNEESRRLSEDSKRRLKDLNRKSAKITRDSKEELRRIVEAVRRGDVEVREVKKELEKIVRDNERVVEDSNDKIRRIVTKNTEDVKRSDETLERIVEEIERRAR

SEQ ID NO: 24742 - protein, 179 aa, Artificial Sequence; identical to SEQ ID NO: 24741
  Synthetic sequence.

SEQ ID NO: 24743 - protein, 179 aa, Artificial Sequence
  Synthetic sequence.
KEKEDVERKVEDVKRDVDRVLEENHRSLKEAEERSNKLSDTSRRVAKRVVDDVRRLKREDERLVRLVEELKKELKRLVEEDKKINDEIREELRRLNEDSKRVVDDLKRRLKEIVDAVRRGDIDVKEVVDRLEKIVRDIRKEIERSNRDVERLVRTLEEVSKRIIDTLERIIDKIREDTK

SEQ ID NO: 24744 - protein, 179 aa, Artificial Sequence; identical to SEQ ID NO: 24743
  Synthetic sequence.

SEQ ID NO: 24745 - protein, 178 aa, Artificial Sequence
  Synthetic sequence.
SEAEELIEELERIAEEDRKLVEDSIRKLRKILDEDRKIMKRLAEELDRILEDVKRKVDKGLSEKELKDVVKEVEDKLREVLRRAEESVRESEERLRENEERNKESVERSRERLDRVIEDVDKVKELEEVVRKVKRESDRTLEKSKKVVDEVRRRSEETLEKLRRVVERVRKRVDEASK

SEQ ID NO: 24746 - protein, 178 aa, Artificial Sequence; identical to SEQ ID NO: 24745
  Synthetic sequence.

SEQ ID NO: 24747 - protein, 178 aa, Artificial Sequence
  Synthetic sequence.
DRADELRERLKEIMERDRRIMKELEDELRELVERDERIIRELERRLEEIVKDVERKAKSGQDEESLKRVVEEAERVVEEVEKRVRESVKKTKDALDELIRRAEDSVRRSREELEDLIRKVSDVDELRRVVEEVEKDSERTLKELRRVVKEVEERVEKTLRDLEEVLERVKERVKRLKD

SEQ ID NO: 24748 - protein, 178 aa, Artificial Sequence; identical to SEQ ID NO: 24747
  Synthetic sequence.

SEQ ID NO: 24749 - protein, 178 aa, Artificial Sequence
  Synthetic sequence.
KEAEDLMREVEELVRRDEEIIKRLADELEEIVDDNRRKVEDLVRRLEEILRRVEESMRKGLSEEELRRVVEDVERRLRELIREAKRSVEESRRRLEEVRKRVEESVERTKRELDRLIEEVKDVKELREVIERARKRVEETLRELERKLEEVRKTSEDLLRRLEEVVKRVKEEVEKLEK

SEQ ID NO: 24750 - protein, 178 aa, Artificial Sequence; identical to SEQ ID NO: 24749
  Synthetic sequence.

SEQ ID NO: 24751 - protein, 178 aa, Artificial Sequence
  Synthetic sequence.
SEMDELRKELEDLARDDKRRVEESIRRLEKIAEDNERLARESIKRLRRLVTELEKLARKGLSEEELERVVRRIDEELKRNEEENRRSVEKSERDLRRNEEENKRSVDETEEVLRRLIEEVKDVKELKEVVDRVREIVKKTLEESREVVKKVREDSKRLLEESKRVVEEVKKRVEELKK

SEQ ID NO: 24752 - protein, 178 aa, Artificial Sequence; identical to SEQ ID NO: 24751
  Synthetic sequence.

SEQ ID NO: 24753 - protein, 175 aa, Artificial Sequence
  Synthetic sequence.
DEVEEVKEELKRTSRDDERKVEEIRKRLEESTRRLRELAEELKDELRKSSRDLERLRRENKDLTDVLRKNEELVKRIDDKLKKVLEDNKRLVDEIRKTAEKSVRDNEEVVRRIKEELKDVREVERALERSLKRSDETVKEVEELLRRSLEDSKKLLEEVREALERSKKRSDELRR

SEQ ID NO: 24754 - protein, 175 aa, Artificial Sequence; identical to SEQ ID NO: 24753
  Synthetic sequence.

SEQ ID NO: 24755 - protein, 175 aa, Artificial Sequence
  Synthetic sequence.
KEVEDVKEELRRSSKKLRELAERLKKLLEDILDEDRKLAEEIKKRLEDSSRKIEELKRRNRDLTDILRENRELVERARRRAEESLKKVKELLDKIREAIREVLERNKELVDEIRKRLKDVDEVERMLKESDKESKRLLEEVDRMLKEVIKASKKSLDDVDRVLRRSERESEKRRK

SEQ ID NO: 24756 - protein, 175 aa, Artificial Sequence; identical to SEQ ID NO: 24755
  Synthetic sequence.

SEQ ID NO: 24757 - protein, 175 aa, Artificial Sequence
  Synthetic sequence.
SEVEKVKEELRESSRALRKLVEKIRRILRETSERDRDTVREIADRLRKSSRRVEELKRNNKDLTDVLRDNDRLVKEIEKRLKDSLDENKRVVDKLREEAKRALEENKKLVTRIEKDLKDVDEVRRVLEESERRSKKLLDEVEELLRRSERTSRESLKEVKERLRKSLEESERRAR

SEQ ID NO: 24758 - protein, 175 aa, Artificial Sequence; identical to SEQ ID NO: 24757
  Synthetic sequence.

SEQ ID NO: 24759 - protein, 183 aa, Artificial Sequence
  Synthetic sequence.
SLVERLKKVVEDAERELRRLTKETEDVLREAEETIKRLSERLKKANEDTERKIRRLAKENRDEKVIKKLEDVVRRSTKLVEDVHRDNERVLDEVRKLVDEVRKTNEDVLREVRRLMEELARLTDEKKIDDAIKRIRDLIERVEEINKEVVDRIKELIERVEEINETVIRDSERLIKEVEDEVR

SEQ ID NO: 24760 - protein, 183 aa, Artificial Sequence; identical to SEQ ID NO: 24759
  Synthetic sequence.

SEQ ID NO: 24761 - protein, 183 aa, Artificial Sequence
  Synthetic sequence.
SLEEDLRRVLEEVKRELKELSKRSKEVNRKTEETARRLSEKSEKVNRETKKRVEDLMRENRDEKVIRELRDAVRESTRLLEELKEDNRRVVERSTDLVRKVDRINREILKEVEELVRRLSRLTDEKAIRDAIRRLKELVERVKRTNEEVVKESEELIERVRERNDDAVRKSRRLIERLTEKVK

SEQ ID NO: 24762 - protein, 183 aa, Artificial Sequence; identical to SEQ ID NO: 24761
  Synthetic sequence.

SEQ ID NO: 24763 - protein, 183 aa, Artificial Sequence
  Synthetic sequence.
SLKETLEEVLKEVKRRIEDLSRRLEEVLRRAREELKRLSDDSRRVVEEAEERVRRLMEENRDEDVIRKLREALKEVRRLLEEVERRNRALMKEVEDLVRKVNKDNRRVLEEIKRIVEKLSRLDKKEEIKRVIDELRRLIEEVEKRNREVVEEIKRLIKEVADDNRRALERIRRLIRKLEEEVK

SEQ ID NO: 24764 - protein, 183 aa, Artificial Sequence; identical to SEQ ID NO: 24763
  Synthetic sequence.

SEQ ID NO: 24765 - protein, 183 aa, Artificial Sequence
  Synthetic sequence.
SLTERLREVLKKVEDTLRKLSERLRDVLRKAEKTIEEISRRSEEANRETKERAERLMEENRDERVIRKLEEVVRRSTKLVRDVDRRNKKVLRDVRELVKKVNEENKKVLKEAREKVDELSRLTDKDRIEDVIRELDRLLEEVRRINEEVLRRIEELIKRVKEENDRVMETSRRLIETVKEEVK

SEQ ID NO: 24766 - protein, 183 aa, Artificial Sequence; identical to SEQ ID NO: 24765
  Synthetic sequence.

SEQ ID NO: 24767 - protein, 183 aa, Artificial Sequence
  Synthetic sequence.
DKVRKILKEMRDLVRRNKEEIDRSIRKIEELIERNKREIDKSIEELKRLLDEVRKIVKDERDKEKLRRIVEEVDKRIEKIHKENEDHSRRSSEEVEKIHRENKEHSDRSSEDIRRLLEELRKDGLEMVRDVARVVKEVHDDNRRLTEKSERVVREAHRRNEEIVKASEEAVREAKRRLEELRR

SEQ ID NO: 24768 - protein, 183 aa, Artificial Sequence; identical to SEQ ID NO: 24767
  Synthetic sequence.

SEQ ID NO: 24769 - protein, 183 aa, Artificial Sequence
  Synthetic sequence.
DKVREILKRLEDLVRTNKERIDESIEELERLADENRRRIKKSIDDLRRLIEEVERIVKDRRDDRTLDKIVTEAKETVKRIHEENERNSKRSSETVKKIHDENREHSKRSSEEAKRLIDELRKDGLEVVRDVERVLEEVDRANRDLVRRSKEVVDKVHETNKKLVEESKEAVDRVTELLERARK

SEQ ID NO: 24770 - protein, 183 aa, Artificial Sequence; identical to SEQ ID NO: 24769
  Synthetic sequence.

SEQ ID NO: 24771 - protein, 183 aa, Artificial Sequence
  Synthetic sequence.
DEVEELVKKLEKVLREIEEMSERLSDENRKVLEKIKEDSKRLNEELERVLRRIREASRDKREEVLRKLVEELKKVLEEVRERSEDLLKEAKDIARESRKRSEELVRRLEEVLREVKRAAERDVKSELLERLREVLEDVKRKLDEIHRRNEESLERLEREVKRLNEDNRRSLKTVDDRLRETKR

SEQ ID NO: 24772 - protein, 183 aa, Artificial Sequence; identical to SEQ ID NO: 24771
  Synthetic sequence.

SEQ ID NO: 24773 - protein, 179 aa, Artificial Sequence
  Synthetic sequence.
SEKEKLDAVLREVEEAAKKNIDKNRRSLEEVAEVVRELVKENRKSLEEVKEMIERIIREIRNKEDLVRKAREVLKEIERLVRESIKELERLLKEIEKLVEESVRRSRKLVKEIEELVKKGGDDVEKIVEDLKRVLEESHKLSEDVDRLIKRVVEEAKKLSRDVNEDVKRVVKEVKDEAD

SEQ ID NO: 24774 - protein, 179 aa, Artificial Sequence; identical to SEQ ID NO: 24773
  Synthetic sequence.

SEQ ID NO: 24775 - protein, 179 aa, Artificial Sequence
  Synthetic sequence.
SEKEKLDDVLRKVKDTLAENIKNNKESLDRVREEIERNIRRNEESLDRARRTVEKIIEEIREDEDLVRRAEEMVRRVADLVRKSVERSRELLKRLEDLVRKSVEDSKDLLRRVEKLVREGGDDVEKLVEELRRLLKESHELSREVNDRLRRALEESHELSKEVNETLRKLLEDIRREAK

SEQ ID NO: 24776 - protein, 179 aa, Artificial Sequence; identical to SEQ ID NO: 24775
  Synthetic sequence.

SEQ ID NO: 24777 - protein, 179 aa, Artificial Sequence
  Synthetic sequence.
KDEERLKKVIDEVRKRVEENIRTNEDSLRKAEETLKRNIRKNEKSLEDARREIEELIREISDDEDLVRELEDVVRKIAELVKRSVEESERLAKELRDLVKESVDRSRKILEDLERDVERGGKDVEKLIKKLRDLLEESHRLSEEVNRTLKRALDESHERSKEVDKRIEEMVERVRRKVK

SEQ ID NO: 24778 - protein, 179 aa, Artificial Sequence; identical to SEQ ID NO: 24777
  Synthetic sequence.

SEQ ID NO: 24779 - protein, 179 aa, Artificial Sequence
  Synthetic sequence.
SEREKLEKVLEEARREIERLAEENRRSLDRARKEVKRLIDNNRKSLDDVRKRVDKLVKDISDDERLIRELERVVKDIEELVRDSERKAREMVKRVERLVRESIRRLEDVVRRLEDLVRKGGDDVEKLVEELKKVLDDVRKESERVNRTLKKLLEDIERLSREVNKRIKEMVRKATEDVR

SEQ ID NO: 24780 - protein, 179 aa, Artificial Sequence; identical to SEQ ID NO: 24779
  Synthetic sequence.

SEQ ID NO: 24781 - protein, 179 aa, Artificial Sequence
  Synthetic sequence.
SEKEELDKVLKEAEDKIEENIRDNERSLRDVERAVRRIIENNRESLEELDKAVKEIVRRISDRKELITRLDKAVKDVKRLVDRSVEEAKRIVDEARELVRRSVEESRRLVERLKKLVDDGGDDVKTLVEELRRALEESHKLSEDVNRALKKVLEEIADLSRKVNDKLRELLKRLEEEAR

SEQ ID NO: 24782 - protein, 179 aa, Artificial Sequence; identical to SEQ ID NO: 24781
  Synthetic sequence.

SEQ ID NO: 24783 - protein, 179 aa, Artificial Sequence
  Synthetic sequence.
SKEEKLDKKLKEAERTIRENIKENRESLERARKTLEENIRNNEDSLRRVEEEVRRIIEEIRDDEELVRRAEDVVRKLRKLVEDSVRDSERIMEEIERLVRDSVRKSEELVERIKRLVEEGGEDVDDILRRIEEILRRSHRLSKEVNKRIKELLDRSHELSKRVNDELDKVLKEIRREAK

SEQ ID NO: 24784 - protein, 179 aa, Artificial Sequence; identical to SEQ ID NO: 24783
  Synthetic sequence.

SEQ ID NO: 24785 - protein, 179 aa, Artificial Sequence
  Synthetic sequence.
DEDEELKKVLDRAKKRVDELVRNNEESLERVKRAVDRLIEKNERSLERAEDELRKLVKEISDDEDLIKKIRDAVEEVRRLVEESRRRAEEVVKRAKELVERSIRELERVVKRLADLVREGGDDVEKLKKELDDMLRKLEELSRRVNRTLEELLRRIEELSREVDERIKKVLKEIKDRVK

SEQ ID NO: 24786 - protein, 179 aa, Artificial Sequence; identical to SEQ ID NO: 24785
  Synthetic sequence.

SEQ ID NO: 24787 - protein, 179 aa, Artificial Sequence
  Synthetic sequence.
SEKEELDDVLRRVEEKVRRNVRKNEDSLKKVEDEVRRNIRNNEKSLEDAERDVRKLAKDVSDDEDLIRRLKEVVDEIRKLVEESVRRSKRLLEEIRKLVEESIRRSEDLVRTVEDLVRKGGDDVKKLLKELEDLARESHKLSRDVDRKLEDALRRSHRLSREVNRKIEEMVRKLREDTR

SEQ ID NO: 24788 - protein, 179 aa, Artificial Sequence; identical to SEQ ID NO: 24787
  Synthetic sequence.

SEQ ID NO: 24789 - protein, 179 aa, Artificial Sequence
  Synthetic sequence.
KEEERVTDALRRVRETAKKNIEYNRRSVERVERTLKELVKNNTRSLERVRKAVKELVERIRDKEELIRELERVVKELEKEVRDSIKRIEEAVKRSKDSSETHVKTSEDVVRRLEDEVRKGGDDVDKLIERLERVLEKSHRDLRRNSKDNKRILDEIKKESEEVNRRLEEVLRKIKEDVE

SEQ ID NO: 24790 - protein, 179 aa, Artificial Sequence; identical to SEQ ID NO: 24789
  Synthetic sequence.

SEQ ID NO: 24791 - protein, 186 aa, Artificial Sequence
  Synthetic sequence.
DKVRELEKTLRDLLRENHRISEDLNKKLKDMARRNKKHSEDVIEKIKRLLDRLREIVKRDGGEDKRVVEELRRIVEEVRRLLREDEKENERSLEEVEKLVRESEKRSKKILEDAKKLVEDLERDNIDDELVRRVREVLREVEERLRDNIKDNRRSLDDHRRVIEETRRESKRAVERAEDEVKKLED

SEQ ID NO: 24792 - protein, 186 aa, Artificial Sequence; identical to SEQ ID NO: 24791
  Synthetic sequence.

SEQ ID NO: 24793 - protein, 186 aa, Artificial Sequence
  Synthetic sequence.
SKVEDLIRRLKTLLDDLRRISREVDEKIKEILKEVERHSKEVIDRIKDILRRVEEIVRRKGGEDEEVVEELRRVVEEVERLLREDVKEIDRVVKEVRDLLRRSVEIIEEIVKRVRDLVEEIKRDNIDKRLVERVEKVAREVEEAVRKLIEKNKESVERAEETARRLIERSKRAVDEARRKIEELRR

SEQ ID NO: 24794 - protein, 186 aa, Artificial Sequence; identical to SEQ ID NO: 24793
  Synthetic sequence.

SEQ ID NO: 24795 - protein, 186 aa, Artificial Sequence
  Synthetic sequence.
SKVEELIERIERLLEEVRRISDKVDEDLERLIRENEKHSKKIIKELEKLLKELEDIVRREGGEARRVVEILKKIVEDVRDLVRRDEKLNRDSAKTAEDLVRTSEEDLKRVLEEVKRLLEEIERDNIDKRLVERLRKVVEDAEREIRRLIEKNKRSLERHKRELERTIKESRDVLKKVEDRVRELAR

SEQ ID NO: 24796 - protein, 186 aa, Artificial Sequence; identical to SEQ ID NO: 24795
  Synthetic sequence.

SEQ ID NO: 24797 - protein, 186 aa, Artificial Sequence
  Synthetic sequence.
SKVEDLERRIRKILREVEEISERVNRALKRLLDENRKHSEKIIRELEELLRRLEEEVRTKGGEAREVVEAIKEIVERAKRLVDEDRRLNEESRKRAKELVDESRKTLEEVVKEVRKLAEELEKDNIDKSLVDRVRKAVEEAEERIRRLIENNERSLRRHEEAIKKTIEESDKVLEDVRRRAEELLK

SEQ ID NO: 24798 - protein, 186 aa, Artificial Sequence; identical to SEQ ID NO: 24797
  Synthetic sequence.

SEQ ID NO: 24799 - protein, 186 aa, Artificial Sequence
  Synthetic sequence.
SKVERLIERLKELLDENHKISERVNKELERLARENDKHSKDLIRDIERILREVEEIVRRDGGEAEEVVRRLREVVKEVRDLLKEDADRNRESAKEAEKLVKDSEDTSRDILREATELVERIERDNIDRRLVEEVRRVLREVREAAKENIRNNRESLKRHKDALRKTIEDSARVVKRAEERIRELER

SEQ ID NO: 24800 - protein, 186 aa, Artificial Sequence; identical to SEQ ID NO: 24799
  Synthetic sequence.

SEQ ID NO: 24801 - protein, 186 aa, Artificial Sequence
  Synthetic sequence.
SKVDELVERIERLLRELTKHSKEIIDRLKKLLEDNERINRDVIRRIEEILKEVKRIVERDGGEDERVVRTIEEMVKRLAELVKRVEEINDESAKTVTKLVEDDMRELRRIVEEVEKLAEDLERDNIEEELVRKVREVVDRARERVEELIRRTEDVLKKHREELKKLIEESRRVLEEAKKTADELKK

SEQ ID NO: 24802 - protein, 186 aa, Artificial Sequence; identical to SEQ ID NO: 24801
  Synthetic sequence.

SEQ ID NO: 24803 - protein, 185 aa, Artificial Sequence
  Synthetic sequence.
DEVRKLKEDLRRLLKENKEKVEKVIRENEKLLRENKKMVEDAERDLRRLLKELEDLVRKRGTDEDLAETAKRVKEEVDRILEELRRHSKRSSEESRRSVEEVERHSRESSERVDKIIRDAEARGLPKELVDEVRRVARRVKEENKRLLDEVRKVSEEVERTNRELVRRVEEVVREVRERIDELLR

SEQ ID NO: 24804 - protein, 185 aa, Artificial Sequence; identical to SEQ ID NO: 24803
  Synthetic sequence.

SEQ ID NO: 24805 - protein, 185 aa, Artificial Sequence
  Synthetic sequence.
SEAEDLERRIEKLLEDNTRLVERVIEENEKLLRDNAEHSKEVEDRLRDLLRRLEEVVRKRGTDEELKKLADEVVKRVRDILRENKKHSDDSSRRSEKSVDDVRKHSKESSDEVKRILDDIRRRGLPEELIKRVEEVVRKAKKTNEDLLREVEKVSREVKKANEDLLRRSKEVVDEVEKDIERLKR

SEQ ID NO: 24806 - protein, 185 aa, Artificial Sequence; identical to SEQ ID NO: 24805
  Synthetic sequence.

SEQ ID NO: 24807 - protein, 185 aa, Artificial Sequence
  Synthetic sequence.
DDIERIIEKLKELLERNKRHTEEVIKELERLLRENERHSREVKKRLEELLKRLEDVVRREGTDERLKKLAEDVLREVRDILRRNEEHSRDSSEKVREIIERNEEHSRRSSDTVDKILEEVRRKGLPEEVIRRIEEAVREVKEANKDLVRESRRVARRVEEENKRLVEESRRVVEKVEKRIRDLLR

SEQ ID NO: 24808 - protein, 185 aa, Artificial Sequence; identical to SEQ ID NO: 24807
  Synthetic sequence.

SEQ ID NO: 24809 - protein, 185 aa, Artificial Sequence
  Synthetic sequence.
DEIDEARKELEEILRENREKVDEVRKRLEKLLRENEEVVKEIIRRLKELLKELERVMREEGTDERLKELVREVMDRVRKILEEAEKHSRDSSREVDKILKEVEKHSRDLVRRVREIIRRLEAKGLPEKLVREVRKDAERAERELRRSVEDIRRVVERVKRENERLLREVEKVVEEVKEELRKIET

SEQ ID NO: 24810 - protein, 185 aa, Artificial Sequence; identical to SEQ ID NO: 24809
  Synthetic sequence.

SEQ ID NO: 24811 - protein, 185 aa, Artificial Sequence
  Synthetic sequence.
DEIERVIEELKKRLDENRRVLEEIIRRLEELAKRNKRHSEELEKRLREELDKVRKRLEETGTDEEVEKILRTVKREVDKILRENEEHSRKSSEDVKKILDEARKHSEDVVRTVEDILRDVARRGLPRELIERMREVVEEVERALRKSLKDVEDVVREVEKKNKELLEKSKKVVEDVRRTLEKLRE

SEQ ID NO: 24812 - protein, 185 aa, Artificial Sequence; identical to SEQ ID NO: 24811
  Synthetic sequence.

SEQ ID NO: 24813 - protein, 185 aa, Artificial Sequence
  Synthetic sequence.
SEVEEAIKTLKKLLDDNKRHTEEVIRRIEELLKRNEEHSRKVIEDLERLLRKLEKMVRDRGNDERLKKLVRDVLERVKELLKRNEEHSRRSSKRVEEILRENEEHSRRSSRTVKEILKDVRRKGLPEEVVRRMEEAVRRAEETNKDLVRRSREVVRRANETNKKLLEDSKRVVERVEKRLEELLR

SEQ ID NO: 24814 - protein, 185 aa, Artificial Sequence; identical to SEQ ID NO: 24813
  Synthetic sequence.

SEQ ID NO: 24815 - protein, 185 aa, Artificial Sequence
  Synthetic sequence.
SELEEIERELEELLRENKKLVDRVREELKKLLDELRKHSERVIREIERLLEELERVVRKRGTDERLKELVEKVKEDVKKILRENEALAEEVDRRVDKILRDVEEHSRDSSRRVEELLKDARDRGLPEELIKRLTDVVRKVKEDNKRLVEEARRVVEEVKREIKRLLEESREVVRRAERRLEELRR

SEQ ID NO: 24816 - protein, 185 aa, Artificial Sequence; identical to SEQ ID NO: 24815
  Synthetic sequence.

SEQ ID NO: 24817 - protein, 185 aa, Artificial Sequence
  Synthetic sequence.
SEIEDAERKLKKLLEDNTDMARRLIERLRKILEENKRHSERVKRELEEILKELEDLLRRKGTDEDVARKVEDIERRVRDLLRRNREHSRRVLEEVRKILEEAERHSRESSREVKRILDDLRAKGLPEELVKRVEDVVRKVDEDNKRLVEEVRRVVEEVRKTLEDSLRESERVVREVKKRLEDLKR

SEQ ID NO: 24818 - protein, 185 aa, Artificial Sequence; identical to SEQ ID NO: 24817
  Synthetic sequence.

SEQ ID NO: 24819 - protein, 178 aa, Artificial Sequence
  Synthetic sequence.
SEREKMEKVVREAKKDLDRSLKRVKEVAEEVKKELDRSLEEVKRVSEENKKEVDRIRKKGDVDDEILRRNKERSDRSLEEAKEITDRTKRKVEELLKTIEEVSRRSKRKVDRISEEVDRGKDVDTLVRRLEKILEENRRIVKEIEDRLRKLLEDNKRVVDEIIKRNEDSVRDVERRAK

SEQ ID NO: 24820 - protein, 178 aa, Artificial Sequence; identical to SEQ ID NO: 24819
  Synthetic sequence.

SEQ ID NO: 24821 - protein, 178 aa, Artificial Sequence
  Synthetic sequence.
SEREKVEEVVREAKERLDESVKRVEEVSRENKKEIDRLLEEVKKVIEEAKRRLEELRRRGLVDEKVVREVEEELKRLLEEIRKVVEENKEESDRSLKEVEDISRESKERVDRILKRVDDGSDVDEVLKELRRILRDNERMVKEVIERNRKSVEDLERIARRIIEEIERLLKELTDRAR

SEQ ID NO: 24822 - protein, 178 aa, Artificial Sequence; identical to SEQ ID NO: 24821
  Synthetic sequence.

SEQ ID NO: 24823 - protein, 176 aa, Artificial Sequence
  Synthetic sequence.
SEDEEVEEAADRHRRSVEDSSRDLKKVLDEDRRTVAESSRKLKEILREVEREVKRVEDDGSVSDEEVRRMLDELRKLVERHHRENERLLRESEKLVKKHHDDNERSLDEVRKLVEDREGDVEELKKRLKELSDESRKSLERVKRKLEETSRRSEESLRRVKKDAERLVREIEKRAK

SEQ ID NO: 24824 - protein, 176 aa, Artificial Sequence; identical to SEQ ID NO: 24823
  Synthetic sequence.

SEQ ID NO: 24825 - protein, 176 aa, Artificial Sequence
  Synthetic sequence.
SEDEKVKKVLDDVRRKAEDSSRRITEVLRRHEETVRRSSEKLKKLLDELREDADRVRRAGKVDEETVRKLVEDVDELVERHHRRNEESLKRVKELVEEHHKLNEDLLRRVEELVRAKKGDVKDLERKARDIVRKSEESLERVVRELERLSRDSERSLKKVKEDLERVVEEIRRRAD

SEQ ID NO: 24826 - protein, 176 aa, Artificial Sequence; identical to SEQ ID NO: 24825
  Synthetic sequence.

SEQ ID NO: 24827 - protein, 176 aa, Artificial Sequence
  Synthetic sequence.
SEDEEVEKVLREDEESVKRSSDEIRKLLEDHERTVRESSDELKKALDEVRKRLDELKRRGQVSEETVRELVRRVEELVKDHHRKNEESLKRAEDLVREHHKENERLLEESRELVRRREGDVEDLKREAERTSEESRRSLEEVRRRLEELSERSRESLKRVKDELKRVVEEIEERAR

SEQ ID NO: 24828 - protein, 176 aa, Artificial Sequence; identical to SEQ ID NO: 24827
  Synthetic sequence.

SEQ ID NO: 24829 - protein, 176 aa, Artificial Sequence
  Synthetic sequence.
SEDEEVKRVLDELRKRLKESSDRLREVLKRDKRTLEKSSEDIDRALKKVERALTEVLKEGKVDEEAVDRVLRDVRRLVREHHELNRKLLEESKKLVEDHHRLNEKLLRDVEELVRRREGDVKELLDTLRKLVEESEESLREVVERLDKTSEDSKESLRRVIETLDRLVKDIDEKAK

SEQ ID NO: 24830 - protein, 176 aa, Artificial Sequence; identical to SEQ ID NO: 24829
  Synthetic sequence.

SEQ ID NO: 24831 - protein, 185 aa, Artificial Sequence
  Synthetic sequence.
SELEKLKKEIDDLSRDLDRILKELKKRVEELTRRSEKVLEDLRKTLEDIVKTLEDLARGGLDKEELRRRIKEVKDRVEEELKRLTEEIRRVSEELERLLREVEKVVEKSKRDLDELLKRLEERGLPSELVKRAADVVEKHRRSLERLLRTVTKIVKDHHERNEEIVDEVRKVVERAKERLEEIRK

SEQ ID NO: 24832 - protein, 185 aa, Artificial Sequence; identical to SEQ ID NO: 24831
  Synthetic sequence.

SEQ ID NO: 24833 - protein, 185 aa, Artificial Sequence
  Synthetic sequence.
SEVDELRRRVKKLSDDSKRVLDELSRRLKELSERLAEIVKEVHRRNEELVDRLRRLKDKGEPKEDLDRMVRELLKTSKKILDEVTKRLRDSLEEVKKLLEDLRRLIEESSRTLEKLLEDLERRGLPSELVEEVKRVVEKHHEDNKRIVEALAEMVKDHKRTIDELRRRLEESVKDAEKKLRDVSR

SEQ ID NO: 24834 - protein, 185 aa, Artificial Sequence; identical to SEQ ID NO: 24833
  Synthetic sequence.

SEQ ID NO: 24835 - protein, 185 aa, Artificial Sequence
  Synthetic sequence.
SELEELERRLKELSDESRRVLRELLERLKELSKDLERILEDLKEKVKKIEKDLRELKKRGLPKEELKREIDKLVKDVRDLLRRAKKRLEDSLREVEDLLRELEKRITEVSDEVRKLLEDLRARGLPSDLVREVARVVKEHHDENEDIVRRVKEAVDEHRETIERLRRAVERVVKEVERRLKEEAR

SEQ ID NO: 24836 - protein, 185 aa, Artificial Sequence; identical to SEQ ID NO: 24835
  Synthetic sequence.

SEQ ID NO: 24837 - protein, 177 aa, Artificial Sequence
  Synthetic sequence.
SKDEELERVVKEVREVLDDVNREVTKVSDDVKKRLDELLEEVRRVSDEVRKRLDEVLRERDEEEIRKILEEVRETSKRLNEEIDRAIRTVDKRSKELNETNKRAVDEVKKTVDRLRKEVKDVEEAKRRLEKLVRDIRRLTEEHKKRHEDLVREVEEIVKKLKDDHRRLVEDIERAIR

SEQ ID NO: 24838 - protein, 177 aa, Artificial Sequence; identical to SEQ ID NO: 24837
  Synthetic sequence.

SEQ ID NO: 24839 - protein, 184 aa, Artificial Sequence
  Synthetic sequence.
SVLDELREKAKKNIKESEELLRRNEDHSRRDTERSKKLLEDLERRVKEVVREAERIKKKGMPEEEVRERLERLLRELREDIKRIIEELRRSLDENRKLSEEIIRRLKKSAEDLTRDVRELLKRLDKDVVRDLERVVKEVEDSNRKVADDSRRSTEDNKRKNEKVERDARELLKEIEEIVRRLEK

SEQ ID NO: 24840 - protein, 184 aa, Artificial Sequence; identical to SEQ ID NO: 24839
  Synthetic sequence.

SEQ ID NO: 24841 - protein, 184 aa, Artificial Sequence
  Synthetic sequence.
DSLERLREIVERIVREARRLLRENEEHSERDTREVERLLEEVERRLRRVVEEAEKIKKRGSPKEEAMKRLDDLLRRVKEEIDRIVRESKESVDRNRRLSEEIIKTLEKLIEDMEREVDKLVKRLEEDVVREARRIVDELRKEVKEIVERSRKSTEDNERRNRKVIEDLKRLVKELEDRIREIKK

SEQ ID NO: 24842 - protein, 184 aa, Artificial Sequence; identical to SEQ ID NO: 24841
  Synthetic sequence.

SEQ ID NO: 24843 - protein, 184 aa, Artificial Sequence
  Synthetic sequence.
DFEERLKEVLKDAERVVDENKKENKKVLDKAKKVVDENRDRNRRVLEEVEREIRRLIDEIRKDKDLVDRLRRVLEEIEEKHRDAVRRTEELLRKVKEDHERVVRESERLLEEIRRKLDDLRRKGLTKEVEEVLKEIKDILRESSKTSKDLVRRTEEILEESSRDSDRVAKESKKLLEEVKEEVR

SEQ ID NO: 24844 - protein, 184 aa, Artificial Sequence; identical to SEQ ID NO: 24843
  Synthetic sequence.

SEQ ID NO: 24845 - protein, 184 aa, Artificial Sequence
  Synthetic sequence.
SFEEKLDKVVREVEDKIRRLVKRNRDAVKRVADEIRKLKDRNEEVVDRAREKIKRLIDEIRRDEDLVRRLKKVLEEVERRHKELVRRAEKALEEIRRSHERNIRELERVLEEIKKEIEDVKRKRVTKEVEEVLTRLKEKLKRVEESSEKVVRDSERLLEKIKKLSKDVEDESRKLLERVEREVR

SEQ ID NO: 24846 - protein, 184 aa, Artificial Sequence; identical to SEQ ID NO: 24845
  Synthetic sequence.

SEQ ID NO: 24847 - protein, 183 aa, Artificial Sequence
  Synthetic sequence.
SEVERLLKELKELLEELKKKVDDVLKDLEELLKRLEDHTREVVKRSEDLLRELEEMKRRGDLREELLKRAVEESSKLVRDDRERLRKALEEVEKRIRDVKRELEKAVKEIEEKVRDLERKLKDKEEVVRELRRVLEEVRRTAERLLEKLDTVLKKVEDKIRELLKESTRVNKDAKREIDRLRK

SEQ ID NO: 24848 - protein, 183 aa, Artificial Sequence; identical to SEQ ID NO: 24847
  Synthetic sequence.

SEQ ID NO: 24849 - protein, 183 aa, Artificial Sequence
  Synthetic sequence.
SEVETILEDLRRLLEELKKHSDEVVKEIKDLLREIEKHTREVVKTSKKLLKELEELRKRGDLREEELERAVEESSKLVEDDEREIRKMLKRIEDLVRENKDKLRRAVEEVERKVRELKRRLKDKEELVRKIEKVLKEVRETIKKIAEDSDRVLEEAKEVAKRLKDESDRVNEEVRKRIEELKK

SEQ ID NO: 24850 - protein, 183 aa, Artificial Sequence; identical to SEQ ID NO: 24849
  Synthetic sequence.

SEQ ID NO: 24851 - protein, 183 aa, Artificial Sequence
  Synthetic sequence.
SDVDRVLEEIRKLLEDLKRHSEKVSEENEDLLRKNTELNKRVSEDNERLLEELKRLRERGDIREEDLKRALDRVRKTVETVKEENKRSLEDVRRTVETNKRKLERVVEEIKKLIEDAKRRLKDKEELKKKLDEVLERAKRTIDRLLETSDRSLEKVERDLRRLNEELDRSLERAERTIRELAK

SEQ ID NO: 24852 - protein, 183 aa, Artificial Sequence; identical to SEQ ID NO: 24851
  Synthetic sequence.

SEQ ID NO: 24853 - protein, 183 aa, Artificial Sequence
  Synthetic sequence.
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKDKEELRRKLEKVLREAEKVIDELLKKTDEVLKRARETIEDLNRKLDKVLKEVRDKLDRLRD

SEQ ID NO: 24854 - protein, 183 aa, Artificial Sequence; identical to SEQ ID NO: 24853
  Synthetic sequence.

SEQ ID NO: 24855 - protein, 185 aa, Artificial Sequence
  Synthetic sequence.
SSIEKVKREVDEVIKTSKKSSEDSEKLVRDVEERLRKLVKDVRDRVKRVIEEMERLVRERKDKDVRKELRELVRDVEREVKRVEDEMEKLLRDIEEEVRRDIKRSRELVDEVRRRVADVIRKDGEESELVERLKEVLKRLEEVSEESERRNREVVRRLEDTARKLTEELRRVLTELRDVLRRLEK

SEQ ID NO: 24856 - protein, 185 aa, Artificial Sequence; identical to SEQ ID NO: 24855
  Synthetic sequence.

SEQ ID NO: 24857 - protein, 179 aa, Artificial Sequence
  Synthetic sequence.
KDEETLKRLLEKAKEVVDRLKDENEKVTRDNHESVKKAKDANKRSNEKSERVARDAIRRVREAKEVVDTAEKLLRDNHEHSRDTVKKARELNETSRRHSERIVEKIEEILEEVERTLRENRGDVRELAKKVEKAIRELEELSRENREAVKRISDEIKRLSDENAKDSERIIKEIDDRVR

SEQ ID NO: 24858 - protein, 179 aa, Artificial Sequence; identical to SEQ ID NO: 24857
  Synthetic sequence.

SEQ ID NO: 24859 - protein, 179 aa, Artificial Sequence
  Synthetic sequence.
SDDETVTKLLKEAEKVVRELTKRNKELLRKNHESVREAKKRNEDLSRKLEEVVRRLIEEIREREDVVRELEKLLEDAKRHSERIVREMEDLNRKSKKHSKETVDRLKDLLRKVEETARARKGDVKDLAKKIEDVIREMEELTRRNEKRIEEISDEIRRLSDTNRREIERIREELRRRAK

SEQ ID NO: 24860 - protein, 179 aa, Artificial Sequence; identical to SEQ ID NO: 24859
  Synthetic sequence.

SEQ ID NO: 24861 - protein, 179 aa, Artificial Sequence
  Synthetic sequence.
REDERLEEIARKIKKVVDELVERNKKLTEDNHESVRRAEKRNRELSRELEEVAKRAIERIRSDKKVVDEVKKLLEDAKKHSKEVIDELRRLNEESKRSSEDTIRRMRKLLRELEETVKAKKGDVEDIERKVEDIIRRLEDLSRRNEEKVRRISEEIKKLSKDNERTIKEIIKEIEERVK

SEQ ID NO: 24862 - protein, 179 aa, Artificial Sequence; identical to SEQ ID NO: 24861
  Synthetic sequence.

SEQ ID NO: 24863 - protein, 185 aa, Artificial Sequence
  Synthetic sequence.
DELDRLREEIKALIKESRESLKRLEEESRRLAEELRKLIRELKERIERIIEEARRLAKEIKDKDELRKRLEDLLRRVERLVEEVRRRLKEVVDRDRKLVEDNRRLLEELVRRVEELVRDLDAKITDDDVRKKVEDVLEEARRRITDDEDKTKKVHDESRRVVEEVRERVKRLLDKARTVVKEIEK

SEQ ID NO: 24864 - protein, 185 aa, Artificial Sequence; identical to SEQ ID NO: 24863
  Synthetic sequence.

SEQ ID NO: 24865 - protein, 185 aa, Artificial Sequence
  Synthetic sequence.
SEVEDLERKIEELIERAKRLVEELEERSRRLIRELEELSKKNEEDIERLIKEAKKLAEDIKDKETLRKLLDEVLKRVRDSVERSKEELERVVREDRELNKRVKDTLRKVLEDVERLVRDIEKKLTDEEMRRRVRELLKKAEEVVRRLEKDSDRVSKESEDMVRELLRRNEEALRKAEEVVREIKR

SEQ ID NO: 24866 - protein, 185 aa, Artificial Sequence; identical to SEQ ID NO: 24865
  Synthetic sequence.

SEQ ID NO: 24867 - protein, 185 aa, Artificial Sequence
  Synthetic sequence.
KDIDELRKRIETLIREAKKLVDDVRKRSEDLIERLKKLSEDNARDIERLLREAEDLARKIKDKEELERRLRKVLKEVEDSVRRSRKELEDVVREDEELNRRVKRALEEVLKTVEKLVRELEKKIDKREVKERVRRLLEKAADVVRRLIEESNRVSDDSRRVVKELLDRNKELLDRARKRVEEIRK

SEQ ID NO: 24868 - protein, 185 aa, Artificial Sequence; identical to SEQ ID NO: 24867
  Synthetic sequence.

SEQ ID NO: 24869 - protein, 185 aa, Artificial Sequence
  Synthetic sequence.
DDIERLKREIERLLKEAEKISRDNEERSKELLDRLRKLSEDNKRKIDKLVEELKRLADKIKDKEELTRRLKEVVDRVEKSVRDSERMLREVVREDEESVRRSKTKLEDLLRKVEELVRRLEKKVTDEKVKRDAREALRKAKKKVDELKRKNDEVHRRSREEVKRLLEENRKLLEDLRRMVREITQ

SEQ ID NO: 24870 - protein, 185 aa, Artificial Sequence; identical to SEQ ID NO: 24869
  Synthetic sequence.

SEQ ID NO: 24871 - protein, 176 aa, Artificial Sequence
  Synthetic sequence.
RKVEEVEKHSRESIKEIERLVEEVRKHSKDSIRRIEKLVEDVERHSRKVIEELERDKIDEKAKRLLEEDEKLVREIKERIKKLSRENEERVKDIARRIRELSKRNEETVRAIARKIDKDMVRRLEKILKEDKEVVKKAEEELRELLKEDREVVKRAEEELERLLKETEDVVRKVET

SEQ ID NO: 24872 - protein, 176 aa, Artificial Sequence; identical to SEQ ID NO: 24871
  Synthetic sequence.

SEQ ID NO: 24873 - protein, 176 aa, Artificial Sequence
  Synthetic sequence.
SALEEVKRHSEESIKAIEELVRRVEKHSRESSKRNEELIREVEDHSRRVIEELKRKKADREARELVKEDERRVKEVAEESRRLSKRNEELVRRIAREIERLSEENERLVKAVLRTLSEDVVRAAEKLLEEDRDAVRRAKEKLDELLKRDRDSSREAIRELERLLKETRDVLREVER

SEQ ID NO: 24874 - protein, 176 aa, Artificial Sequence; identical to SEQ ID NO: 24873
  Synthetic sequence.

SEQ ID NO: 24875 - protein, 184 aa, Artificial Sequence
  Synthetic sequence.
SEIEKILKDVDKKLKDSSRESEESVKESRDLLRESSERSERSVRETRKRVDDLLRLVDERKDEKLIREIEERARRIADKNRRIVEESKRLVEEAVRKNEDIVRKSAELVERIIRELEDLLRKRNEEDMKREIDKLVEKLKKVLRDNKRLHEKVIRELEEVVTRNEELHRRVIKEAKEVVDRVRK

SEQ ID NO: 24876 - protein, 184 aa, Artificial Sequence; identical to SEQ ID NO: 24875
  Synthetic sequence.

SEQ ID NO: 24877 - protein, 183 aa, Artificial Sequence
  Synthetic sequence.
SEVEEVLRRIEELLREDKRHVEEVVREIRELLKRNKDMVDEVLKRIEDLLREIDEARKRGDLREKAVEDLLRTVEELVRRAEEHTERLLERVERLLERNKEHSERVLEEVKRLIDDVKRKVKDVEEVIRKLDDILRKVKRVSEDNKRETDKVREEVAEVVKRSKDKLDKVRKDVKRVIERVRT

SEQ ID NO: 24878 - protein, 183 aa, Artificial Sequence; identical to SEQ ID NO: 24877
  Synthetic sequence.

SEQ ID NO: 24879 - protein, 183 aa, Artificial Sequence
  Synthetic sequence.
DEVEKAAEDVERRLREDEDHARKVVKRIRELLEEDTRTVDKVLREIEKLLKDITDLRRRGDIREEDIDRILRKVERDIERIEEHSKRVLEEVKRLVDRNRKHSKDLLDEVRERAKDVKRKVKDKKELTEKLDRLLERVEEVSKRNEDATRTVEKEVEEVVRRTKKKLDDILERVERVARELKR

SEQ ID NO: 24880 - protein, 183 aa, Artificial Sequence; identical to SEQ ID NO: 24879
  Synthetic sequence.

SEQ ID NO: 24881 - protein, 184 aa, Artificial Sequence
  Synthetic sequence.
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 24882 - protein, 184 aa, Artificial Sequence; identical to SEQ ID NO: 24881
  Synthetic sequence.

SEQ ID NO: 24883 - protein, 186 aa, Artificial Sequence
  Synthetic sequence.
KEVEDLERRVKEILDRMKRLIDENRKKIEKSIRELERLIDENRKEVERVKKELKDLKREGGDDARTLRERVRKIIEDVEEHSRRSTEEVRRIHKENKEHSERSSDEIRELLRRVEELIEEVKRRLRDKEMEKKLEDIVRRVREVVRRAHETNERLVDRSRKAVEKAERTNRRLVEEIRKVAEEVRK

SEQ ID NO: 24884 - protein, 186 aa, Artificial Sequence; identical to SEQ ID NO: 24883
  Synthetic sequence.

SEQ ID NO: 24885 - protein, 186 aa, Artificial Sequence
  Synthetic sequence.
DEIRELEERVRRILDELRRLVERNREVIERSIRELEKLLDRNRRKVEEILRRIDDLTRRGGDDKKTMLDDVRRLLREAEDHSRRSSETAKRIHRENEEHSKDSSRKVRKLIEELRELAKKVEKEITDERVKEAIKELVKDVDRVMREVDRANRELTKTSKKVLEDVDRTNRRLVKEVRDVVERARK

SEQ ID NO: 24886 - protein, 186 aa, Artificial Sequence; identical to SEQ ID NO: 24885
  Synthetic sequence.

SEQ ID NO: 24887 - protein, 186 aa, Artificial Sequence
  Synthetic sequence.
KEVEDLERTVRTILKRMRELITRNEEEIRRSIEELKKLLKENKDTVRRILEEMKELKKEGGDDKKRLVEEIKRLLDELRENSKRSSDRAKEIHERNKRHSEESSRTIEKLLKELRDLVRDVERKLRDEDAKRKLDELTKRVEKVVREADERNKRLTKRSKEVLDEVHRANEEALKEVEEVVRRVTK

SEQ ID NO: 24888 - protein, 186 aa, Artificial Sequence; identical to SEQ ID NO: 24887
  Synthetic sequence.

SEQ ID NO: 24889 - protein, 186 aa, Artificial Sequence
  Synthetic sequence.
DEIEELRKKAEEIIRRMEDLVRRNTETIKRSIETLKKLIDENRRRVRKIIETMKELKRRGGEDKETLLRRIDELLRRVEKHSKDSSDTVKRIHEENEKHSRDSSRKIEELLKTLRDLAEDVKRKIDKEEVKEAIERLVRRVEEVVRKVREENKRLNEESEEVVRRADRTNREILKRVRDAVREVRR

SEQ ID NO: 24890 - protein, 186 aa, Artificial Sequence; identical to SEQ ID NO: 24889
  Synthetic sequence.

SEQ ID NO: 24891 - protein, 181 aa, Artificial Sequence
  Synthetic sequence.
DAEDTLRDITRKVRKVLEEHRETIERTIRKNRESLERVKRAIEELIERSRRALEEVTRSGIEERVVKKAEDLVRRDEKTLRKVVDELKKLVDESEEINKDSLRKVEKLVRDAEDTLRKVPPRDEMLKRVEDIVKKLIEDLREMAKRNRDISKEVDDRLKKILDEVRKHSEEVIKRLKDEER

SEQ ID NO: 24892 - protein, 181 aa, Artificial Sequence; identical to SEQ ID NO: 24891
  Synthetic sequence.

SEQ ID NO: 24893 - protein, 181 aa, Artificial Sequence
  Synthetic sequence.
SAEETLERLAREVRKVLEEHARKIKKTIDDSRRVLEEHRKTIKRTIDESRKVIKDVRDDGIEEEAVKRADELLRRDEKLNKESLDTVRELVKRDVEENEKSLRDVERLVEEIKERLERVPPDEEVLRRVTEEVKELIERIERLLKENRKHSKKIIDRLRELLEENRRHSEELRKRLEDERR

SEQ ID NO: 24894 - protein, 181 aa, Artificial Sequence; identical to SEQ ID NO: 24893
  Synthetic sequence.

SEQ ID NO: 24895 - protein, 182 aa, Artificial Sequence
  Synthetic sequence.
SSLDEIRRKVREAIERLERLLEENRRKVEEVKRRNERLLDRNREVVDEVIKRLEEMRKDDEAVKRVRKILEEVRKHSRESTEESKKTVDEVRKHSEESSKRVKEILDELRKSAEDIERKNREKREVDEELKRLVEEVKKVVDDVRRENKRLLEEVERVSEEVKKTNEKLLERVKRVVEEAER

SEQ ID NO: 24896 - protein, 182 aa, Artificial Sequence; identical to SEQ ID NO: 24895
  Synthetic sequence.

SEQ ID NO: 24897 - protein, 182 aa, Artificial Sequence
  Synthetic sequence.
SSLDTAREHTRDVIKKIDDILRRNEKLVDDVIRELERLLRENAEVVERVIDRLRRLKKDKEALEEVEKILREVEKHSRDSTREVRRILREVEEHSRKLLEEVKKILDDNRKLIEDIKRKNREKREVVEELKELRKRSEEVVDRAEKALRRSVRKAEKVVEEVERANKRLLERVKKVVDDMRR

SEQ ID NO: 24898 - protein, 182 aa, Artificial Sequence; identical to SEQ ID NO: 24897
  Synthetic sequence.

SEQ ID NO: 24899 - protein, 185 aa, Artificial Sequence
  Synthetic sequence.
EVRERVKEVIERSEKSVRELERIVEELARRLRESVEDLERKIRELSKELRRVVEELVRTRGESSEEIKKVEETVREVDKELKELVERVREENERAIKRMRELLERVERENRRVVKEAKDLVDKRGDEEVVRRIEELLKEVHKENKRVADELKKLVEDLHDRNRRVKEEVKRRVDEVRRKAEEVAR

SEQ ID NO: 24900 - protein, 185 aa, Artificial Sequence; identical to SEQ ID NO: 24899
  Synthetic sequence.

SEQ ID NO: 24901 - protein, 185 aa, Artificial Sequence
  Synthetic sequence.
EVDERIRRLVEESRKSVEDLARIVDELVERLRRSVRDLEEKSKRNKEELEKVLRDLARTRGDKSEKVKRIADIIRRVEEESEKLIDRVRKENKKVIEDMRRLIRKVEEENKRVIDDLRRLVKERGTEEVVERVERLIEKVHRDNRRVAEKLREDVRRVHEDNKDVARKSHKLVKEVRDTVREVRR

SEQ ID NO: 24902 - protein, 185 aa, Artificial Sequence; identical to SEQ ID NO: 24901
  Synthetic sequence.

SEQ ID NO: 24903 - protein, 178 aa, Artificial Sequence
  Synthetic sequence.
DVLKEVEEDSRRNHERNRRVAEKVTDDSRRNVKRLEEVAEEIKDDSRKNKERLDKLRGDDEVVRRLAENVKRSARKLEEELKRLTRNVERTVKEVEEIIRRSRKNVDDTRKKLETEITDKEIEKILRDVLKENEDSLRELKEILERLLEENRKAVEKLKRILEELLRRNDEMLKRVRT

SEQ ID NO: 24904 - protein, 178 aa, Artificial Sequence; identical to SEQ ID NO: 24903
  Synthetic sequence.

SEQ ID NO: 24905 - protein, 178 aa, Artificial Sequence
  Synthetic sequence.
SVDEEVRRDSKKNKEDLDRVAEKVKRDSEENMRRLEEVARKVTEDVKRNKKTLEDLRGDEDVLRRLKENVERSREELEEIIERLERNVRRTVEEVERIVKKLRENVERTKKEVEERITDEEIRRILKELLERNERALEELKKRLRKVLEENKTVLEELRRRLEELLRRNKRMVDEARR

SEQ ID NO: 24906 - protein, 178 aa, Artificial Sequence; identical to SEQ ID NO: 24905
  Synthetic sequence.

SEQ ID NO: 24907 - protein, 179 aa, Artificial Sequence
  Synthetic sequence.
DEVEKLVEDVARVNKKSLDEVRRLLEELEKVSRDHRREVERSLREAEKVLEDLKREAEKTRDKDTLKKLLDELKRILEEIKDRHRRLTEHNKKVLDEVRETIRRIIERNKEVLDELLKRIGEEDDEIRKVKKHNEDVLRKVRKILKDAERISKRALDENERILKEVEKRVRDVIRELER

SEQ ID NO: 24908 - protein, 179 aa, Artificial Sequence; identical to SEQ ID NO: 24907
  Synthetic sequence.

SEQ ID NO: 24909 - protein, 179 aa, Artificial Sequence
  Synthetic sequence.
DEVDDVVRRLEEENRKSEERAKDTLRKAKKVLDELKKRVKESEDRVKEVLDDVEERVRRTTDKETLRKLLEELRKILKKVEEDHKRLTKTLRDLLKRVKEEHDKLTDENRKLLEEVLRRLGKDDKRVRDALRHNEDVLRRNDEIVDELRKRVEDVLKKNEDDVRRVAEEVRRVIEELRK

SEQ ID NO: 24910 - protein, 179 aa, Artificial Sequence; identical to SEQ ID NO: 24909
  Synthetic sequence.

SEQ ID NO: 24911 - protein, 179 aa, Artificial Sequence
  Synthetic sequence.
DRVEEVVKRAKDENRKSEEEVKKSLKDLEDLSREHEKRIRDLLKEVKEILDRIREEVEKKRDRKTLEEIVKKLADVLKRVDDEVKELLKHNKEMLEELRKRHKKLTKDNRDVLEELRREIGEEDDEIRKLERHNEEVLKKNETIARDLEKRSREVVKRLEDILRKVEREVEKALEEVRT

SEQ ID NO: 24912 - protein, 179 aa, Artificial Sequence; identical to SEQ ID NO: 24911
  Synthetic sequence.

SEQ ID NO: 24913 - protein, 182 aa, Artificial Sequence
  Synthetic sequence.
SVEEELRKLKEEIDRVLEENKKIIDDIRKELDDVNRENKKIIDDIRKEIDDVLERVRGEDKDRMREIEEVARRAKEKLDRLLEKSTRLIEKLKEELDDLVRRSAELAKEMKDRLKELKDNNVDEKDLKKLLEEVRELLERSRRASEELLREVKRLLDESRKESKRLADDVRRLLEELERRTK

SEQ ID NO: 24914 - protein, 182 aa, Artificial Sequence; identical to SEQ ID NO: 24913
  Synthetic sequence.

SEQ ID NO: 24915 - protein, 182 aa, Artificial Sequence
  Synthetic sequence.
SVEDIIRKIEKELDDVNRENEEIIRRIKKELDDVNRRNEKIARDSKKRVDDVLRKVTGEDKDKVDEIRRIAEEAKRSTDELLKESTELIERLKKRLEELLRESSRLIEELKKRLEDLLRNNVPEEVVKKIREEVRKLLEESKRRSDELAKEVRELLKRSEDKSRRNLEEVEKLLKEVEDRTR

SEQ ID NO: 24916 - protein, 182 aa, Artificial Sequence; identical to SEQ ID NO: 24915
  Synthetic sequence.

SEQ ID NO: 24917 - protein, 179 aa, Artificial Sequence
  Synthetic sequence.
KDLEDVLDKVRKDLERSKKHSDDVVKTIRELLKESEKHSEELVKRVEKLLEELRRMTTRGDAREEKVDRVLEEVDKLLKENRDESRRVKDEVRKLAKRNRDVSKELLDRVKEEIERLRRRGVDESILRELERRVKKVVEENDEITRRVEREVEKVDKKNKDITDTLRTRVKKAVDEARK

SEQ ID NO: 24918 - protein, 179 aa, Artificial Sequence; identical to SEQ ID NO: 24917
  Synthetic sequence.

SEQ ID NO: 24919 - protein, 190 aa, Artificial Sequence
  Synthetic sequence.
SDIERLLREVEKVIRDSEEETRKLLEEVEKALKDSRDSSEDVKRKVDDILRKLRELRRRNELPKEELTRRAEEEVRKIDRLLEENYKRSKEVVDEIKKKLDEVIKRSDELVRRLEEELRRVLERVKEREDMERIERLLREVRKRVEEAAKRNKDVIKEIEERVRTVHDENRRLLEEIAKRVRDVLEEVRT

SEQ ID NO: 24920 - protein, 190 aa, Artificial Sequence; identical to SEQ ID NO: 24919
  Synthetic sequence.

SEQ ID NO: 24921 - protein, 171 aa, Artificial Sequence
  Synthetic sequence.
KVEEELEKEVRRALEESKRLLDRLTEHSKRVLDELRELLERVERDVRRVLEELKRERDDEKATRIIEEVRKRLKDVVDRIRELVERNKRELDKAVKDSTRLVEEIKELLREKLEDKDVVDRLEKELKKVNDEARKRIEELLRESDRVLEEVKKKMRELERELKKVLKEVRD

SEQ ID NO: 24922 - protein, 171 aa, Artificial Sequence; identical to SEQ ID NO: 24921
  Synthetic sequence.

SEQ ID NO: 24923 - protein, 171 aa, Artificial Sequence
  Synthetic sequence.
DEVEDADRKVRTVLEDLRRRLEELKKHSDDVSRRNEKLLRELKEHSDRLVEEIKRDKKVERVEELVRRNEKKLEDAVREVEKTVRDNKEKLKRVVEKIEEDIRRVEEELKRDVRDKRVVDELLKKLRDVLEEVRRTVDELVKRSEESLRRAREVIRRLLEKTREVLEEVRT

SEQ ID NO: 24924 - protein, 171 aa, Artificial Sequence; identical to SEQ ID NO: 24923
  Synthetic sequence.

SEQ ID NO: 24925 - protein, 173 aa, Artificial Sequence
  Synthetic sequence.
STEDVLRKIKEDVKRVIDDNRRILDEVRRTSKRVLDDLRRNLKHIAEEVERVLREVDKEEVVRELKKILDEIREEHRRLIRTNEKVLEDIERDHRRISEELKRILDEVDELLRAGKPSKELLEKAKRVVDEIKRLAEESLKRLEDLSRDHKRRAKELNDEIRKVVDELRKRAT

SEQ ID NO: 24926 - protein, 173 aa, Artificial Sequence; identical to SEQ ID NO: 24925
  Synthetic sequence.

SEQ ID NO: 24927 - protein, 173 aa, Artificial Sequence
  Synthetic sequence.
SLEEVLDEIRKLVERALRDLERNLRHVTRTSEEVLRRNEEILRRIEEKVDRVVRNVKTEEVVREMRKILKELRERHKRLTETNREALKRIAERHKRLIEEVKRILDEVAEVIKKGEPSKELLDEIRRVLEEVKRRVEELNKELKDLSDKHKEKAKRTDETITDVLRKAEERER

SEQ ID NO: 24928 - protein, 173 aa, Artificial Sequence; identical to SEQ ID NO: 24927
  Synthetic sequence.

SEQ ID NO: 24929 - protein, 180 aa, Artificial Sequence
  Synthetic sequence.
SVEELLREVAELVKRVDEDLRRLLEEVRRSNEEVIRRLEEILKRIEEENRKVVEELRRRGVSEDLVRESKRLVDESRRVIEKLVKESRDSVERTRETVDRLREELKRLVEEIKKMVEDNSSEETVKRLLDELRELLERLKRTIEELLKRNRDLLRDAEEKARRLLEENRKLLKKARDTAT

SEQ ID NO: 24930 - protein, 180 aa, Artificial Sequence; identical to SEQ ID NO: 24929
  Synthetic sequence.

SEQ ID NO: 24931 - protein, 180 aa, Artificial Sequence
  Synthetic sequence.
SLEELVRDVERLVKESIEELERVVEDVRRLNTELKEKLERVAREIKKRNDDLVRELRTAGTEDRLIKESRELVRRSEDTVRRLIERSEEIARRTEKNVKRHVKENKDVVEKIREVVTKNSSEEVIDRLRKELEDIIRESRKNLEDLLRENKRLVEEVERTLRELLRTNKELLERIREEVR

SEQ ID NO: 24932 - protein, 180 aa, Artificial Sequence; identical to SEQ ID NO: 24931
  Synthetic sequence.

SEQ ID NO: 24933 - protein, 180 aa, Artificial Sequence
  Synthetic sequence.
SVEEMLEKIRRRATESVKRLRKILKEIKERNEKAIRDDRRLLEEIERRIREVVKRLRDAGVSEDLVRRLEEILKRVKEAVEKSVRESKKLVDDTKRNVEKHIEDNKRVVDRVEEAVRRNSSEETVKRLEEEVEKIVRDSERNAREMLERNRRLIEESKKRTKDLLKEVEDEVRKLEEEVR

SEQ ID NO: 24934 - protein, 180 aa, Artificial Sequence; identical to SEQ ID NO: 24933
  Synthetic sequence.

SEQ ID NO: 24935 - protein, 184 aa, Artificial Sequence
  Synthetic sequence.
SVEEIVRRIREELKKVEEDSERIVRTVEDVLRKVLETVERIVRESEKRSRDAVRRIREKLSDKEKLKEIEDEARKSVEELRKLLEDVERRVRELVKKARDLHRRSKEVVDEIRKKVEKLLKDGGSDEVATRLLKEVKEELDRLREENERLLRELKETVEKLKRDAEKVVEDDERLVRELEKRVD

SEQ ID NO: 24936 - protein, 184 aa, Artificial Sequence; identical to SEQ ID NO: 24935
  Synthetic sequence.

SEQ ID NO: 24937 - protein, 183 aa, Artificial Sequence
  Synthetic sequence.
DIEELLEEIRRRAEEAHRRNEDLLRKIKELVKKARKDNEKVVRDIERRLREVLERVRKKITDDRLREEIERLVDEVRKLLEDVKRESEKLVREAEKLLKDLERRSKEVLDRIEKLLRDVSRSTDREEVKEVLKRVEDLLRTSEEETKELLKRVEDELRRSKEDSEDVLRKVEELLERIDRRVT

SEQ ID NO: 24938 - protein, 183 aa, Artificial Sequence; identical to SEQ ID NO: 24937
  Synthetic sequence.

SEQ ID NO: 24939 - protein, 182 aa, Artificial Sequence
  Synthetic sequence.
KEIEEILEEVKRLLDKLKEDSDRILERVRELLERSKEKSREILKRVEDLLRELEKLVRDDRDEDTLRDLLRELEERVKELLKELDKTSKDVLDEVRKLLEENNRLLDELTKRVDELLRRISEDEELRRVLEEIRRLLEEVRRKIEEASRRLKEDADRVHRKNEEILKRIEELIEEVKRRVEK

SEQ ID NO: 24940 - protein, 182 aa, Artificial Sequence; identical to SEQ ID NO: 24939
  Synthetic sequence.

SEQ ID NO: 24941 - protein, 182 aa, Artificial Sequence
  Synthetic sequence.
KEVEDILREVDKLLKESKRKSEEALKRVKRLLDELKKTSKRILREVEKLLERLRRLKKDDRDKDRLREELKKLLKTVEDLLRDNDRLLREVEERAKKILKDVRETSERLLRTVKKLLEEIPKDKDLKKIVDDIRRKIDKVDKDNERLIKELEDRVRKAREDIRDISRRIRELVKRVVDEVEK

SEQ ID NO: 24942 - protein, 182 aa, Artificial Sequence; identical to SEQ ID NO: 24941
  Synthetic sequence.

SEQ ID NO: 24943 - protein, 182 aa, Artificial Sequence
  Synthetic sequence.
DEVETILRDVKRLLEESRRESERVLEEVRRLIEELKKRSRDIMEEVKKLLEELREIVRRDRDKETLRKLLEELEREVRKLLKRNNELLEELLRRARKLIEEVERTSRELFKTVEELVRRIEPDEEARRLLEEADRLVREVDKENEDILRRIEESVREVEERIRRISRAIEESIRRVKEEVER

SEQ ID NO: 24944 - protein, 182 aa, Artificial Sequence; identical to SEQ ID NO: 24943
  Synthetic sequence.

SEQ ID NO: 24945 - protein, 182 aa, Artificial Sequence
  Synthetic sequence.
KEVEDLLREIERLLKESRERTKKVEEDVKRLLDESRKTSEDVLREVERLIRELEKIVREDRDKDRLEELLRRLKETAKELLRKVEELSRRLKETVDKLLRDLEEDSKKLLEDVKELLDRIPPDDKARKLVEEAKRRLDTVNEENKDVVRKIKEDLERVDEENRDVLRRIKRIVERVEEEVRR

SEQ ID NO: 24946 - protein, 182 aa, Artificial Sequence; identical to SEQ ID NO: 24945
  Synthetic sequence.

SEQ ID NO: 24947 - protein, 180 aa, Artificial Sequence
  Synthetic sequence.
DEAERLLRRIEEILKRSKDVSDKLLEDNEKLVRDVKRRLDEHLRKNREALKKLREELKRNRDERDLERLIRESKKLLDDSEKNIRKLVKESDRLLEETERENRRLIKELRDIVKEIAERIGKDDDEVVRRIEELVKKLEEDNKRVVEEIKKLNDDLRREVKRVLDEARKLNKEIVDELRK

SEQ ID NO: 24948 - protein, 180 aa, Artificial Sequence; identical to SEQ ID NO: 24947
  Synthetic sequence.

SEQ ID NO: 24949 - protein, 180 aa, Artificial Sequence
  Synthetic sequence.
SEVDELRRRVEEVERRSEENSRKHLEDNEKMVDDLRKNLERHLKENKELVERVRRVVEDNTSEELLKRLIDESEDLVRRSEENIRDMIRRSRELAKRSKDNNEEVIRRLKKLIEDIVRTIGKDVDRVVEDLKRRADELVRRNERAAEEVRRLNEEVVEDLKRVVKEVKDLNDELVKEVRR

SEQ ID NO: 24950 - protein, 180 aa, Artificial Sequence; identical to SEQ ID NO: 24949
  Synthetic sequence.

SEQ ID NO: 24951 - protein, 183 aa, Artificial Sequence
  Synthetic sequence.
SVEEVLKEIEKEHRRSEEEVKDVLRKARKINEEVERRVKEVVDRIRETIARVRKEVKDRNGERLEELERRLERILREVERLAKELIDRLRRTVEDSERLVKRLVEENRRVLEDVRRLVRELDKVKDVLKKLLDRSRRLVEKVRDDLRKAEEKNRRVAEEIKETLKRMEDRVREELKEIKKKAK

SEQ ID NO: 24952 - protein, 183 aa, Artificial Sequence; identical to SEQ ID NO: 24951
  Synthetic sequence.

SEQ ID NO: 24953 - protein, 183 aa, Artificial Sequence
  Synthetic sequence.
SVEEVLKEIEDLHKKSIDEVREVLKEAEDLNRRAVKEVEDALRESEELNRRVTKEVRDENGKDLEELEKELRENVRRVRETVRDLKRKLEETVRESREDVERLVRENERVVKEVRDLVRKLDKVKEVLDRLLEKSEKLARDVRKRLKEVLDKNRKVVEEIRKVLEELLRHSERKLERIRERLK

SEQ ID NO: 24954 - protein, 183 aa, Artificial Sequence; identical to SEQ ID NO: 24953
  Synthetic sequence.

SEQ ID NO: 24955 - protein, 184 aa, Artificial Sequence
  Synthetic sequence.
DVEDVVRELKKLLDEITRRSEEVVKRLHDRNEEAKEEVRRVVKEVRERLKKVVDDVRRELKDSEKLERVEEKIEEAVRRLDEELRRLEEELDRSSDRLRKLHETTRRLIEEAKRRIKELLDRNGDREVLRKLKKEIKDLLDRIEELNKKVLDESEKLIKEIREDLRRVKEEIKEELKRIREEVR

SEQ ID NO: 24956 - protein, 184 aa, Artificial Sequence; identical to SEQ ID NO: 24955
  Synthetic sequence.

SEQ ID NO: 24957 - protein, 184 aa, Artificial Sequence
  Synthetic sequence.
SVEEVVRRIKEKLETVVDESRRVVKDLHDKNKEIVEESRKVLRESEKVDEDVVEEVRRRLGNSEKLREAEKKIEKSTEENRRLHKKTADEIKESSERLRELHERTRREIEKAMERVERVLRKGGSDEELEKLLREIEDLLRKIRKLNKEVLDRSRKLLEDIRRLNKRALERNRKIAKEIRDEVK

SEQ ID NO: 24958 - protein, 184 aa, Artificial Sequence; identical to SEQ ID NO: 24957
  Synthetic sequence.

SEQ ID NO: 24959 - protein, 172 aa, Artificial Sequence
  Synthetic sequence.
DSAEKLERDVRRALERIRKRLEENDRRVEEILERIRRRLREDLETSREVLERLRKENVREDEVRDLARRVKENTDRTLEEVKRLIEEAKKHSKDVLDDVKRDAERLKEEIRRVPVDESVIEKLERLLDELLEEVKRVVETSEKKLDELLEEVKRVVEESKKALDDLLREVEK

SEQ ID NO: 24960 - protein, 172 aa, Artificial Sequence; identical to SEQ ID NO: 24959
  Synthetic sequence.

SEQ ID NO: 24961 - protein, 183 aa, Artificial Sequence
  Synthetic sequence.
DKVDEVLRRVRELLERLRKLLEDNKKTTDELLEELRRILKEDEDRTRKLLKRLRDVKREEIKDKDTLTKTAEEIAKRLEDSNRTSKEIVERIVKELRESNERLERIADEIRERVERLLKKAKEEGVDDRMMKRLKEELERIRKKVREVLERSSRAVERIEREVDEVVKRSSDTVKRILDEVRK

SEQ ID NO: 24962 - protein, 183 aa, Artificial Sequence; identical to SEQ ID NO: 24961
  Synthetic sequence.

SEQ ID NO: 24963 - protein, 183 aa, Artificial Sequence
  Synthetic sequence.
SEAERVRRRVEELLRELREHSRRVLEEVKRLLEKLREDNERSLRRIKKLLDELRRVRERDLQDKDELRKLLRELKEDVKRIIEENDKIVKKLLEDAERLARENEEMLKRLKEEAERLIRDLRRKGVEEEVLRDIERRVREIEKEVREVTRAIEESVKKIEKESRDVLRAIAETIRKIEEEVKK

SEQ ID NO: 24964 - protein, 183 aa, Artificial Sequence; identical to SEQ ID NO: 24963
  Synthetic sequence.

SEQ ID NO: 24965 - protein, 183 aa, Artificial Sequence
  Synthetic sequence.
DEAEEVLKTVKKLLDDLRRRNEDSLRRIEELLKRLRDHSKRVLEEVRRLLEELRRVKERDLKDKEELERLLERVLREAERLLKENEDLLEELERRVRDILRRNREMVEELRRRAKRLLERLRERGVREEVLRKIKKDVEKIVRDSERVIKTIEEKIDRIKKEVKRVTDEIRKRVEEIAEEVRR

SEQ ID NO: 24966 - protein, 183 aa, Artificial Sequence; identical to SEQ ID NO: 24965
  Synthetic sequence.

SEQ ID NO: 24967 - protein, 181 aa, Artificial Sequence
  Synthetic sequence.
SELEDVLRRSRDLLRRLKELLERLLETVRKLIEEAKELLKKILEDSRKLIREVEEMVRRGDIDDDTLRRIKEENRRLNKELRDRVKKLEEDIRRLIKKLEDEVRKAKEDNERLLKKLRDDEDSEEIRRVIKESKDLSRALEETVRRVERKIEDLLRRIKEEAERVIKESEKLIEDAERATK

SEQ ID NO: 24968 - protein, 181 aa, Artificial Sequence; identical to SEQ ID NO: 24967
  Synthetic sequence.

SEQ ID NO: 24969 - protein, 177 aa, Artificial Sequence
  Synthetic sequence.
DEDEEVERELKKIKDKSKKVLDKSRKTIDELRKEVERTLRRWTKRSKDLLDKVEAAKRRNVREEELKRLVDEWRKEVDKVREEVERLKKKLKDELRRLEREHRELVREIEEELKRLAERGVPEEVLRKVDTILKEIKRRNEKVLKELRDIIDDLAKKLDEVLRRDEELAKKVTEELK

SEQ ID NO: 24970 - protein, 177 aa, Artificial Sequence; identical to SEQ ID NO: 24969
  Synthetic sequence.

SEQ ID NO: 24971 - protein, 177 aa, Artificial Sequence
  Synthetic sequence.
SEDEDARRTLREMLEESRKHLKEWEDTSRELEKKSREVLKETRKTIAKLADRVRKAKENNVDEKSLEDLTREAEETLRKLAEDHKRLVKEWREVIERLRKTVEDLVRKIREILKRLAEKGVSEEVLEDIRRKVEKLEEDNRRVMKKDEDAVRRVEEENRKVLKELKERIDRLAEELK

SEQ ID NO: 24972 - protein, 177 aa, Artificial Sequence; identical to SEQ ID NO: 24971
  Synthetic sequence.

SEQ ID NO: 24973 - protein, 177 aa, Artificial Sequence
  Synthetic sequence.
DEDREAEETIKRLLDRSRKTLEESRKTSEDLRRKSEKVLRETRKSLEDSLRKVREMKKRNVSEELLEKLRKELEDNLRRLERKHRELVKEWRKVTEDLERKHRELIKEIERILKELREKGLDEKVLRDLEEIVRRAAKANKDVLDEDRRVMEEAREENKRVIDEYRKILKEATDELR

SEQ ID NO: 24974 - protein, 177 aa, Artificial Sequence; identical to SEQ ID NO: 24973
  Synthetic sequence.

SEQ ID NO: 24975 - protein, 177 aa, Artificial Sequence
  Synthetic sequence.
SEDEEAKKTLDELLKKAEELVKKIKETSERLLRKSDKLLEETKKTIKELDDEVKEVKKRNVSEEDLKRLAEKLREILKRLEDRHRKLVEEWEKVTRELAKELEDLRREVKRILDELRKRGVSEEVLRRIEEIIRRVTELLKKVLKEDREVVEEARKKNEEVLDRLKKIIEEAEERLR

SEQ ID NO: 24976 - protein, 177 aa, Artificial Sequence; identical to SEQ ID NO: 24975
  Synthetic sequence.

SEQ ID NO: 24977 - protein, 177 aa, Artificial Sequence
  Synthetic sequence.
DEDEKAKRMLEEAEKKSKKHVDEVRETSKRLLEESKKLLEETDRSLRKSLERVDRVKKNNVDEKDLKRLLEELEKNLRDLARRHEKLKRDWEEVTRRLEETAKKLVEEIRRILEELRKEGVDKRVLDDIKTKVERLEERNKKVLDDDREMVTRAEEENRRVIKKYRDILEEARKRLK

SEQ ID NO: 24978 - protein, 177 aa, Artificial Sequence; identical to SEQ ID NO: 24977
  Synthetic sequence.

SEQ ID NO: 24979 - protein, 177 aa, Artificial Sequence
  Synthetic sequence.
SEDEDLDRVAEKLKREHKKSVEEIKRVLKRADEESKKLVRDTERVIEEIKREVEEARRRNIDEELVERLKKKIEDILRTLEERHKKLIKELREILKRLSDESRRLAEETEKVLEDLERKGVDEEVLKKLREIVRRVKEENRKVNEEVEKRLRELEEENKKVIEDLKKTVEELVERLR

SEQ ID NO: 24980 - protein, 177 aa, Artificial Sequence; identical to SEQ ID NO: 24979
  Synthetic sequence.

SEQ ID NO: 24981 - protein, 188 aa, Artificial Sequence
  Synthetic sequence.
DDLEDIKRRLDEMREEVKRHVKRLKEVAKEIEDEHKETVRRNKEVAKKLAREIDDARRRNRNEEELERIIRRLRETLKRLTDRNKEVIDRSREKLKRLKERSEETIRRLRRKLEEIRKDIERVKKAGADKDKVDKVLREVTEEVKRLEEEIKKVDKEIEEIVRRVERENEEVVRDIARIVEELERKLR

SEQ ID NO: 24982 - protein, 188 aa, Artificial Sequence; identical to SEQ ID NO: 24981
  Synthetic sequence.

SEQ ID NO: 24983 - protein, 188 aa, Artificial Sequence
  Synthetic sequence.
RELEEVIKRIEKTVTDNERANKESVDRIREIVDRLKKEIEESVRRMRDSVKKLEEEIRRRGASEEVKETVERLMRELEKHIRESEREIEKLAREAEEHIKRSNERVKKSVKELRDLLETVKRLKERGNEEELIRRLEKVLKEHHKRVEEIVKENEDVARDLDRRIKEIVERNRKVLEDLRRRIKELKK

SEQ ID NO: 24984 - protein, 188 aa, Artificial Sequence; identical to SEQ ID NO: 24983
  Synthetic sequence.

SEQ ID NO: 24985 - protein, 179 aa, Artificial Sequence
  Synthetic sequence.
SEIEDALRRAERVSRESAKKLEDALRKYEKVSRDLKRRLDEVLKRYEDTSRKIAKDLRDNGVDEETVRRLVETSKEDLKRLERELRELARRSDEDLKRLDRELKELVERSKELLKEVERRNIDEETIERLIEKNKREVDKLLKKIEEVIKRNKDEVDKLLKKIEEVIDRNRRAMEEIAR

SEQ ID NO: 24986 - protein, 179 aa, Artificial Sequence; identical to SEQ ID NO: 24985
  Synthetic sequence.

SEQ ID NO: 24987 - protein, 184 aa, Artificial Sequence
  Synthetic sequence.
SIEDELRKIVEDIEREIKKLEDDLRRVSKDHRDEVRRILEKLKEHIERLEEDADRLKKAKEPKEKLDERVERLKEHSKKVVKEARDRLRELEERNRKIDRELEEELKKLEKRVREEVKKVRTRKDTETVREMIKRLEELVRRVKRRIEDVIRRNREVVDESRRRIEKAIEDNERVLKKIEEEVK

SEQ ID NO: 24988 - protein, 184 aa, Artificial Sequence; identical to SEQ ID NO: 24987
  Synthetic sequence.

SEQ ID NO: 24989 - protein, 184 aa, Artificial Sequence
  Synthetic sequence.
SIEEEIKKVVKELEDEARKLLKKIEEHSEDLKRKLEDLLRKVEDHIRRLREEIERIKRENLDEERVKRALDKLEESSRRVVEELKKKVKELRDSSEELKKEVRKKVEELRDRVEKEIEEVKKRKKTETVKKAIKELRDLVDKIEEDLKRVLDENERVLREIARKIDEIIEKNERELRRVLEEIR

SEQ ID NO: 24990 - protein, 184 aa, Artificial Sequence; identical to SEQ ID NO: 24989
  Synthetic sequence.

SEQ ID NO: 24991 - protein, 172 aa, Artificial Sequence
  Synthetic sequence.
DEAEELERRLREEVKRVETDLRRTTRELEREVEEVRRRLEKTSRENNDRSEKAEREDSRDKRLEEELKRESDRLEKEHRDLIKKLRDSLEKMRRDHKRLIDELRKRLEDLERKIKDKEVVDRLREIITDLVRKLEENVKRLEEIIKRLEEELKRNVDRLRENSKRLAERLRT

SEQ ID NO: 24992 - protein, 172 aa, Artificial Sequence; identical to SEQ ID NO: 24991
  Synthetic sequence.

SEQ ID NO: 24993 - protein, 172 aa, Artificial Sequence
  Synthetic sequence.
SEAEKVLEEVRRLIEEIRRRLKETTDDVRRLVRELKEEAKRLLEEDKRLVDDLRRRNAKDETLTRRLRRHAEETKKTIEELIRALEEALDRLRKRHEELLRELDETLRRLEERIEVKEVVDKIRKVAEELKKELKDNADRVRRIAERLKEELKRVAEKSDRIIRTLEEELKR

SEQ ID NO: 24994 - protein, 172 aa, Artificial Sequence; identical to SEQ ID NO: 24993
  Synthetic sequence.

SEQ ID NO: 24995 - protein, 172 aa, Artificial Sequence
  Synthetic sequence.
SEVERLVREVEKDLERERRRLEKTVRDSERLVRELKETLDRLLKRDKDVVDDARRKNSKDERLRKRLEEHLRRTKEELRRLKEENRDVARKLREEHKRTEERLDERLEDLERKISDKSVVDRLREIVKELKDRNRKVVKELEDIHRDSDRELDDVVRRSDEIIRELVERLKT

SEQ ID NO: 24996 - protein, 172 aa, Artificial Sequence; identical to SEQ ID NO: 24995
  Synthetic sequence.

SEQ ID NO: 24997 - protein, 181 aa, Artificial Sequence
  Synthetic sequence.
DLEEIIKTIREINERLNRRVREVEERLRRTSRELEERIRDVVRKLREINDRLRKEVEARGLDKGKLEEAERESERTERENEKLLKRIEDSLRKSEEEIRRVIKKLEDESRELEKRLEDLLREGRVDERLVRENEEAVKRLTKELDDLLRKNEELIRRLEEEAKRVLERNEKIARDVREELK

SEQ ID NO: 24998 - protein, 181 aa, Artificial Sequence; identical to SEQ ID NO: 24997
  Synthetic sequence.

SEQ ID NO: 24999 - protein, 181 aa, Artificial Sequence
  Synthetic sequence.
DLEEIIRKIREINRELNETVKKVVRELEEDTRRVKRRIEEIVKELERTTRELDKRVKDSGLDKSELDRIRKELRDSEEELKELLKEIEERLRRSNDKLRRVEEKIRKRSEELKKRLEEALREGRVDEKLVEDNRKEVRDLEEEARKLLRENHELTKRLIEEAERILKKNEELIRKIEEEER

SEQ ID NO: 25000 - protein, 181 aa, Artificial Sequence; identical to SEQ ID NO: 24999
  Synthetic sequence.

SEQ ID NO: 25001 - protein, 181 aa, Artificial Sequence
  Synthetic sequence.
SLEELLEELERILREVEERIKEVVRRLEEDTRRVEEEIRRIVEELKRINRELEELVRRTGLDKSELDRLRRESEETEKRNRRLEEEIKKRLEESNRRIKELLDRAKERLKKIADDIKKVFDDGRVDERLVKEVRDTVKELEDELKELLDRNHELTRRLEEEAKRLLEENKKRADDVKEELR

SEQ ID NO: 25002 - protein, 181 aa, Artificial Sequence; identical to SEQ ID NO: 25001
  Synthetic sequence.

SEQ ID NO: 25003 - protein, 184 aa, Artificial Sequence
  Synthetic sequence.
RLDEVIRRVEEVIRDVERRVAEVVKRLRDSSKTVKEKIETVIRRNKEINKRLEDLIRESGVPEEVKRKAEEVLERSDRENEKLLREADRRLRESEKKLDDLRKEIEDTVRRLRERLKDVARRGVPEDDLRRTLEEVKRTIDKLKEDAERLLEENKDLIRRLEEELKESSKRNDTLVKKLKKELK

SEQ ID NO: 25004 - protein, 184 aa, Artificial Sequence; identical to SEQ ID NO: 25003
  Synthetic sequence.

SEQ ID NO: 25005 - protein, 182 aa, Artificial Sequence
  Synthetic sequence.
REMEEALKRNNELSERLRRELKRVLEENHRLSRDLEKKLRDLLERVRELVERLDRMKEEGKADEDTLDKLRREVEDLLRRLEELLREIKRKSEELLERLKRLLDELRKESRKLLEDLRRKSDTEEVRRVLEEIRRDTEELEKDARRVLTELRRNLERLRRKVEKVLEEIRRILEELERRVRK

SEQ ID NO: 25006 - protein, 182 aa, Artificial Sequence; identical to SEQ ID NO: 25005
  Synthetic sequence.

SEQ ID NO: 25007 - protein, 175 aa, Artificial Sequence
  Synthetic sequence.
DKLEKLEEKLEKDVRRWDDELRRDLEDSKRLVDTIRKRLEKLLRDHRELVRRIRELLRDGRVPEKLMKELEDFNRRVAEEVKKLRDDLRRKLRESAERHKKIAEELRRELKRIEDEVGRNEVVRRLEEEVRRLEEKVKEVLRRNEEEVRRLEKDIERVLRESTKIVEDLKDEVRK

SEQ ID NO: 25008 - protein, 175 aa, Artificial Sequence; identical to SEQ ID NO: 25007
  Synthetic sequence.

SEQ ID NO: 25009 - protein, 184 aa, Artificial Sequence
  Synthetic sequence.
SVEEVVEELERIHREVKREIDEVVDRLREINEEVRREIKEVLDKIREDLERLKEEIDRDLKDKKTADRLKEEIDRLLREVEETVERLERRHEDAKRRTRERVEELKRRHDKVLDEIRELIRRGVSDDILREMLRKSEELVRESREDLKRLLEEHRKLVEESRRELERLKKEVKDAVEEVRRRLK

SEQ ID NO: 25010 - protein, 184 aa, Artificial Sequence; identical to SEQ ID NO: 25009
  Synthetic sequence.

SEQ ID NO: 25011 - protein, 184 aa, Artificial Sequence
  Synthetic sequence.
SVEEVVEELKKIHEDVKRKIDEVLKRLKRINDELRKRIREVLERLRREAEKLMEAIRRDARDRDTVKKLEEELRRLLKRLEDTARELVKRSDKLLEDTERTARKLKEDHDRVRKKIEDLVREGVSDDILREMLKESKELVKRSEKTLRELEKRHRDLVREVEETLKELEREVERKVREVERRVR

SEQ ID NO: 25012 - protein, 184 aa, Artificial Sequence; identical to SEQ ID NO: 25011
  Synthetic sequence.

SEQ ID NO: 25013 - protein, 184 aa, Artificial Sequence
  Synthetic sequence.
SVKEVLDEIRKINDDARRRLEEVLKDLKRINDELKERVDRVHDRNRRLLEELKKEIRTKLKDKRKADELERRLKELLEESKKLADEMKKRSDDVLRETERTARELTERHRKLLEEVKRLVEAGVSDDILREMLERNKELVKESKKVLEELEREHRELVREVKKRLDDSTEKIKTEVDKVKKELD

SEQ ID NO: 25014 - protein, 184 aa, Artificial Sequence; identical to SEQ ID NO: 25013
  Synthetic sequence.

SEQ ID NO: 25015 - protein, 184 aa, Artificial Sequence
  Synthetic sequence.
SVEEVIKEIEKIIRDLKEELKKVLTELEKRNEELKRRVEEVHEESRRLLDTIRKEIERKLKDKKEADRLEEELRRALKKDEELVREVIKRSEDLLRETRKRAKELSDRLEELRKRVEDVARAGISDEVLEELLRRVKKTVKEVREDLDRLRKEHEELVDRVREELERSLREIKERLERIKRRLD

SEQ ID NO: 25016 - protein, 184 aa, Artificial Sequence; identical to SEQ ID NO: 25015
  Synthetic sequence.

SEQ ID NO: 25017 - protein, 180 aa, Artificial Sequence
  Synthetic sequence.
KEAEELLEKVRKLVKEIEDRLRKSSEENRELVKRVEDELRETTKKNKKLVDEIKERREKSDKDKKKVDDDIRKELEDVSRENKEILKRIEDESRKSEEKNKKLADDVKRELDEMRREVREKVKDEDVLRRIEEILERVERAVREVLRRNKEINDRLRERVEDVVRKNEDILRRVLDEVRK

SEQ ID NO: 25018 - protein, 180 aa, Artificial Sequence; identical to SEQ ID NO: 25017
  Synthetic sequence.

SEQ ID NO: 25019 - protein, 180 aa, Artificial Sequence
  Synthetic sequence.
DEVERLIEEVDKLVKTIEEELRRSSEKNKDAVRRVKRRLEKSNEDNREVVRRVDKERRDSDKDRKKVRDEIEERSRRTEEENKRLLKELKEESERLEEENRRLLEEVERRLERMEEEVRKKVKDEDVLRTIKEILRELRERVEEVAKRNKEINDRLNEDVERVVRENKELNDRLRERVDR

SEQ ID NO: 25020 - protein, 180 aa, Artificial Sequence; identical to SEQ ID NO: 25019
  Synthetic sequence.

SEQ ID NO: 25021 - protein, 180 aa, Artificial Sequence
  Synthetic sequence.
DEAEKLIEEVKRLVEDLERKLDESSRRNEETVKRIDKELKDSNKKNRDTVKKVTDTAKDSDKDREEVLRRLKKRSEETKEENKELLKRVRERLEKVKEDNDRLLEEITRALRELEDKARKTIKDEDVLRTIKKILDDLERRVEEVVRRNREILKDLERKVRRVFEENEKLNRELEERVKT

SEQ ID NO: 25022 - protein, 180 aa, Artificial Sequence; identical to SEQ ID NO: 25021
  Synthetic sequence.

SEQ ID NO: 25023 - protein, 178 aa, Artificial Sequence
  Synthetic sequence.
SKADEVEKDVDRKLKEVKKRLDETRESVRRKLEEVRRELEESEKSVETVLREVKKTKDRGTSEEALKDIKRRLREHNKRLTEKHEKIKRELDKHNKELTDDHERIKEELKEKVRKLEEDGLEEEVLKKLKDIATELRERLDRNNKELTDIHRELKERLDRNNTKLSEIHKRLEEELDK

SEQ ID NO: 25024 - protein, 178 aa, Artificial Sequence; identical to SEQ ID NO: 25023
  Synthetic sequence.

SEQ ID NO: 25025 - protein, 178 aa, Artificial Sequence
  Synthetic sequence.
SEVDEARKRVRDVLEEVRKALEETEKSVRRTLEEVEKRLKESEDSVRKVLEDVRRELERGTSEEVLKKIEEDLRRHNKRLTETHKEIEDRLRDHNRKLTDLHRRLKKELDRLLKELKDKGLDEEALRELEEIARRLERELEKNNKDLTDIHETLRRRLEDNNRKLSKIHEDLARELRK

SEQ ID NO: 25026 - protein, 178 aa, Artificial Sequence; identical to SEQ ID NO: 25025
  Synthetic sequence.

SEQ ID NO: 25027 - protein, 182 aa, Artificial Sequence
  Synthetic sequence.
KEAEDMLREVKRLIDRIKKVLEDVLKAIEELIRRLEDIHRKVNEDSERLTEDLKRTIGTERDEAREVLKRLEDLNREIRKRSEEVKRELRKVLEDARKRLEEIERELEEMLRRLEREVEKGTSKEKIEELLRRVEELIRRIEEEVRKLLEDVERKIRESVKEAEELLRRSKKEIERVKREDT

SEQ ID NO: 25028 - protein, 182 aa, Artificial Sequence; identical to SEQ ID NO: 25027
  Synthetic sequence.

SEQ ID NO: 25029 - protein, 182 aa, Artificial Sequence
  Synthetic sequence.
SEAERVIRESERLTDELRKELEKALRRSKKLSDELRKIHEDANREVRKLIEDLKRTIGTESEEARDVLRKLEKELDRLRRESERVEKESEDLNREIKRRLDELLRRSEELNERIRDLLRKGTREEILKKLLDESRDTVRRVEDTVRKLVRRSEEFVRKSKERVKRLLDDVRRKIEDVKRKTK

SEQ ID NO: 25030 - protein, 182 aa, Artificial Sequence; identical to SEQ ID NO: 25029
  Synthetic sequence.

SEQ ID NO: 25031 - protein, 178 aa, Artificial Sequence
  Synthetic sequence.
DEEERLLREAEEMHERNKRLIDKLRREVEESLKEVEREIRRLLTDIARLVRRVEELKKNNIDRKEVEDLLRRIEEELEKIERELRKILRDDERKLKEAEDRLRRMLEENKRVLRRIKEENKEAEEVLREIRKLVEESRKILEKVIRDWRRITEELKDRLRRVLEELKKLVDELRKTLT

SEQ ID NO: 25032 - protein, 178 aa, Artificial Sequence; identical to SEQ ID NO: 25031
  Synthetic sequence.

SEQ ID NO: 25033 - protein, 178 aa, Artificial Sequence
  Synthetic sequence.
SDRERLLEEIKDLNRRNKEILERILRRSEELLKKAEDLLDKIKRDSDRAARKVEELKRRNISEELVKELLKELEDINRELKKEIERLLKEWEKDSRELEDEIRRVLEENRKKLRDVKEENKELEEVLRRLEKIVRDSERELRRVREEDKKVADEIREKLKRVHDESERIVRELKETLR

SEQ ID NO: 25034 - protein, 178 aa, Artificial Sequence; identical to SEQ ID NO: 25033
  Synthetic sequence.

SEQ ID NO: 25035 - protein, 181 aa, Artificial Sequence
  Synthetic sequence.
KELEDVKKRVDDLLRENERVVRELLESSKRLNEENEEAVRRLDESSKELAKRVKEIKDRGTSEDAVRKVDEELKEHLKEVKKRLEDLVRKNEEHLRRVKETSDRMKKKNDEELDRLRTKDGDDRDVRRVLEFVKEVIKEIERIHKKVNDDNRKLIEESIRRLKKVLDDNKRVIDELRKTLK

SEQ ID NO: 25036 - protein, 181 aa, Artificial Sequence; identical to SEQ ID NO: 25035
  Synthetic sequence.

SEQ ID NO: 25037 - protein, 179 aa, Artificial Sequence
  Synthetic sequence.
DEEEEVKKRVEELLDELRKSIKKSVDDSKRVLDEARKSVERSREELEKLLRALEDILRKGNKTGELLERLKRLLDKLREDADRWRKELEKLVEDLKRHADEWTKELDRLIRELRKRLEAREDDLRRLEEEAKRLVEEVRRRDEEHLKRSEELLKEVEERDRELLKRARDLFEDVRRKIE

SEQ ID NO: 25038 - protein, 179 aa, Artificial Sequence; identical to SEQ ID NO: 25037
  Synthetic sequence.

SEQ ID NO: 25039 - protein, 179 aa, Artificial Sequence
  Synthetic sequence.
SEKEEVAKRLEEALKRLEDTIRKVSEENERVLRTLEDRARKSAEKVERLLEELRKRLEDSNNQGELLETLERLIERLRRETEDLKRKLKELVTDSRRRTKELEDKLKERAKELRKEIKADKLDLEELKKRVEELTREVEEEIRRLKETSKRLEEEVKRLIEDHDRRVRELKDEVERRIR

SEQ ID NO: 25040 - protein, 179 aa, Artificial Sequence; identical to SEQ ID NO: 25039
  Synthetic sequence.

SEQ ID NO: 25041 - protein, 177 aa, Artificial Sequence
  Synthetic sequence.
DEAREVIKTLRKLLRDSAEILTRVTEEDREVLRELAEIIKKVTDEDRRVLEEARRELDDERVLDELEKLSRDIEKELEKLLRDLTKRSEDIRRDVERLLTDTERDIRRLIRELERRQGDRILEELLERIKRLHEENKKAVDRWREESKKLKEEVKKKVKEWKDTSEELLRRVKERAR

SEQ ID NO: 25042 - protein, 177 aa, Artificial Sequence; identical to SEQ ID NO: 25041
  Synthetic sequence.

SEQ ID NO: 25043 - protein, 177 aa, Artificial Sequence
  Synthetic sequence.
KEVEEVIKTLRRLSEKLAREHKKVIDELRDLLRRSEEELKRVAKADEDLLDEIRRKVQDRSVLEELRKKSETMKRELKKLLDDTRKKIEDIERTNERVLREHRKKTEDLIRELDKRRGEEILEEVKERIDRLVKENKEIVDRSRELAKELHDRNREMLTKWLEDSKRLVEEAEKKAR

SEQ ID NO: 25044 - protein, 177 aa, Artificial Sequence; identical to SEQ ID NO: 25043
  Synthetic sequence.

SEQ ID NO: 25045 - protein, 177 aa, Artificial Sequence
  Synthetic sequence.
DKEKEVTDELRKAKRDNDEVVKEIEKESRRLLEEVKETVKRDKKVLRELEEEVKEAKKKNVSEDLVEKLLRKWEKVSKELKDRHRRLIEEWDKVTKELEKKSRKIIDENRKILKRIADRGVDKKVLDEIRKVLTEAKKMHDDVLRRDREVLETARKLSEDSKKENEDVLRKVAEELR

SEQ ID NO: 25046 - protein, 177 aa, Artificial Sequence; identical to SEQ ID NO: 25045
  Synthetic sequence.

SEQ ID NO: 25047 - protein, 176 aa, Artificial Sequence
  Synthetic sequence.
DEERDLERKLEEVIRRAKETSERLNRELERVIEEVRRRHEEAKRRAEEVIRRILKRLGTEREEAKDVVRRLEEILRELDDHVRRSEETAKEILDRSRKKSEELERKLREVLRTLREARLDKDEVDELVERLKRDIDRWAEDVKKLIEDLRRMVERNLREIDKLLKDLKRVVDETKK

SEQ ID NO: 25048 - protein, 176 aa, Artificial Sequence; identical to SEQ ID NO: 25047
  Synthetic sequence.

SEQ ID NO: 25049 - protein, 179 aa, Artificial Sequence
  Synthetic sequence.
SEADKLLDEVRKRVEDMERRLEELVREDRKLVEDHHRDNKRLLDRVKKLAEDMERLIDRGEVDEEVIKRLEEELKKLLEDNKRHLDELKRRSTELLRELRKLLEELEKTLKDLLREKSGRSEKAEDVRRRLKELAERVRRVVRRVEEESKRTLKELEKSSKELAKKLRDLVETVERRLR

SEQ ID NO: 25050 - protein, 179 aa, Artificial Sequence; identical to SEQ ID NO: 25049
  Synthetic sequence.

SEQ ID NO: 25051 - protein, 179 aa, Artificial Sequence
  Synthetic sequence.
SRVDDLLREAERLAEEHHRLNKKLVDEDRELVRRHHETNRRVLEEVKRLVEEAEKLIRRGDVDERVIRELKERLRDLLRKNREHLRRLEETSKDLLRRNEEHLKRLEETLEDLLKRFSGRSEEAKRVAERVRRLLERLRESSKRVKETSKETLERLRRSSEKVEEDLRKLIEDVERAAR

SEQ ID NO: 25052 - protein, 179 aa, Artificial Sequence; identical to SEQ ID NO: 25051
  Synthetic sequence.

SEQ ID NO: 25053 - protein, 179 aa, Artificial Sequence
  Synthetic sequence.
RELEELVKRDREEVRKHHELNKELLDRARKLVRDHHERNKRLVREDEELVREAKELIERGEVTEEKIEELMRRSKDLLRDNRRHLRELEDTLRRLLEENKRHLDDVRRRSEELLRDKSGRSDEARKAKRESERTLKELEESSREVEKELRRLLKELRESSKKVEDDSRKSLERVERALR

SEQ ID NO: 25054 - protein, 179 aa, Artificial Sequence; identical to SEQ ID NO: 25053
  Synthetic sequence.

SEQ ID NO: 25055 - protein, 179 aa, Artificial Sequence
  Synthetic sequence.
SKADELVKKDREKVEEMERRLRKILREVEELVKEHHERNKRVLDEVKKRVDDAKELIKRGEVTEEVIRKLEEELKDLLRRNEKHLRELEETLKKLLEEATRLVKKLEDDSRRLLKDDSGRSRKAEEVEKDSRRTLERVKDVLRKVEETLRELLDRLRESSERVTEALKRLMEEVREALR

SEQ ID NO: 25056 - protein, 179 aa, Artificial Sequence; identical to SEQ ID NO: 25055
  Synthetic sequence.

SEQ ID NO: 25057 - protein, 185 aa, Artificial Sequence
  Synthetic sequence.
SKLEALVKEVEELVKKAKKDLDRLVEEDKKLAEEHHDRNRKLVDTVRELVERAKEDIDRRGKTEELEELLRRLAEEIERLKRENEKHLRELERTSRELVRRLEELLKRLAERIKKIIDDAERDVSDKKELEEVVKELRRLLKELEEVVRRVARESEKSLEEVRRSSEEVKKALDKLLKELEDAVR

SEQ ID NO: 25058 - protein, 185 aa, Artificial Sequence; identical to SEQ ID NO: 25057
  Synthetic sequence.

SEQ ID NO: 25059 - protein, 183 aa, Artificial Sequence
  Synthetic sequence.
SELERIVEEVKKLVEDHKKKLKDIVEEVEELVRRHEKKLEDILRRNEKRVRELKEEVRRRGKLEEELVKDAERESRKNKEEIRRSNEEIHRRLKELKERIKESNDKLHEDLKRLTDDIDRRVRDRKKAEEVKRRLEELLKEANKASEEVKRTLDKLLEDVNRESERVERASDELLKRLRDDAR

SEQ ID NO: 25060 - protein, 183 aa, Artificial Sequence; identical to SEQ ID NO: 25059
  Synthetic sequence.

SEQ ID NO: 25061 - protein, 183 aa, Artificial Sequence
  Synthetic sequence.
SELEELVKTVKKLVEDHKRRLKELLERARRSTEDLKRKLEKLVRDVRKLVEDAKDAIRKSGKADERLLETIKRALEELKRRARDLLRRHKEEIDRLIKDIRRSNEELHRAAERLRDELRKRVRDKDELKKVEDALRRLLEELNEVSEEVERALRELHREVEEAIRRVEKELDRLLKEVEDAAR

SEQ ID NO: 25062 - protein, 183 aa, Artificial Sequence; identical to SEQ ID NO: 25061
  Synthetic sequence.

SEQ ID NO: 25063 - protein, 182 aa, Artificial Sequence
  Synthetic sequence.
RELEEILKESEKSVEDIKRELEKIKKKSKTDLEKWKDDLRKIRKEIADLVRKVTREVEDGRSDSRLRDLERRLREVVRRIEEELERMIKTHEDRVRELEERLRKIIDDHRRKVEDLLRKIGSEDEKVKRVLDELKRSLEEVRRALEEVREVLRESLKRLRDLAEDLKRELRELLKELEERAR

SEQ ID NO: 25064 - protein, 182 aa, Artificial Sequence; identical to SEQ ID NO: 25063
  Synthetic sequence.

SEQ ID NO: 25065 - protein, 177 aa, Artificial Sequence
  Synthetic sequence.
SEKEDVERRIRRLIERLRRMIEELRRRNTDILRKVRELVEEVKKADERSIREVEKLLRDVDEELKKRIKTLIDRSREETEEMDRDVEKLIRESEKRTDELEEELRRLARELEKVVTRDVTDLDELIERAERLVREIERKLRKAIEDSKDLLRRIEERLRRLIEKSEKLLRDIKREVD

SEQ ID NO: 25066 - protein, 177 aa, Artificial Sequence; identical to SEQ ID NO: 25065
  Synthetic sequence.

SEQ ID NO: 25067 - protein, 182 aa, Artificial Sequence
  Synthetic sequence.
SEIEKLVKEIEDHLRRLKEEIEKSSRELKKHLDELERRADKIVRDLRRLVEEIKDTIRREGPRDELLRRLEEALRRIEETLERLRRDHKRLLDRSEDKLRELEEDHDRLLEEVRERLRKSELPREAVERLRKALKESKERLKKALEDNRRTLKKSEEDLKKVMEEVKETLDRVKKEVERALD

SEQ ID NO: 25068 - protein, 182 aa, Artificial Sequence; identical to SEQ ID NO: 25067
  Synthetic sequence.

SEQ ID NO: 25069 - protein, 182 aa, Artificial Sequence
  Synthetic sequence.
SEIEKLARDAEEHLRRLLEELRKSSDDLRRHLEELKKKLKEIVDRLKELVDRIKDTIRREGDAREIEKALEKVLREVEETLRRLLEDHKRLLEESKKRLKELLKNHEDLLRKLEDDLRKAELDKKVIDDLRRILEESARRLKRAAERNDETLKESADRLRRAIDRLREVAEKLSRDVRRAAK

SEQ ID NO: 25070 - protein, 182 aa, Artificial Sequence; identical to SEQ ID NO: 25069
  Synthetic sequence.

SEQ ID NO: 25071 - protein, 182 aa, Artificial Sequence
  Synthetic sequence.
SEIEDIARRLREHLEDLKKKIKDSSDELRKHLEEVKRRIERTSEKLTDDVRKIEEKIRKDGPREKIEEDLKEALTRSRTELKKLLDDHRRLLKRSDELLKKLLENHKRTLDRIKEELDRSELPEERIRDLEKILEDSERELRDMARKNRETAERSERELRKVLRENDRTAKKLTDDVRRTAK

SEQ ID NO: 25072 - protein, 182 aa, Artificial Sequence; identical to SEQ ID NO: 25071
  Synthetic sequence.

SEQ ID NO: 25073 - protein, 182 aa, Artificial Sequence
  Synthetic sequence.
DEIDKLVEDVERHLEKLLREIERSSEELKKHVEDLREKLRDLVRRLKEVVDEIRKTVRDKGPREEILEDLKRILEEIDDTLRKLLANHDELLKRSDDLLRELIADHERLLKRVEEELKRSELPKEDVDRLREMLERSRRRLKRAADENRRTAEKSRKELKEVAERVRRALERMRREVEEELR

SEQ ID NO: 25074 - protein, 182 aa, Artificial Sequence; identical to SEQ ID NO: 25073
  Synthetic sequence.

SEQ ID NO: 25075 - protein, 182 aa, Artificial Sequence
  Synthetic sequence.
SEIEEIAKKLEEHVKRVVEEIRKSSEEAKRHVEDVKRKIEELVRELARLVKEIKEAIRRDGPRDELEERLKKVLDEVRKRLEELLRNHEELLKRSDDRLKELLKNHEEELRRVEDELRRIELPKERIDELREIAKRSRDKLKKVADENRRTLEKSLRDLARAVEELRRRAKRLEEEVRRERT

SEQ ID NO: 25076 - protein, 182 aa, Artificial Sequence; identical to SEQ ID NO: 25075
  Synthetic sequence.

SEQ ID NO: 25077 - protein, 182 aa, Artificial Sequence
  Synthetic sequence.
SDIERLVEEVEKHLKELEDEIRKSSEELKRLAEEISRDIRRTSEELKKLIEDIKDTIRRDGTRDEIERRLEEAIRRSRERLERLKERLDRSVKESRKKLKRLEENHRELLKRLEDRLREIELPKEKIDRLRKILEESEKRLEELARENERTVKEVKKEIDDMVRENEETAKRLLDEVRETLR

SEQ ID NO: 25078 - protein, 182 aa, Artificial Sequence; identical to SEQ ID NO: 25077
  Synthetic sequence.

SEQ ID NO: 25079 - protein, 172 aa, Artificial Sequence
  Synthetic sequence.
DELEKLLEDLRRKIRKIKEDLRKTSKENRDELRKSKKRLEDLVREVRRLVEEIRKLKEQDRREVEKTLRDLRKKIEDAIRESEERSKKLLDDNKKTADDIRRDLKRTEERLRKEGISEEVEKTLRELIKEIEKVLEDDERTVRELIERNKELLDRLAKEVDRLIEEIKREAD

SEQ ID NO: 25080 - protein, 172 aa, Artificial Sequence; identical to SEQ ID NO: 25079
  Synthetic sequence.

SEQ ID NO: 25081 - protein, 175 aa, Artificial Sequence
  Synthetic sequence.
SEADKVRKELDDVRRRVKKALDDIRRELEKLVKEVEDALRDHERSNEELVREVREKLKDDKDVERTVEKSHRDSRRLVEEIKREVEKLRERLERVLRKIEEDVKRLKEKLERLIEEGNVDDRVVEEIRDMMRKLKRELERIVEEAKKVVEDLKRRLEEVSRRSADLVRRLKERAR

SEQ ID NO: 25082 - protein, 175 aa, Artificial Sequence; identical to SEQ ID NO: 25081
  Synthetic sequence.

SEQ ID NO: 25083 - protein, 175 aa, Artificial Sequence
  Synthetic sequence.
SDLERVKKDLEDVVRRVEEVLREHKRTNDEIIREIERLIEELRKENERLAREVRDKLKDVDDVRRAVKKSHEDVREVLRRLKEEADESHEKSKEVIKEIEKRVKKLLEDLDRLIKEGRVDERVVDEIRKVVKELEERLRRLSEESRKLVKDIKEKLDKLAEDSRRLVEKLERDAK

SEQ ID NO: 25084 - protein, 175 aa, Artificial Sequence; identical to SEQ ID NO: 25083
  Synthetic sequence.

SEQ ID NO: 25085 - protein, 182 aa, Artificial Sequence
  Synthetic sequence.
REFEELVERVKRVVEELTRRLRETSEETKTVLEKLRKELEEASRRIEDVLRRLTEKIRKDGRGGELKEEVERELKRLRDESEELVRRVEEVVDRLRRRHEELKKRAEDVLRKLREELKEMRDRGKGTEELEETLERLVEAIRDALRKDEETMRRVAEAIRRLLEDHRRSLEEVLEKIRDALR

SEQ ID NO: 25086 - protein, 182 aa, Artificial Sequence; identical to SEQ ID NO: 25085
  Synthetic sequence.

SEQ ID NO: 25087 - protein, 182 aa, Artificial Sequence
  Synthetic sequence.
SEAEKIVEDIRRVIRELKEKLKKTSEDTEDTVRKLSRRLRELAKRSAELVERVTREIRKDGPGGELVRKVRELLKKSSKEIEDLVREVEEKVEELKRRHDKVVKEAEEVLRELEKRVDEVRKKGLGTEELEETLRRVAEEIRRLLEEDRETLRRVERKIREMLKELEEINRRLIKEVDEEVK

SEQ ID NO: 25088 - protein, 182 aa, Artificial Sequence; identical to SEQ ID NO: 25087
  Synthetic sequence.

SEQ ID NO: 25089 - protein, 182 aa, Artificial Sequence
  Synthetic sequence.
DEVEEIVRRIEEVLKDLRRRLETLARESRDLVRKIKEELRRHSDESRRLLERIKERIRRDGSGGELVRDVERLLKESSDTLEELKRRVRELLERSSKKVEDLVREAEKVLKKLEEDVKRMRDKGKGTDELKKEADRVKKEIRDMLRKLKKINDDLIREIEEALKDNERTNREIIRRIEEELR

SEQ ID NO: 25090 - protein, 182 aa, Artificial Sequence; identical to SEQ ID NO: 25089
  Synthetic sequence.

SEQ ID NO: 25091 - protein, 182 aa, Artificial Sequence
  Synthetic sequence.
DEAEKIVRDIEETVRRLARELEKHSEDSRRLVERIKEELTRHSKKVADVVRELKKRIKRDGSGGELVEDAKRVLRTLEETIEKLKRDVERLVKESSDSIRELEERVRKVLEDLRREVEEARRRGKGTEELEKRMRRLVKEIERMLEENKRTNEELVREIEEALKKNEETLRRLKREIEEALR

SEQ ID NO: 25092 - protein, 182 aa, Artificial Sequence; identical to SEQ ID NO: 25091
  Synthetic sequence.

SEQ ID NO: 25093 - protein, 175 aa, Artificial Sequence
  Synthetic sequence.
SEAEELVKDAERVVEELERRLRKVSEDIDREVKKIKRELDEHSKRVKETVDDVRRRNLPEEDVRRIVEELKDSLEKLREKLERKREEIRRRSEKLKREADKVLEELKKKLDEIRKKGLGTEELKKRVEDLIRTIKELIKRHDDSVKEVEKRIREMLERNRKSVEEVIEELKRTSK

SEQ ID NO: 25094 - protein, 175 aa, Artificial Sequence; identical to SEQ ID NO: 25093
  Synthetic sequence.

SEQ ID NO: 25095 - protein, 182 aa, Artificial Sequence
  Synthetic sequence.
SELEELVKEVKELVDRSKEELKKLSEELKKLLDDLIKRIEDLSRRSKRLVEELRRRVEERGRRKDLLRRAREELRKSDEELDEIEKRAEKRVRDSKRRVREIHKESERRLREIRREIEERVRGEEEMKRVEEELKRLREEDREAVERHDESIRKLREDLRRAVETHKKSNRDLLREVEETVR

SEQ ID NO: 25096 - protein, 182 aa, Artificial Sequence; identical to SEQ ID NO: 25095
  Synthetic sequence.

SEQ ID NO: 25097 - protein, 179 aa, Artificial Sequence
  Synthetic sequence.
DEVEELIRKIEDLLRRIEEKVTKAIRKSERLLEEIKKKIKEMIDKSERLVEEVERRTRNSDKDKEEVVRRLKKEAEDSHRELEDLIRRVEEELRRSHDELRRLVEAVRKEIKDLEREVEESRASEDVKRVLKKVADDVERLLRDLERRNRKVREDVKRVLEELRKSNERSIRRIDETLR

SEQ ID NO: 25098 - protein, 179 aa, Artificial Sequence; identical to SEQ ID NO: 25097
  Synthetic sequence.

SEQ ID NO: 25099 - protein, 179 aa, Artificial Sequence
  Synthetic sequence.
REIEEIIKRARELLEEVEEEWRRLIEKSRRLLEELKKRWDKLIEKSKDLLRKIEKTTKDSDKDKEEVVRRLEEEAKKSHEEVKKAVDDSRKETKESHEEVKRVIEESKKRTEELKERLERNNIDDELRKILKRVEDENRRLVEEVERSNRRSMEENERLAEEVRRSNKDVIDKIRERLR

SEQ ID NO: 25100 - protein, 179 aa, Artificial Sequence; identical to SEQ ID NO: 25099
  Synthetic sequence.

SEQ ID NO: 25101 - protein, 184 aa, Artificial Sequence
  Synthetic sequence.
DELERLSESVKKAERRIERLNEELNERVKEVTKAIDDLNKRLNDESKRVKEELRKVLARSDREEVERKLRKLEEELDRENKRLNDESEKLKRELEERNKKVNERSKRLVERLRRVLEEIRRRKVPEEVIKRVLDDVERAVDEVRKLIEDVLKEHEDILREVKKELDKAIERHKEILKRVREDIK

SEQ ID NO: 25102 - protein, 184 aa, Artificial Sequence; identical to SEQ ID NO: 25101
  Synthetic sequence.

SEQ ID NO: 25103 - protein, 184 aa, Artificial Sequence
  Synthetic sequence.
SVLEDLARKVERVIREAKKVNEELNRRSEEVRRRADEVVADLNRESKKVDDELKKVLARSTREEVARDLERLRRELEELNKRLNDRIEEIKERLERLNERVNRETDELVRELKKRLKEVEDRQVPEEVARRVVEELKKVLKEIEDEIRRVIERHKEALDEVRRLVKELKDRHDKILREVREKIR

SEQ ID NO: 25104 - protein, 184 aa, Artificial Sequence; identical to SEQ ID NO: 25103
  Synthetic sequence.

SEQ ID NO: 25105 - protein, 184 aa, Artificial Sequence
  Synthetic sequence.
SSEDRLRETVEDVIRRARDANRELNKASRDVEEESKKLNKELNDRSRKVERDLEEVLRRSTDEELARRLEELRKELRKLNEDANRRSKKLIEELREKNKEINKRTDKVVKELKRKLEEVEKRKVPEEVIERLIRDLRRVLEEIKREIEEALRDHERVLKENEDMVREILRRHEEILKRMTDEIR

SEQ ID NO: 25106 - protein, 184 aa, Artificial Sequence; identical to SEQ ID NO: 25105
  Synthetic sequence.

SEQ ID NO: 25107 - protein, 184 aa, Artificial Sequence
  Synthetic sequence.
SVLERVADELRKVEEAIDRLNKELNDAVERVERESRRVNKELNDASERVERELDEVLKRTRRKEVADRLEKLKEDLRRTNEDVNRRSKELIDRLREENKRVNEESERIKDKIRRDLEDIKRRKVPEEVAKELIDRIRKLLDDIRRKLEEVLKRHEEVLKRNEDTIRKVLKRHEEILEKVKRDIK

SEQ ID NO: 25108 - protein, 184 aa, Artificial Sequence; identical to SEQ ID NO: 25107
  Synthetic sequence.

SEQ ID NO: 25109 - protein, 184 aa, Artificial Sequence
  Synthetic sequence.
SSKERLREAVERVERESDKVNKELNDKSRRVTEELRKLAEELNRRSKEVEEELDKLLARSTRKEVADRLEDLKRRLRELNKDLNRRLRELEEELRRLNEKLKRESEELKERLRRLLEEVEKRDVPEEVIRRLIEELDRLLEENDRRIKKAIEDHKRILEKAEREVREILRRHEKILEDVREEIR

SEQ ID NO: 25110 - protein, 184 aa, Artificial Sequence; identical to SEQ ID NO: 25109
  Synthetic sequence.

SEQ ID NO: 25111 - protein, 171 aa, Artificial Sequence
  Synthetic sequence.
DEEEDLRRAIERVIETVRRLVERVEEESKRVADELRKLTKRLEEVVRKVDEDARKEVKKKDLLDKVRKELEEILRDLRRHTEELERESKKSIDELRELLKTLRRELEEIRKRGERVEDVKRRLEELLKRAKEVLDELIKRHRDLLRRHEEKVRRLIKRIEDLLRELSKKAK

SEQ ID NO: 25112 - protein, 171 aa, Artificial Sequence; identical to SEQ ID NO: 25111
  Synthetic sequence.

SEQ ID NO: 25113 - protein, 171 aa, Artificial Sequence
  Synthetic sequence.
SKEEELEKIVRKIREDLRRAVKEVEDESKRVLESTKKALDTIRRVSEKVIEDLRRELRDEEVLKDLERRSKETIKKLEEHVKRSEEESRDSIRELRRLLEELERRLEDLKRRGEPVDELVRRLEELLKELRKRLEDLIRRHEDINRRNHELIRRAIEEHRRLLREAREREK

SEQ ID NO: 25114 - protein, 171 aa, Artificial Sequence; identical to SEQ ID NO: 25113
  Synthetic sequence.

SEQ ID NO: 25115 - protein, 179 aa, Artificial Sequence
  Synthetic sequence.
DEIEELIKKLREDLDRSRREVEKNSEDLKELIKRSEERIEKLIEDLERMVDDARRKNSKDSTLKETIKKLAEELRRELKKLHEDTKRKLDESRERTERIHKRTEEILRDLRDKLKRIDVDEKLLKKLEDVIDDVRRRDEDVVRKNEESLKRIEKRDEELIRKIEEVIRRAERKVDEVMR

SEQ ID NO: 25116 - protein, 179 aa, Artificial Sequence; identical to SEQ ID NO: 25115
  Synthetic sequence.

SEQ ID NO: 25117 - protein, 179 aa, Artificial Sequence
  Synthetic sequence.
SKIEELIKELEKLSRTNEELVKRVLEELTRLVEESAKRIEDIIRRLKEVVDKARRENSRDERLLREVEKELRRVEEELEELHRRTKKKLDDVRKEAEDSLRKSKDDMRKVEEELRRTDVDKKLLDKIKKAIEDLERENERALKELEKRLRELLRTDRELIRKIEEEIKKLRREVEEVLR

SEQ ID NO: 25118 - protein, 179 aa, Artificial Sequence; identical to SEQ ID NO: 25117
  Synthetic sequence.

SEQ ID NO: 25119 - protein, 184 aa, Artificial Sequence
  Synthetic sequence.
SIKERLTEVLKRLAEEIRKVIEENKRTVDRAREEVERVIRKNREVLKRIKERADEVIKRISDERLVREIEDRLEKLKKTSEDLVRDVERIVEEMERSSRELEKDIRRILDELAKKVEKVKKDGSDERVVEELIREAKKIVEDIVRRVKRHSREVERIVEEIRRRAEEHIERLKRSLEEVEKKVD

SEQ ID NO: 25120 - protein, 184 aa, Artificial Sequence; identical to SEQ ID NO: 25119
  Synthetic sequence.

SEQ ID NO: 25121 - protein, 184 aa, Artificial Sequence
  Synthetic sequence.
RIMEKLEEVLKELRKKIKKLNKDNEETVRRIKKEVDKVIKKNRDVNERIRKRLEEVISRISDERLVRDIERLARENSRTSEELEREVRKIVREAEESSKRLIEKNEDLLRRLTEEVKRVKDRGESEEVVEKLIEDMERVVAESAKENKKHSDDVKRILDEIRRKAEDHIRKTEELLRRIEERTR

SEQ ID NO: 25122 - protein, 184 aa, Artificial Sequence; identical to SEQ ID NO: 25121
  Synthetic sequence.

SEQ ID NO: 25123 - protein, 184 aa, Artificial Sequence
  Synthetic sequence.
SIKEKLTEELERLAKRIREANEDNKRTVEEVEKRIREVIKKNRDSNKEIKDDVERVLSRIDDEEVVRKIKELVERNSETSERLRRKVEEELKRLRESSRKLIEDNKKLLEDLRREVEEAKRRGEDEEVVERLLKKMREAVKKSEDENREHSERVKRIIEKIAREAEEHSKRTKELLDRIREEVR

SEQ ID NO: 25124 - protein, 184 aa, Artificial Sequence; identical to SEQ ID NO: 25123
  Synthetic sequence.

SEQ ID NO: 25125 - protein, 184 aa, Artificial Sequence
  Synthetic sequence.
RVDEDLKRVLDELKKRVEDLNEENKKTVEDISRRVREVIKRNEDMLREVKKRAREAISRISDERLVRRIEELLKRLEETSRKLARDVEEIVKDIERSSEELIRDNERLVRELAREVEEVSRRGESEEVVRELIKKMRDVVRKSEKDNKDHSERVKRILKRIEERAREHTRRLEEVLRKVEEDVR

SEQ ID NO: 25126 - protein, 184 aa, Artificial Sequence; identical to SEQ ID NO: 25125
  Synthetic sequence.

SEQ ID NO: 25127 - protein, 183 aa, Artificial Sequence
  Synthetic sequence.
RVKEKLREVLERLEREIRKILKDNKETVKRIEEEARRAVEKNKEALKRLEDRVRELLEDKDQEDRKKVKDVVDELRKSSKKLTDKIRKILEDIKKTSEDLERRVKEVLDKLREDVKRIEEKPVDEEKVERLAEELRKIVRKIIEDVRKHSEDVRKILEDVKKEVDDHVREMEEIVKRLEDEIR

SEQ ID NO: 25128 - protein, 183 aa, Artificial Sequence; identical to SEQ ID NO: 25127
  Synthetic sequence.

SEQ ID NO: 25129 - protein, 180 aa, Artificial Sequence
  Synthetic sequence.
SELEEIVKEIKRILDEHEKKVRRNSEEMKRIVDRHAERVEKLIREIEELLRRLDELVKRGEVDEETAERIKDRIRKLLEEAKKHSKRIKDELDRSNKELDDHSEKVKREIDKLVKDVRRKGVEGEEDLERMAREIKDRLDKIDEENKKSSEELKRELDRLDEKLRDVARRIMEAIDERTR

SEQ ID NO: 25130 - protein, 180 aa, Artificial Sequence; identical to SEQ ID NO: 25129
  Synthetic sequence.

SEQ ID NO: 25131 - protein, 180 aa, Artificial Sequence
  Synthetic sequence.
DELREIVRRIEKILEDHARTIEEVIERIRDILRKHEKLVEEVLRRIEKLLKELEEMVRRGELDEETVRRVEREIEDLLRRAKEHSEEVKKRIEELLERLRRHSRDVERAIDELVKKVRERGVEGTEDLERMAERVKRELERLNKKAEDALREVKRALDDLDRDLKRVLEEIKERIRRATT

SEQ ID NO: 25132 - protein, 180 aa, Artificial Sequence; identical to SEQ ID NO: 25131
  Synthetic sequence.

SEQ ID NO: 25133 - protein, 180 aa, Artificial Sequence
  Synthetic sequence.
SELERILTEIEKRIEEHERRIKENSKRMKEIVDDHERKVEEVLRRIRKLLRDLEEMVKRGELDEDTAEKVKRDIDKLLEEARRHSERVKRELDKSNEDLRRHSKKVIDDIRRLVEEVRRRGVERREDLEKVARDVEKRLEDANRENEKSSRELKRRLDELDKKLEEEARRIKKAIDDKTR

SEQ ID NO: 25134 - protein, 180 aa, Artificial Sequence; identical to SEQ ID NO: 25133
  Synthetic sequence.

SEQ ID NO: 25135 - protein, 180 aa, Artificial Sequence
  Synthetic sequence.
SEVDEVAKEIRRILEEHEEEIRRNSEEAKRILDEHREKLKRNSDDMRRIVKEIEDMRRRGELDEETAKKIKEELERSNRKLEKHSEDVIRRLRKSNTDLKRHSEEVKKEIEKLVKRLEDKGVEREEDLREVAERVKKDLDRLNRENDESSKEIEKDLKRLDDRNRDVSEKLKKEIDELTK

SEQ ID NO: 25136 - protein, 180 aa, Artificial Sequence; identical to SEQ ID NO: 25135
  Synthetic sequence.

SEQ ID NO: 25137 - protein, 180 aa, Artificial Sequence
  Synthetic sequence.
DRLREIVKRIRDILKEHEDRIRENSKRARDILREHKRKIEEVLRRIEKLVEDLERLKRRGELDEETAKKVKEDIRRLVRTVEEHSRRVIEELDRSNDELRKHSEDVKREIEKLVEDVEREGVEGEEDLRRAAEEVKKKLDELNEENERSSEDVKRTLKKLNDELREKVRRVMERIDEAVR

SEQ ID NO: 25138 - protein, 180 aa, Artificial Sequence; identical to SEQ ID NO: 25137
  Synthetic sequence.

SEQ ID NO: 25139 - protein, 180 aa, Artificial Sequence
  Synthetic sequence.
DEVEDVLRKIEKILDDHRKRIEKNSRDMARIIDEHRRKVEENSREMKKLVDDLKKAVDRGEADEETAEDVKRKLEKSNRELEKHSEEVKRRLDESNEDLRRHSEEVKERIERLVKKLREDGVEREEELKEVADRVKEKLDRLNRENEKSSEELKRELDKINDENRETSERLKREIDETTR

SEQ ID NO: 25140 - protein, 180 aa, Artificial Sequence; identical to SEQ ID NO: 25139
  Synthetic sequence.

SEQ ID NO: 25141 - protein, 180 aa, Artificial Sequence
  Synthetic sequence.
DELREVVKTIEEILRDHERKVRDNSRRMKEIIKRVKEELERVIKEAKELVERLKEAVRRGEVDEDTARKIKKELRDLLRELKKRLEEIKKRLDESNDRLRRHSEEVKERIDRLVDKVRRDGVEREEDLRKMAEDVKRALDKINRDNEESSRRLKKELDDVLRKVEEVIRRLEEEIDRLTT

SEQ ID NO: 25142 - protein, 180 aa, Artificial Sequence; identical to SEQ ID NO: 25141
  Synthetic sequence.

SEQ ID NO: 25143 - protein, 180 aa, Artificial Sequence
  Synthetic sequence.
SELEKIEEDIRRILKEHKDTVRKNSEDIDRSVKEVKERIDKILKEIDDLLKELRELVERGELDERTVEEVKRRIEELLREVEKLSEKHKRDLDRSNDELRKHSEEVKKEIDDLLEEVERRGVEKREDLERVVREVKKELDDINRENRKSSEEAKKKNDDVLAELEKRIREIKRRIDEDAT

SEQ ID NO: 25144 - protein, 180 aa, Artificial Sequence; identical to SEQ ID NO: 25143
  Synthetic sequence.

SEQ ID NO: 25145 - protein, 180 aa, Artificial Sequence
  Synthetic sequence.
SDLEKLVEEIKRLLKELKERVTKNSEDMKREVERHKELVKKLKKRIEDLLRELEDAVRKGELDEKKVKELKDEIRKLVKELRDHSREVKKRLDDSNRKVEEEVRKLKEDIDKLVKEVRDKGVEKREDLERVVEEVKKEIDKIVEENRDSSRKLKERLDEANEELERRVEEIERRIDEKAR

SEQ ID NO: 25146 - protein, 180 aa, Artificial Sequence; identical to SEQ ID NO: 25145
  Synthetic sequence.

SEQ ID NO: 25147 - protein, 180 aa, Artificial Sequence
  Synthetic sequence.
DELREIVTRADETLKRVADKIEENSRRMEEIVREHERKVRELLKRIEKLVRDLSAMVRRGELDEESLKRLKDEIEKLLEEAERHSRDVKRKLDESNKRLEDDSRRHEEDLDRLVTEVEKRGVEGEEDLRRVVKRVKETNRRLLEKNKDSSRKLKKRLDEANKTLADALEEVKRRIDERRK

SEQ ID NO: 25148 - protein, 180 aa, Artificial Sequence; identical to SEQ ID NO: 25147
  Synthetic sequence.

SEQ ID NO: 25149 - protein, 180 aa, Artificial Sequence
  Synthetic sequence.
DELDEIVKRAKETVEKVKREVDANSKDIERILREHRKKVDKNSKDMEDLVRKLEELVRRGELDEETAKDVKRRLDESNDRVRRHSDEVKKKLDKSNEELRRKSDEHKKDLDRLLDEVRRRGVEREDELREAVERLERENRKVLEENRRSSEKVKRDLDRVNRENEEVSERLKKRIDEAAT

SEQ ID NO: 25150 - protein, 180 aa, Artificial Sequence; identical to SEQ ID NO: 25149
  Synthetic sequence.

SEQ ID NO: 25151 - protein, 174 aa, Artificial Sequence
  Synthetic sequence.
SEIEKIIKELDDLVKEDEDTIRRLEEELRELLKEIDREAKKSDEELEKTLEELAKIARDGKLDEELLERVERTLEKSERRMRRLKEELKRELDRIREDLERSKRDLDRKIKKLLDEIDDEELRRVLERVAEDSKRTLDRLERVLKEVERRVDEALKRNKTVLDKVREDVKRLKD

SEQ ID NO: 25152 - protein, 174 aa, Artificial Sequence; identical to SEQ ID NO: 25151
  Synthetic sequence.

SEQ ID NO: 25153 - protein, 180 aa, Artificial Sequence
  Synthetic sequence.
REIEEMIKRNEKLLEDDKRKVKRIIEKLDKVLEDDRKRAEDLIRKLEKVAEEIARLRDKVEERDVARKIKELKDEVEKLVRESKKLNEELREEVRRMKEESKELIKESHKEVRDVERKLKVEELLDTLRKVNERVARESEKTIRELEKVLERVNRESKKTIEEVEKALKEVADRVTEVRR

SEQ ID NO: 25154 - protein, 180 aa, Artificial Sequence; identical to SEQ ID NO: 25153
  Synthetic sequence.

SEQ ID NO: 25155 - protein, 180 aa, Artificial Sequence
  Synthetic sequence.
SEIEKLIKENKDLLEEDKRRVEEVIEKLERVIEEDKRRVDEAIKRLDDVAREIERLRKDSDDKDVERDIRRLEKEVREVVEKSKDLIRRLKEEVERVERTSRELIKESHKKVREAKERLKDEDLLRRLERVNEEVARRSEDTIRRLREVLKKIEDDSRRTIDELREVLKRVKTRVTEVRR

SEQ ID NO: 25156 - protein, 180 aa, Artificial Sequence; identical to SEQ ID NO: 25155
  Synthetic sequence.

SEQ ID NO: 25157 - protein, 180 aa, Artificial Sequence
  Synthetic sequence.
DDIERLIKRNKDLLDRIREEARKLIERLKKVLEDDRRKVERAIERLEEVVDEVRKLKKDTDDKDVERLLERLKEEVKKIEEESKKLIDDLRKEVEDLVKRIEESIKTSHDEVREVERRLRNEEVLRKLKKANEDVEREVRKMIEEVRRVLRKVEEDSKRTIKKLKDVLKKVAEEMEKVRR

SEQ ID NO: 25158 - protein, 180 aa, Artificial Sequence; identical to SEQ ID NO: 25157
  Synthetic sequence.

SEQ ID NO: 25159 - protein, 180 aa, Artificial Sequence
  Synthetic sequence.
DEVEEAIKELEDALRKDREAVERMIRDLERLADEDRREVEDHVKKIEELIAAVERMSRDVDEKDLRRTLKELEDSSRELVERSKDINRRLTEKVKELLERSKELNERLKRKIEDIERKLDKREVLEKLKEVLKRVEKASRKTNEDVKRVLDEVRRISEETNRRNERVVEEAKERVERVAK

SEQ ID NO: 25160 - protein, 180 aa, Artificial Sequence; identical to SEQ ID NO: 25159
  Synthetic sequence.

SEQ ID NO: 25161 - protein, 179 aa, Artificial Sequence
  Synthetic sequence.
SEVDEVIKRLEELVERHRRKVEEVIRRLEKLAEDHERKVRELEKRLRELIKRIEELARRDGPREEKVRDVRRKLRTLLKELRDTTEELKKTIRELEKELNETTKKIVDEIRRLRERVNVTSRDFDRLEDVARRVKEDLERTDEEVRRVAEEVRKRVEKTTRDVERVVREVERAIEERRR

SEQ ID NO: 25162 - protein, 179 aa, Artificial Sequence; identical to SEQ ID NO: 25161
  Synthetic sequence.

SEQ ID NO: 25163 - protein, 179 aa, Artificial Sequence
  Synthetic sequence.
DEAREVIKTLEKLLEEHERRVREVIKRLEELIKRHEDRVREVIETLKRLLEEAEKIVRRDGPSDKTVKKLRDDLEEIRKELNKTTKTIKEDLDRTIKELDEITEDIKRKLDDLRRRINVTSEDMRRLEEVIRKVKEALKRTNDRLREVVDEVKKRLDKTDEDATRVVEEVKKRIDEAAK

SEQ ID NO: 25164 - protein, 179 aa, Artificial Sequence; identical to SEQ ID NO: 25163
  Synthetic sequence.

SEQ ID NO: 25165 - protein, 179 aa, Artificial Sequence
  Synthetic sequence.
DEVETVIRRLEELIREHKEKVDRIIKELEKLLRKHEEKVKKVIEELRRLAKEAADIVRRDGPSEEVVDRLRRRLEEILKDLERHSEDVKRRLREVLKELNDETKRLKDDLRRTRKDANVRSRDMERLERVIRKVEEDLDRTNREVEEVIRRVEEEVERLDREAEEVVRDVKEKIDRLKK

SEQ ID NO: 25166 - protein, 179 aa, Artificial Sequence; identical to SEQ ID NO: 25165
  Synthetic sequence.

SEQ ID NO: 25167 - protein, 179 aa, Artificial Sequence
  Synthetic sequence.
SEAEKVIKELRDIVKRNDEVVKEIIRRLEELVKEHKRLVEEIIKRLRELLKRIEEVVRRDGPSEDKVEKVERDIERLLEELERHSRRVEEELKRLLEELEKHARESKREIKEREDKINVTSEDLKRLKDVLDEVIKKTDELLREVERKAREVTKRLRDLDRRVKEVADEVRRRIREATK

SEQ ID NO: 25168 - protein, 179 aa, Artificial Sequence; identical to SEQ ID NO: 25167
  Synthetic sequence.

SEQ ID NO: 25169 - protein, 180 aa, Artificial Sequence
  Synthetic sequence.
EEEERVKEFLDRVDTEDKKLVEELRKVVERVKRENEKLIKESEDMSKKVEDDARRLIAELRREVDETVMREIEEEVRRLKEKNERLIEKSRRDSRRLEEEVRKVIDKSRKDITKIKREVEEEPADKEVVRKLEEYLRRSRKLVDELKKKLRELLERSREKVERSKEELKRILEEVRKKAK

SEQ ID NO: 25170 - protein, 180 aa, Artificial Sequence; identical to SEQ ID NO: 25169
  Synthetic sequence.

SEQ ID NO: 25171 - protein, 185 aa, Artificial Sequence
  Synthetic sequence.
SVSERLRRVLERVAREVKRLIDEDRKVNEEAEREVRKLIKKDEDALKRVAEEVERLIREASDDDKLIREIEEILKKLAEDSRKVVEESKKVLDDINKESEDVVKESEDTLRRAAEELKEVERRGESEEIIEELIRRLEEIVKRLEEKHRTTVKKIEDIIRELKKTHDKTIEDLRRIIEEIEERVR

SEQ ID NO: 25172 - protein, 185 aa, Artificial Sequence; identical to SEQ ID NO: 25171
  Synthetic sequence.

SEQ ID NO: 25173 - protein, 181 aa, Artificial Sequence
  Synthetic sequence.
RVREELRKVLKRAAEAVERVLRKNEEVLRRAEERIRRLLEENEKSLEKVERDVTRILEGGIDSREVTELLRRLRKSSDDLKRRLRKVLEDIERSSRDLVRRVRKLLEELERRVREIEKKPVDEEKVKKLIREIEEVIDRLRRESEKHIEEIKEIITRLDKEVKDHDERLKREVDKLEERAR

SEQ ID NO: 25174 - protein, 181 aa, Artificial Sequence; identical to SEQ ID NO: 25173
  Synthetic sequence.

SEQ ID NO: 25175 - protein, 181 aa, Artificial Sequence
  Synthetic sequence.
SVEERLRKVLEEVRRLLEKIIKDNREVLKRAEEKVRELIKRDKDVLDRIAEEVERLKEKGIDKKKVDDLLEDLRRESKEVIEETEDVLRRIKDSSEKLVRELEKLLEDIERKVRDLERKPVDEEKVDRLIEELKKLIDDAREKNERHIEEIERIIDDLRRKHEETARRLKEAIDRLREEAQ

SEQ ID NO: 25176 - protein, 181 aa, Artificial Sequence; identical to SEQ ID NO: 25175
  Synthetic sequence.

SEQ ID NO: 25177 - protein, 181 aa, Artificial Sequence
  Synthetic sequence.
DKEERIERVLKRVEEELKKLKERIEEVLKKVEDMVRKNLEEIRKVSEDHERTVREIRKRGDITDELVDKLREENERVEEAVRRSVEEAKRELEKVETDVKRLEEEVKRTLDEVRKRVKDTGDEKVVEEIIKELERLLEDLKRRADELIKRLEKLVEEHHRKVEELVRRLEESLDKVRRDAK

SEQ ID NO: 25178 - protein, 181 aa, Artificial Sequence; identical to SEQ ID NO: 25177
  Synthetic sequence.

SEQ ID NO: 25179 - protein, 177 aa, Artificial Sequence
  Synthetic sequence.
SEDEKVKRVVEKVKEESDRLNEELKRVVDEVRKELERLIEKIKRSVERMDRTVRELLKRISDRKTLEEIREEVERAKRRNEEVIERMRRTLEKLERDVRDVLRRDRETLERLRKEVERDGADDRVVEKLKKALDESRKTHKKLIDDLRRALEELEKRVEDLNRENERLLDEIKKRVD

SEQ ID NO: 25180 - protein, 177 aa, Artificial Sequence; identical to SEQ ID NO: 25179
  Synthetic sequence.

SEQ ID NO: 25181 - protein, 181 aa, Artificial Sequence
  Synthetic sequence.
DVERKIEEVVRDVKRELDRLLEENRRSVERVERALDKLLEDSRRVVEEVKKALDDLRRRGLDERTIRELKKEIEELHKRNEKLVRELKKEIRDLLRENEERIRKLKREIDKILEELKRDKVPETDVKKIIEDLRRLVREVEEHSRRTNRRLEELVKDLARHAKRSIDRLKELVDRARERAR

SEQ ID NO: 25182 - protein, 181 aa, Artificial Sequence; identical to SEQ ID NO: 25181
  Synthetic sequence.

SEQ ID NO: 25183 - protein, 181 aa, Artificial Sequence
  Synthetic sequence.
DVEKDIERVVEDVKRELRRLLKEDRDVSKKVKDDLDKLLKESEEVVRRVKKELDRLREEGLDEKKIRELKKEIDELHKENEDLVRDLKRKIDRLNEENEEVVKRLEDEIKKLLDEARRDRIPKSAVDEIIRRLKELVKEMKRHVDKSIKDLEELVRRLEEHIRRSIERLKKLVEEAREDAR

SEQ ID NO: 25184 - protein, 181 aa, Artificial Sequence; identical to SEQ ID NO: 25183
  Synthetic sequence.

SEQ ID NO: 25185 - protein, 181 aa, Artificial Sequence
  Synthetic sequence.
SVEEEVDKVVKKLEEDLDRLLEESKEVVERVEKALDDLLKRDEDVSEEVRRELERLKEEGLDDKKVRDLEKEIEDLNRENKELLERLKRRIRKLHEDNERMLRELKKEVRKRLEDVRRRRIPESMVKKLLDELRKLVEDAREHVERSIRELEKLVKEADDHVRKSIEDLKRLVEEVRETAR

SEQ ID NO: 25186 - protein, 181 aa, Artificial Sequence; identical to SEQ ID NO: 25185
  Synthetic sequence.

SEQ ID NO: 25187 - protein, 181 aa, Artificial Sequence
  Synthetic sequence.
DVEKEIKDVVDKAKRELDRLLREDREVSREVKEALDKLLEDNRRSVERVERELDDLRRRGLDEDEIRKLKDRIKKLLDENKKRVEDLKREIDRLNKENEDELRRLKRELDKILREVERDKIPESVVKEILKRLEKLVEDAKRHVEDSIRKLKKLVDDMRKHSERSNRDLERLVREAREKAR

SEQ ID NO: 25188 - protein, 181 aa, Artificial Sequence; identical to SEQ ID NO: 25187
  Synthetic sequence.

SEQ ID NO: 25189 - protein, 181 aa, Artificial Sequence
  Synthetic sequence.
SVEEEIRKVVEEVKRELDRLLEKNDRSVKEAKKELDRLLEENRRAVEEVKKALDELEKNGLDKDRVRKLKEDIDARLEENERLVRKLKRDLDERLRENEKRLRELKKEVDDLLRRLATEKVPESEAKRLIDRLRELVKRVAEHSERSDRELKKLVDDLREHSKRSNDDLRRLVEEAEREVR

SEQ ID NO: 25190 - protein, 181 aa, Artificial Sequence; identical to SEQ ID NO: 25189
  Synthetic sequence.

SEQ ID NO: 25191 - protein, 181 aa, Artificial Sequence
  Synthetic sequence.
SVEDKVREAVRRAKEALKKLVEDDRRVVKEVEEMLDTLLDKNRDSVRRAKEKLEDLKRKGLDDDTVRKLLEDLKRLLDRNEEEVRRLKEEIRRENKKNEEVVERLEREVKKLLDELERDKVPESDAERLIETLERLVKELEDHVRRSIRKLRELVEEMRDHSRRSDEELKKRLKEVEDRVR

SEQ ID NO: 25192 - protein, 181 aa, Artificial Sequence; identical to SEQ ID NO: 25191
  Synthetic sequence.

SEQ ID NO: 25193 - protein, 181 aa, Artificial Sequence
  Synthetic sequence.
DVEEEIKRVVKKVEEELDKLLEDDERVVREVEEMLDRLLKKNEKVVRDAKRKLDDLRRKGLDEKRIRDLKRELDELLKENERRIRELKKRIRKLHEETRRRLEELKKEARDRLKEVEDRKIPKDVVDKIIETLRRLVKEVAKEVKRSIDELKKTVEEVRKHSEETDRRIEKLAKEAEEEVR

SEQ ID NO: 25194 - protein, 181 aa, Artificial Sequence; identical to SEQ ID NO: 25193
  Synthetic sequence.

SEQ ID NO: 25195 - protein, 181 aa, Artificial Sequence
  Synthetic sequence.
SVEEKIREVVERVRRMLEKLLEDNDRSVKEASKALDDLLRESRRVVEEVKKALDDLRRKGLDDRTVEKLKTEIRKILKDNEDLVRELKKELKRLLEENEKEVRRLEDEIRRIMEEAERRKIPESEVRRIIRELEELVKRATDHVRRSDKRLRELVDELRKHIRKSIEDLKRLVDEARRRKD

SEQ ID NO: 25196 - protein, 181 aa, Artificial Sequence; identical to SEQ ID NO: 25195
  Synthetic sequence.

SEQ ID NO: 25197 - protein, 182 aa, Artificial Sequence
  Synthetic sequence.
DEVEEIRKELEKLLEEVRRKLEKIIKDIRDLLREDKRKSERIDRELEKLLRRLEEIVRDRGPDERVLRDLEEKIKELLDDSRRHADESEKRLRKLLEDARRTLERAKKDIDKLEEEVRRRGLPEEMLREVKRVLEEVRRDIERLLEEIRKVVEEWRKRLEDLKKKNEDSAREVKRRIDELRK

SEQ ID NO: 25198 - protein, 182 aa, Artificial Sequence; identical to SEQ ID NO: 25197
  Synthetic sequence.

SEQ ID NO: 25199 - protein, 182 aa, Artificial Sequence
  Synthetic sequence.
SEVEDIIRRLRELLERHREVSKRINDELRKLLREVEEDSRRLDKEIEDLLRRIREKVTRDGPDDDTLRRVKETLEKLLRESERTIREVKRRIEELLKRSREHSKRVKEEIDKLREEVDRRGLPEDARRRVERVLREVEDTLRKLDKENEDSARRVKEALDRLLKKNEESIRRAEREIDELRR

SEQ ID NO: 25200 - protein, 182 aa, Artificial Sequence; identical to SEQ ID NO: 25199
  Synthetic sequence.

SEQ ID NO: 25201 - protein, 182 aa, Artificial Sequence
  Synthetic sequence.
DDVEELKKEIKKLLDDHKKLSKELNEDIERLLREHRKLSEEIDRRLEKLLKELEELVRREGPVEESLRKAKEDIDRLLEESKRHSEDLRRRLKELLDRSKKHSEEVKERLERLLREVERKGLPKELLDEVERVVREAKKTLDRVDEENKKSIEDAERELERMDRKNEKSVEDVRRTAKELLR

SEQ ID NO: 25202 - protein, 182 aa, Artificial Sequence; identical to SEQ ID NO: 25201
  Synthetic sequence.

SEQ ID NO: 25203 - protein, 182 aa, Artificial Sequence
  Synthetic sequence.
SEAEEIIRRLEELLKKLKKDSDRLDEEIKRLLDENRRNSKDINRRLKKLLDDLRRLVRERGPRRELIKELREKLKKLEDDSRKDIKRVEDELRRLEEESEELIRELKRRLETLKEDVERRGLPEDVLRRVEEALRRAEEDLKRLKEKNDRSLKEWRDTIRELKRENEESLRRVKEEADRLSK

SEQ ID NO: 25204 - protein, 182 aa, Artificial Sequence; identical to SEQ ID NO: 25203
  Synthetic sequence.

SEQ ID NO: 25205 - protein, 182 aa, Artificial Sequence
  Synthetic sequence.
SDVERIIEELERLLEDLERRSKRIDEELKRAADRNRRNVEEIIRRLEDLLRRLEELVRRDGPAREVIRELEEALKRLEKRVDEDVRDVERKATDLARRSDDLARKADKRIKEIEKEVDEAGLDKDVLREVRRVAEKVRRSIKELKERNEKSLRDWKREVDKLLKDIKKVLDEVRKAADDLRK

SEQ ID NO: 25206 - protein, 182 aa, Artificial Sequence; identical to SEQ ID NO: 25205
  Synthetic sequence.

SEQ ID NO: 25207 - protein, 182 aa, Artificial Sequence
  Synthetic sequence.
REVDEIRRRLEKEVERNRRNSKRIDDELKEMADRNRENVKRSIEEIKELLKRLKELVDRDGPDERVIRELEERLRRLDRRLEEDAKRAEEVIDRLRRRSEKDVRDVKEKIKDDEDRVRKRGLPEDVRREVERVLKEWEDDVRRLLRKNEDSLREWREKLKKLVREHREVTKKAEEVLRELLR

SEQ ID NO: 25208 - protein, 182 aa, Artificial Sequence; identical to SEQ ID NO: 25207
  Synthetic sequence.

SEQ ID NO: 25209 - protein, 182 aa, Artificial Sequence
  Synthetic sequence.
KDAEDIIRKLDELLDELAKAAREIIERLRDAARENEENSREINRRLEELLKRLEDAVRRDGPRDEVIKRLEEELKKIKEESERDVRRVEDAAEKLARTVEKLIEDLRRRLKKLDEDVERRGLPEDVKRKVEEVARRVRKAIDDLLRDIKRVLDDWKRKVDKLLEDNRKSLEDVKREAERLRK

SEQ ID NO: 25210 - protein, 182 aa, Artificial Sequence; identical to SEQ ID NO: 25209
  Synthetic sequence.

SEQ ID NO: 25211 - protein, 183 aa, Artificial Sequence
  Synthetic sequence.
SEVERLIKELEDVSRDIKREVTELKRDLKRLAEESKRLVEELEETIRKIVKDIEDTKRRGDDEKTLTELRRKVEEVVRRIEDRVKKSHEKVREVIERIRRRVEELEKRSREKLEEIRKEVKNGDKELVDRVEEALRDHERTLRKVVKEVDKALKDLERDNTELVKRVKKVLDELRRDVEEKAK

SEQ ID NO: 25212 - protein, 183 aa, Artificial Sequence; identical to SEQ ID NO: 25211
  Synthetic sequence.

SEQ ID NO: 25213 - protein, 186 aa, Artificial Sequence
  Synthetic sequence.
DMERKLDTVLEEVRRVVTRAKEANDRVLKDAKRVVEELSDRNRRVLEDAKRVVDELKEKRKDVDELLRRIEETVKELERTARELNKRIEDSLREIAKKHEDLKRRLEEIVKRLAEEIERLKRDLREEDEVVDKLLKKLKETLRRMEKESEELLRETEKILRELEKEVEDHLRTVEKTLEDLRREVE

SEQ ID NO: 25214 - protein, 186 aa, Artificial Sequence; identical to SEQ ID NO: 25213
  Synthetic sequence.

SEQ ID NO: 25215 - protein, 178 aa, Artificial Sequence
  Synthetic sequence.
SEVDKILEDSKRKLEEVEEMVRRLLKKSRDLLEKLERDVERLIRDSERRLEEVARAKRPDELLDKVLKEDKEKVDDLRRKLEEVYRDNEREIRRAEKELEKLLRDDERDLREAERRVKDKDLRRKLKEVHDRSRRVIEKLREELEKVHDEARKVVEKITEKIERAHDKSRRLLEEIKR

SEQ ID NO: 25216 - protein, 178 aa, Artificial Sequence; identical to SEQ ID NO: 25215
  Synthetic sequence.

SEQ ID NO: 25217 - protein, 178 aa, Artificial Sequence
  Synthetic sequence.
SEVDEFVKRSEDLLKKLEEDVRRIVRESERLLEEVERRVRKILRDLEKKLEDAERERREDRDLDRMLREVEEEIRKIEKELDDLLREDKRKLDDAVRKLEEVYRRNEEELRKIEKKVKDKELRDKLEEAHRKVKEKVERLMEDLKRAHDESEKKIRDLKRKLREVLERLRKRVEEIKK

SEQ ID NO: 25218 - protein, 178 aa, Artificial Sequence; identical to SEQ ID NO: 25217
  Synthetic sequence.

SEQ ID NO: 25219 - protein, 181 aa, Artificial Sequence
  Synthetic sequence.
DLEKRLEEAIRENRDTIRRLAKELERVIEDNKRRLEELKKEIKKVIEELERELRRVRKDGRVKERIEEKVEKMVRDVERTLAELEKRSRELVREIEEIIKRLKDSSEKLVREVEKVVEDGTTREIVDELVRRLKKHSDEARKTVEDLRRKSKKSLREAEETVKRLVEEIERLLEEIKETMR

SEQ ID NO: 25220 - protein, 181 aa, Artificial Sequence; identical to SEQ ID NO: 25219
  Synthetic sequence.

SEQ ID NO: 25221 - protein, 183 aa, Artificial Sequence
  Synthetic sequence.
SEVDELVKKIEDSERRIEEKVKRIEDELKESEERIRTKVRELHKENEKLLEEIRRKKKDSDKDKKKVIEEVRRRVEEVRKKNERVLKEMDKHSKEVVKKLREMLDRLRDHSRRLKEEIERLDNKDELRKTLKDALKRHEEVLKRVEERIRRVLKRHEEVLREAEERIRRSLEKLKRDADRVAK

SEQ ID NO: 25222 - protein, 183 aa, Artificial Sequence; identical to SEQ ID NO: 25221
  Synthetic sequence.

SEQ ID NO: 25223 - protein, 183 aa, Artificial Sequence
  Synthetic sequence.
DEVEELVKELRDSLKRIREVAKELHDRNKELLDRIKRLVDELLKEIEKVLKEIEETKKDSDKDKDKVSKEVRERVKEIVKRVRDALRELEKRVRDVIEENKDMLKKLEDHSRRLKEKVDRTDDKEEVRRKLEEAVREHERELERMAREIRKSLEDLKRVLEEVAERIKEVLRRLEKRVKEVED

SEQ ID NO: 25224 - protein, 183 aa, Artificial Sequence; identical to SEQ ID NO: 25223
  Synthetic sequence.

SEQ ID NO: 25225 - protein, 183 aa, Artificial Sequence
  Synthetic sequence.
DEVEELVERLRRSLEKIRDRVRRLLERIKRLAEKIKRDIERLHKKNEDLAREMRKSERKSDKDRKEVLDRLRRRVEEVKKENKEVLEKAERDVKRIADEIKKVLDDLRKHSRDLEEEVRRLDGKEELRKKLRKVVEDHKRVLEEVKDRLTKVLRELEEVLEKVKRDIKKSLEDLEKVLRELEK

SEQ ID NO: 25226 - protein, 183 aa, Artificial Sequence; identical to SEQ ID NO: 25225
  Synthetic sequence.

SEQ ID NO: 25227 - protein, 183 aa, Artificial Sequence
  Synthetic sequence.
SDVERLLTKLKEVAKDLARIVKRLDEENEKLSEKAEREIRKLDRDNERLLEELEERKRRSDKDKEEVTRRAREEVKRVEEENKEMTDRLRRESDELRKKNEEALKRMEERVRRLEEEVERRNGEDRLRKKLKEVLDDLRRVLEELKDHIRRSLDKNRRSLEELEEHIRRSLTELRRRLEELAK

SEQ ID NO: 25228 - protein, 183 aa, Artificial Sequence; identical to SEQ ID NO: 25227
  Synthetic sequence.

SEQ ID NO: 25229 - protein, 183 aa, Artificial Sequence
  Synthetic sequence.
DEVRELLERIEDEIRRIREEIKKLDEDNKKLAEDIRRKIEELDKENKELLKRIEDKKRESDKDKEEVTRRVRKEVEEVEKKNKDVLRDLKRKVEDAERRNEEVLRRLEERVRELEERIARLDGDDEVRDRLRTILKKLREMLKEVKDRIDDSLRRLREVLDEVAKHIERSLKELKDRVREVEK

SEQ ID NO: 25230 - protein, 183 aa, Artificial Sequence; identical to SEQ ID NO: 25229
  Synthetic sequence.

SEQ ID NO: 25231 - protein, 178 aa, Artificial Sequence
  Synthetic sequence.
SDKEEIKKVVDDVRRDIRRLEKELRDLNERFRKRVEELKKRLEEVNDRARREVERLKSRITDERLRRRLDEVLKRDEDKSDKLRKELDELLEEVNRRTRTLEKRLRDLLDEIEKVSRRDLEDVDTLKRRLEDVLRKAREEVEKWKEDLERLLREAERRVREYEEDTRRLLKELEDETR

SEQ ID NO: 25232 - protein, 178 aa, Artificial Sequence; identical to SEQ ID NO: 25231
  Synthetic sequence.

SEQ ID NO: 25233 - protein, 182 aa, Artificial Sequence
  Synthetic sequence.
NVEDEVRRVVTELEKTLREVLKRSKEALDRLRETLERLLKELEDVHREANEDLTRLEREDERLLRRLKELKEESKKILDDLEEILRRILERVKEIHRRNREFLERIREEVRELLRELRRNNVPESVVKRLVRELERLLREVEKHLEDSKRELEDLLRRLRERLEELKKRHEDLLREAREETR

SEQ ID NO: 25234 - protein, 182 aa, Artificial Sequence; identical to SEQ ID NO: 25233
  Synthetic sequence.

SEQ ID NO: 25235 - protein, 182 aa, Artificial Sequence
  Synthetic sequence.
SLEETIEEVVRRNKETLDRARKKSEDVLRELERVLRELKRRTDEVARKLKEELDKLDREDEDLKRKIKRIEERLRELLETNRRMLERILEEAEKIHRRNERRLRELKKRTEKLLRDLKRDQVPEDVVRRLLEELERLSRDLERHVKRSEEEARDLLRKAREHVERSVKEIEDLLEDLKREAT

SEQ ID NO: 25236 - protein, 182 aa, Artificial Sequence; identical to SEQ ID NO: 25235
  Synthetic sequence.

SEQ ID NO: 25237 - protein, 182 aa, Artificial Sequence
  Synthetic sequence.
SLEETVRKAVRRNRETLRRLKRESEEAVKEAKEVLDRLREETERVLRKLEKRLRELRREDEELERLIEEIRRRLEELLKENEDLLKKIDDEVKKLLRENEDALRKLLEETERLVREAETKKLPKSMVDELLRTLEKLSDEIRRHVEKSKEDLERLLRELKKHVKRSVEEIEKLLEKLDKEAN

SEQ ID NO: 25238 - protein, 182 aa, Artificial Sequence; identical to SEQ ID NO: 25237
  Synthetic sequence.

SEQ ID NO: 25239 - protein, 180 aa, Artificial Sequence
  Synthetic sequence.
SEVDEILKRIKEVLKRNKENVERIKKRIKEELDRNRKNVERILRTIEKLLKELEDIARREGPRREVAERLRRELEKLLRDVEEDLRRVDERAEELKREVDEDLRRSEEEIRKLEEDVRGNDEELRKKVKEVMDRWRETLDRLREEVERVLEDWRRKLEELRRRVEKVLRDAERVIKKVEE

SEQ ID NO: 25240 - protein, 180 aa, Artificial Sequence; identical to SEQ ID NO: 25239
  Synthetic sequence.

SEQ ID NO: 25241 - protein, 174 aa, Artificial Sequence
  Synthetic sequence.
SEREEIERVLDENRRSLEELEREVEDALRTWEEELKKVEEAVRKVLEDVRRELEKDLKDAKELVKRVEKILRELEEEVREDKRRSKEAADKLRREVEKASEDNKRELDRLREALDRAEVEKIKTEVDDLSRKLRETVERLKTELKKVIDRNRKTLEDLERRARKLIKEARDAAK

SEQ ID NO: 25242 - protein, 174 aa, Artificial Sequence; identical to SEQ ID NO: 25241
  Synthetic sequence.

SEQ ID NO: 25243 - protein, 174 aa, Artificial Sequence
  Synthetic sequence.
REREKIEDLLRRNEKSLRDVARAVERILEEWRKVVEDLTERNKELLKEVEKVVRELLKDDKDLLRRIKEMLDRSREKTKRDKERSKEVADKLRDELRRLVKENRDRLRDLRRLLERLDVDEIAKELKRLSDKLREMLKRLTDKAKRLIERNEKTSRDNERELRKLIKEAEDAAT

SEQ ID NO: 25244 - protein, 174 aa, Artificial Sequence; identical to SEQ ID NO: 25243
  Synthetic sequence.

SEQ ID NO: 25245 - protein, 176 aa, Artificial Sequence
  Synthetic sequence.
SKEERLERLIEENKKSLDELSKRVEEVIKENKDVLKRLKEKIERLIEKNRRELERLKKDVDEDKARRLEESSERLETRARKIVEDMKKTSDELSEELKRVVEEMERSSRDLEREAKEREAREELERELRDHSRRLKEIVERIERKVREHIRELEKIVKEVEREVEEHIEKLERTVR

SEQ ID NO: 25246 - protein, 176 aa, Artificial Sequence; identical to SEQ ID NO: 25245
  Synthetic sequence.

SEQ ID NO: 25247 - protein, 176 aa, Artificial Sequence
  Synthetic sequence.
SDEDRLRELLKKNRESLKRLSDEIRRLIEENRDALRRVKETIKELLRKLKEVVERVRKDVDDDKVREIKKEVDKIEDKVRKILEEMERTSRELEKRLRKLLKEMDESSRRLADELRKRKADEEVRKTLEEHSRDLRRKVEELAREVKRHIRELEKILKEVKDEIEEVIRRIEETAR

SEQ ID NO: 25248 - protein, 176 aa, Artificial Sequence; identical to SEQ ID NO: 25247
  Synthetic sequence.

SEQ ID NO: 25249 - protein, 185 aa, Artificial Sequence
  Synthetic sequence.
SEIEDAAEKVRRNSEEAKRILDEHRERVKRVLEEIERLVKRAEERIEELIRTIERLRKDGRPTEDLAREIKRIVDEVRKALEEIKKRIEDLLREAEEHSKKVKKDLDRSNEELARTAEELKKRITDEEVRKKLEDILRKNEETSREIKKRLDRIDDDLRRVLEKAAKRLRDLLEKLREAVRRVET

SEQ ID NO: 25250 - protein, 185 aa, Artificial Sequence; identical to SEQ ID NO: 25249
  Synthetic sequence.

SEQ ID NO: 25251 - protein, 185 aa, Artificial Sequence
  Synthetic sequence.
SEIEKVKKEVEENSREAKRIVDEHKRLVEENSKEMEKLLKEAEDTIRKLLKEIKELKDRGLPKEELAREIRDILRRVEEKLRDIERRLDESNERLRRHSEKVKRDLDRSNEELEKRVRELEKRITDERMREKLRRALEENRRTSERLKRKLDDIDRDNERTSREVKEKLKRILEELKRTLEEVER

SEQ ID NO: 25252 - protein, 185 aa, Artificial Sequence; identical to SEQ ID NO: 25251
  Synthetic sequence.

SEQ ID NO: 25253 - protein, 185 aa, Artificial Sequence
  Synthetic sequence.
SEIDKARDEVRKNSDEMRKIIERHREKVEDNSRRMKETVRRVEEEIERIIREIEELKKRGLPKEELRRRIEELVKEVEDRSEEHKRDLDRSNEELRRHSEEVKRRLDESNKRLDDKLRELERRITDRRLREELRRIAEENKKTSDDLKKRLDRIDKENERTSEELKEENDRLLEKLRRAADRVKR

SEQ ID NO: 25254 - protein, 185 aa, Artificial Sequence; identical to SEQ ID NO: 25253
  Synthetic sequence.

SEQ ID NO: 25255 - protein, 185 aa, Artificial Sequence
  Synthetic sequence.
REIEEFEKDVRRNSEDMERIAREHEKLVRDLLRELKRLVDDLKRRLEELAEEIKSLREQGLPREELTKRIKEIVDKVRRELEELKKRIDDLLREARKHSEDVKRRLDKSNEDLERKLRELEKRITDERLRERLKRILDKNKETSDRIKKRLEDLNRELERVARELKKTIDELLRELEEVVERVRK

SEQ ID NO: 25256 - protein, 185 aa, Artificial Sequence; identical to SEQ ID NO: 25255
  Synthetic sequence.

SEQ ID NO: 25257 - protein, 185 aa, Artificial Sequence
  Synthetic sequence.
SLEEEVKKLLEELKKVADKLTKEVREADKKLEEVLRRVKRRLDEVDRRLEEEIKKVKSRITDERLRRRLDELLERVREHSKRLKERLDKILEDVNRRTKEMEERLRRIVKEVEELVEEVKRRKSDREELLERLKRRIDRLIEEARRLVEKWRDELKKLIDEVRKLVEDHERKVRDIEKKVRDESR

SEQ ID NO: 25258 - protein, 185 aa, Artificial Sequence; identical to SEQ ID NO: 25257
  Synthetic sequence.

SEQ ID NO: 25259 - protein, 181 aa, Artificial Sequence
  Synthetic sequence.
DAEEKARRVLEELDEALKRLAKKIKESIDKLKDVLRKLAEIIKRSLDELDEVLKRLASKLDKKDLDRIREELEKLKEDNKRDLDKIARELEELVRRNEDKLREIARDLERLKEELKRVLDRDGGVGEEILEELRRALEELKREVDELDRRNEEALERLKERVKRLNEDNRRTLERLEREVD

SEQ ID NO: 25260 - protein, 181 aa, Artificial Sequence; identical to SEQ ID NO: 25259
  Synthetic sequence.

SEQ ID NO: 25261 - protein, 184 aa, Artificial Sequence
  Synthetic sequence.
DVEELLRRLLEELRRVVKEVEDINRRSLEEARRVLKRLEDDHRRVLKELEDVLERLRRQGLPEDVVRTLTREIREMAEKHKKLLERIREAVKRSEEEHKRHTDDVRRTLETIERELEKVERRGVSRETIEELLRKVDRDLKRIRTTSEDLVRKNEELLEKLERESRRVVEESRKRLKEAEERTR

SEQ ID NO: 25262 - protein, 184 aa, Artificial Sequence; identical to SEQ ID NO: 25261
  Synthetic sequence.

SEQ ID NO: 25263 - protein, 184 aa, Artificial Sequence
  Synthetic sequence.
SVEEKLKDLEKENKDSLDEIRKLNEDSLEEAKRVLKKLEDTHRTVLRKLEKVLDELRKRGVPREDVERLKKIMEDAARKHKELLDDLRRKVKESEDRHRDHTRRVEEKSKELRRELEDVRRRGEDDDAIRKLRKKVEDTSRDLKRTSDDLVRRNRKLLKELEEESRKVVKESDEILRKMKEEVR

SEQ ID NO: 25264 - protein, 184 aa, Artificial Sequence; identical to SEQ ID NO: 25263
  Synthetic sequence.

SEQ ID NO: 25265 - protein, 184 aa, Artificial Sequence
  Synthetic sequence.
SVEEKLDELEKRIKEVLERIERINEESLRRAEEVLRDLEETNRRALERVRDVLRRLEERGVPEKDVDKLRRIVEKLERDHRDLIRRLRELVKRSKERHEEHTERVRRTIKRIREELEDIKRKGVDDDAIRKLLETVDRRLKELTETSKRLVEENRDLLRRAKEESKRLVDESEKVLEEMDRETR

SEQ ID NO: 25266 - protein, 184 aa, Artificial Sequence; identical to SEQ ID NO: 25265
  Synthetic sequence.

SEQ ID NO: 25267 - protein, 184 aa, Artificial Sequence
  Synthetic sequence.
SADETLEELEKELRRVVDEVRRTNEEANKRLREVLRKLEKKNDDVLRDLERVLKELEDRGVPEEVVRRLRKIVEDLKREHEKLIKKLREEIKRIIDDSRRHIRDVERILEKIRKELKDIRDKGVSEETIKKLREDVKRELDRIKTSSKKLVDDIERRLRRMEEESRKLAEDSRRILEEMRKEVT

SEQ ID NO: 25268 - protein, 184 aa, Artificial Sequence; identical to SEQ ID NO: 25267
  Synthetic sequence.

SEQ ID NO: 25269 - protein, 175 aa, Artificial Sequence
  Synthetic sequence.
SEVEKLVDEIKKELKRLRETSKKLLDEIRELLERLKRSSKKLVDDIKRILEELKRRNLPREDVERLLREIRKRVEEHKKRLREALERVERRVRDHNRELRRVLEEVERKVREIEKRGVDKDKLEKALRDARKVVEDIERTNREILKRVRDMVERIREDNDTVLEEVERMAEEVRK

SEQ ID NO: 25270 - protein, 175 aa, Artificial Sequence; identical to SEQ ID NO: 25269
  Synthetic sequence.

SEQ ID NO: 25271 - protein, 185 aa, Artificial Sequence
  Synthetic sequence.
REIEELKKKVEKVLRELRKSSEEMKRRVEDLIRRLKKSSKDLERKVKDLLKKAEEKVRRDGTTDELKRRLEKEARDLERELRKHDEDVERKVRKLKEELKRHNEEVEDIIRRVEEELKRVADKIDDEEARRRLEEVVRRLRKVLDDVRKINKEVVDRLKKALDEVKRTNEDVVRDLRKVLEELKT

SEQ ID NO: 25272 - protein, 185 aa, Artificial Sequence; identical to SEQ ID NO: 25271
  Synthetic sequence.

SEQ ID NO: 25273 - protein, 177 aa, Artificial Sequence
  Synthetic sequence.
SEIEKLKEEIRRLLEEIKRHAEENKRRVETALRDIERHVEENTRRVAKVEEEIKKLKDRVRREELDEILKRVKDHLEEAKRRIKEILRRVEEHVKRSKRRIDELLRRLKEKVARIKEAGVDKDELDKVEEEAKRVAEEVKEIHDRVLEEVRRVVDRVLKAHDEVLRRLERVVREVKR

SEQ ID NO: 25274 - protein, 177 aa, Artificial Sequence; identical to SEQ ID NO: 25273
  Synthetic sequence.

SEQ ID NO: 25275 - protein, 177 aa, Artificial Sequence
  Synthetic sequence.
EEEKRLRELEKRNEDVIRKAAEDVREILRKNEEVLKEAEDRIKRLIDEDRRVLEEVKRDDSRDDKLRKVTEESKKLVRETERVLEELKDSSRKLKEELKKLLDELRDSSEKLKDDLRKRRVDEELEREVRKHDKEVKEVIDRLREKSERHIREIERIVDELRKKHEATVRKLKKDVK

SEQ ID NO: 25276 - protein, 177 aa, Artificial Sequence; identical to SEQ ID NO: 25275
  Synthetic sequence.

SEQ ID NO: 25277 - protein, 177 aa, Artificial Sequence
  Synthetic sequence.
DEDETLRELEKKNDKALDDARRTIEEVIRRNEEVLKRAAEEIEKLERKNKRVLEEVKRRDSRDDVLRKIEDSSRKLKEDLRRVLEDLKRTSEELKRKLREVLKRLEDSSRRLKDELRKRRVTEELAEEVKRHDDRVRKEIEKLKREVEKHDREVKETIDRLAKKVDDHLKELRDTTR

SEQ ID NO: 25278 - protein, 177 aa, Artificial Sequence; identical to SEQ ID NO: 25277
  Synthetic sequence.

SEQ ID NO: 25279 - protein, 189 aa, Artificial Sequence
  Synthetic sequence.
DEIKEIEETVERLVEELKRIVEEWREESKRNVDELEKRIRDIKRRIDEAIKTLEELKRRGLPKEELSERIKRILEKLKREIDKVKEEVRRSHKDLDRKSKEIETRIRKLLEDLERKIREAKKRMKDDSRVEELRRALDELLEKARKVVEEVEKMIKEVNDRNKKVVDELKRTLDKILKDLEEVAREVDR

SEQ ID NO: 25280 - protein, 189 aa, Artificial Sequence; identical to SEQ ID NO: 25279
  Synthetic sequence.

SEQ ID NO: 25281 - protein, 189 aa, Artificial Sequence
  Synthetic sequence.
SEIEKMKRDSDENIKRMEEIARKWEKESRDNIREIEKRVEDLKRRIEKVIREIEKLRRDGRPDEDLKRKLDDDLRKLKEEVEKLKEDLRRSHEDLDRRSKEIKREIRESHRKVEEDIRRIEEELRDDKDLEEAKRKLEEVLDKNRRVVEKVERRIDRINDRNREVLERAEKELDDILRKLEEVVRRAEK

SEQ ID NO: 25282 - protein, 189 aa, Artificial Sequence; identical to SEQ ID NO: 25281
  Synthetic sequence.

SEQ ID NO: 25283 - protein, 182 aa, Artificial Sequence
  Synthetic sequence.
DEIREAKKRLDDIVTELRDHIRRSKERHERLVKELERHIRELEKKVRELIKRLDDAVRRDGKVDEELLRRLRETAKRDAENVEDVNRRLEEELKKNKEDVDRMNDTLRKRLEEIAKEVSRMDKEEVKREITRLLEDLKRVSREHREEIRKLLETTREVSKRHREKVEDLLRKLEEVLERVRT

SEQ ID NO: 25284 - protein, 182 aa, Artificial Sequence; identical to SEQ ID NO: 25283
  Synthetic sequence.

SEQ ID NO: 25285 - protein, 182 aa, Artificial Sequence
  Synthetic sequence.
SELEEIARLAEEIERKLRESLRESDKMHKKLNKENEDLLEKIRKEVEDIIKKLRDLKGTSEKILKDLAKEVEDVIRKIEELVKDAERRNREALERDRRKNEELRREVRKVIEDIKERVRRVRDERVEEAVRRVVEKIKDVVEKHSDASRRLNEELKESVDRLRREVEKLVEKIRKVVEDLRK

SEQ ID NO: 25286 - protein, 182 aa, Artificial Sequence; identical to SEQ ID NO: 25285
  Synthetic sequence.

SEQ ID NO: 25287 - protein, 185 aa, Artificial Sequence
  Synthetic sequence.
SDLERVEKESRDHIDTLRRIVERVEEHVRRSIKTLDELVDRARRSVERLIEELEEMKRKDKDKEKMTRKIEKLLKDAEDEIRKLKKEIRELHKRNEDEVRRVKEEIRKSLKEVEDRIKEIRDKTTDRRVEEELRRLLEENRRVVEEVEKELDRLLKESEDAVRRVEEALDRLLKELERVAKEVKD

SEQ ID NO: 25288 - protein, 185 aa, Artificial Sequence; identical to SEQ ID NO: 25287
  Synthetic sequence.

SEQ ID NO: 25289 - protein, 185 aa, Artificial Sequence
  Synthetic sequence.
SDLEKVKKDSDDHIRELERLVRRAEEHVRDSVRRLREIVEELDRDVRRLIEELKDLKRKIRDKEKLIRTIRRLLEELERKVREIKKRIREENEKNEREIRKLKEEIRRSLEEVERRLREIKKKTTDEDVKKKLDDLLRENREAVKRVERALDKLLTDDRRVVEEVERALDELLKRIEKVAREVEK

SEQ ID NO: 25290 - protein, 185 aa, Artificial Sequence; identical to SEQ ID NO: 25289
  Synthetic sequence.

SEQ ID NO: 25291 - protein, 185 aa, Artificial Sequence
  Synthetic sequence.
RDVDELRKESEDHIRELRKLVEDVRRHVKRTNDDLERLVKEVDDTLKELIKEVKELKRRVTDKEELVRRLEKLLRDLEKKARELKEEVKRLLERNRETLEKLERELKKSLDELEKRADDIRRKTTDEDVKKKIKDLLDTNREVVERVLRTLRDLLRRNKEVIDRILETLDELLERVKREIEKDAK

SEQ ID NO: 25292 - protein, 185 aa, Artificial Sequence; identical to SEQ ID NO: 25291
  Synthetic sequence.

SEQ ID NO: 25293 - protein, 185 aa, Artificial Sequence
  Synthetic sequence.
DDAERAKEESERHIKRLKDLVEELRKHSERTDEEIKELLRRLEKTVRDLIRELERLKEEIKDKDTVTRRIDKLLRDLEEKVRDLKRRLKKLLEDNKARVDELREDIKRSLEELERRVREIKEKTTDEDVKRKLDKLLKENEDVVREVDRALKELLRKNAEMLERAKERLDRLLEEVKKVADEVRR

SEQ ID NO: 25294 - protein, 185 aa, Artificial Sequence; identical to SEQ ID NO: 25293
  Synthetic sequence.

SEQ ID NO: 25295 - protein, 182 aa, Artificial Sequence
  Synthetic sequence.
SIEEELERLLRKNEDSLRRVRDEIRRLEEEIRRVLKKWRDEARKLLREIERVLKEVAERKGKREELDEILERVERDIEKSERDLRRLEEEVKKLVTDIEKAIKDIEDESRKAIEEVRRKRSTDETLLRDLERKSKEVDERLEELLRRAKERVEELIREIEALLDRNRRNVERLIRELERRTD

SEQ ID NO: 25296 - protein, 182 aa, Artificial Sequence; identical to SEQ ID NO: 25295
  Synthetic sequence.

SEQ ID NO: 25297 - protein, 179 aa, Artificial Sequence
  Synthetic sequence.
EELERLLEDVKRTLKELRDRAKEVLDRVRKTLEELKRELKRVLDEVTELLERLRRIVKREGKVEETLKRVEEELRRLAEEVKRLNEEHRRKLERLAREVRKLNEEHRRRLEELTKRAEDKGLDKRIIKEARERVETVNRETKKILEEIARTVEKVDEESRRILEKVKRDAERVLREIKK

SEQ ID NO: 25298 - protein, 179 aa, Artificial Sequence; identical to SEQ ID NO: 25297
  Synthetic sequence.

SEQ ID NO: 25299 - protein, 180 aa, Artificial Sequence
  Synthetic sequence.
DELEEVEKEVKRILEESRRLLEELEREVRELLERSKRILEELEEEVRRLLEKLKRVRTRGEKDLEELIKTEVRRLEKKIKDLLDKDREMLKRATERLEKVYRENRELIERVKRKLDDLARRKRKDEELERLKRELDKVHEEVREKVERAKRELERVHKRSEEEARRLKEEVDKVLDELRK

SEQ ID NO: 25300 - protein, 180 aa, Artificial Sequence; identical to SEQ ID NO: 25299
  Synthetic sequence.

SEQ ID NO: 25301 - protein, 186 aa, Artificial Sequence
  Synthetic sequence.
SELDELRKRVEEIVEENDRVLRELEKRVRELSERNKKTLKELTKRVREILERLKELKDRGEDKDTLDKAIRRVEEEVKELVERVTRHDEESKKEVRKLVDEARKHLEESKKRVDDLKRKVEKRLGQLEEVKEVVRRLEEKVKESLDRAEKVLRRLEREARESNRRHEEEVRRLKEEIDRVVTELRR

SEQ ID NO: 25302 - protein, 186 aa, Artificial Sequence; identical to SEQ ID NO: 25301
  Synthetic sequence.

SEQ ID NO: 25303 - protein, 186 aa, Artificial Sequence
  Synthetic sequence.
SLEDVLREVEERIRKSLEEHRKVTDEAEKELRRIVEDHKRVLEEVKKEIEDVIKELKKESVDEEEVRKLVRELREALKRLEKHSKDLEEEVKRVVEEMRKRSKELKERNDKVLDELRKKVKDSDDEKEKVAREIRETVKKLHEDNRRMSEEIKKTVERLLDKLRRSLERIRREAKDLVRKIEDLRR

SEQ ID NO: 25304 - protein, 186 aa, Artificial Sequence; identical to SEQ ID NO: 25303
  Synthetic sequence.

SEQ ID NO: 25305 - protein, 186 aa, Artificial Sequence
  Synthetic sequence.
KLEEVLRKVAEDIKRSLEDLKRVLKEVADHIRRSLEELRRVLERVKKEIEDVLRELENSELDKRAVDKIVKEVKEALDELEEAVRRVAKENEDALRKLAKDVEDVARRNKEAVDRARERVDKSDDDADKVAEDIRRDVRRLDEENRELAERIKRAIEELDRKNKDLARRIEDAVRRLLEKIKEAVR

SEQ ID NO: 25306 - protein, 186 aa, Artificial Sequence; identical to SEQ ID NO: 25305
  Synthetic sequence.

SEQ ID NO: 25307 - protein, 186 aa, Artificial Sequence
  Synthetic sequence.
DLEEVLKEVEKRIRDSLKDLKRVLDEVLDHIRRSLKENRDSLRKLEEDLRRVLEELRRTDLDERVVKKIEDEIDKVVKRMEKVSRDLEEDNRRVLEELEEEVRRVMKENKDVLDRLRDEVTRSDDDEKKVAEKIRKEVKELDEKNKELARRIRDVAKKLDERNKDVSRRLAEEVERLLRKIKEKVR

SEQ ID NO: 25308 - protein, 186 aa, Artificial Sequence; identical to SEQ ID NO: 25307
  Synthetic sequence.

SEQ ID NO: 25309 - protein, 186 aa, Artificial Sequence
  Synthetic sequence.
DLERVLEKVARDIEESLRRNKESLKRLKEHVEESLKENRKSLEDLRKKLKDVLDELKKTELDESEVKEIEERVKKVEEDLERKSKKLEDENRKAVDELRKLSEDLERKNRKVLKELKDEVKDSDDEKKKVADKIREEAKRLDKENREASDRARDVVRRLDEKNKKLSEEMKRTVERLLETLDRKMR

SEQ ID NO: 25310 - protein, 186 aa, Artificial Sequence; identical to SEQ ID NO: 25309
  Synthetic sequence.

SEQ ID NO: 25311 - protein, 186 aa, Artificial Sequence
  Synthetic sequence.
DLERFLEEVARKIEKSLEELRRVLEEVRDRIRRSLEENTKSLERLTEEVRRVLERLKDTDLDKKEVEDIEREVRRVERTMRELSKKARRDNTEMLRDLARKVDEVEKENKRVLERLREKVKDSDDDEDKVAKEIEDEVRRLDEKNRKLAKEIRDEIRKLDKENKDLSKELRDRVEELLRKIEETVR

SEQ ID NO: 25312 - protein, 186 aa, Artificial Sequence; identical to SEQ ID NO: 25311
  Synthetic sequence.

SEQ ID NO: 25313 - protein, 178 aa, Artificial Sequence
  Synthetic sequence.
KAAEEIRKKVEDYKRESEKILEEVEDHSRRSKETLKRLLDDLRRAVEELKRRLEELKRRPRTEEIAKRAEEAVRRAAERIKKVIDDVERHIRENAKELKRLLEEDREASRRLEDEIDKEVKAREVADELKKRLKRANEESERVLRELAERNKTALEEAERVLRRLKEEIEKVLRKLKK

SEQ ID NO: 25314 - protein, 178 aa, Artificial Sequence; identical to SEQ ID NO: 25313
  Synthetic sequence.

SEQ ID NO: 25315 - protein, 182 aa, Artificial Sequence
  Synthetic sequence.
SEVEDLRRRVEEIKRRVEEILRENKEVSEKSIRELERLLEELKRLVDELLKRLEELKREGRDKKEELKKLLEDAERLLRKVEEEIERLKRESEDHLRRSNEEVDELVKRMEELLKEIEKRSRDDDLRRALKDVVDEVKKVVDELREENDRLRKENKRAVDEVRKELERLLRDVERVIRRAEK

SEQ ID NO: 25316 - protein, 182 aa, Artificial Sequence; identical to SEQ ID NO: 25315
  Synthetic sequence.

SEQ ID NO: 25317 - protein, 182 aa, Artificial Sequence
  Synthetic sequence.
EELDRLRRHADESRKRAEEILKRNEEEIRRLVEELKRILKTNEDVLRDLEKKLEDLKRRGERREEDLRKLLEDAKKHLTDSNKRLEELKERIERHLRRSNKELEDILETNRETLKELEKRSRDDKLRTTIDEVRRRSKKVLDDLRDRNRRLLEEVDRAIKEVRETNEELLRRLKRVIDEVRR

SEQ ID NO: 25318 - protein, 182 aa, Artificial Sequence; identical to SEQ ID NO: 25317
  Synthetic sequence.

SEQ ID NO: 25319 - protein, 185 aa, Artificial Sequence
  Synthetic sequence.
SAEELLRTIEKRIEDNHRRLEEILEEIARLIEDMLRTDERIVREIKELLKEVLDRVRRAGVPEEVLERVRRELERLKKELEELRRRSEEKVKELKRRLEEIRRKLEEEHRDLRRKLEELRRDLGDKEEVVKKLVEDVERELERSLREAEDLLRRVEEVIRTSKKESKDVLEKIERLLRDLERRTR

SEQ ID NO: 25320 - protein, 185 aa, Artificial Sequence; identical to SEQ ID NO: 25319
  Synthetic sequence.

SEQ ID NO: 25321 - protein, 180 aa, Artificial Sequence
  Synthetic sequence.
SVAEELKKEVDDLLRDLKKKLDDVRRDHERLLRELEEHLERSRERVERLLRTLEDVARKGRVEEELLKELKKRIDEIAKENRDLLKELEERSRDTLRKLRETLKKLKKRVDDLIRKVEEEKKIDRKVIEKIERDIRKILKEVEEVLRTLKKKSDEILERAKRVTEKIERDVTEILERIKK

SEQ ID NO: 25322 - protein, 180 aa, Artificial Sequence; identical to SEQ ID NO: 25321
  Synthetic sequence.

SEQ ID NO: 25323 - protein, 180 aa, Artificial Sequence
  Synthetic sequence.
SVADELRKTAEELLKRLREHLDTSRRRVEDLLRRNEKKLRDVLREVKKLLDELRELKERGRVDDEVLKELKKRVDDLIRELEETNRKTREDIRRILEENRKLLEDLRDEIRKLEEKVRRDNKAPEDVIREIKDRVRRILDEARRVSEKLRRDVEKINRESREVLERIKELIKRILKEAKD

SEQ ID NO: 25324 - protein, 180 aa, Artificial Sequence; identical to SEQ ID NO: 25323
  Synthetic sequence.

SEQ ID NO: 25325 - protein, 178 aa, Artificial Sequence
  Synthetic sequence.
SELEELLREVDDSLKKLETEAKKLLDEVRDSLRKLEETLRRVLREVEEELKELEKENSKDDRTLERVKEMLDRVAKRIKDMNREHRKKVKELEDRVRELNKRHRDKLEELAREVSKNSDKRVEDVLREIRRRAREINERLKKILKEAKEVAEKVNEETRRVLKEIKELIERVLRELRK

SEQ ID NO: 25326 - protein, 178 aa, Artificial Sequence; identical to SEQ ID NO: 25325
  Synthetic sequence.

SEQ ID NO: 25327 - protein, 176 aa, Artificial Sequence
  Synthetic sequence.
REAEEAKEEVEELNRRNKKELDDARRRVDELDKRNKDRLKESSDRVKRLVEELERVKEEGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 25328 - protein, 176 aa, Artificial Sequence; identical to SEQ ID NO: 25327
  Synthetic sequence.

SEQ ID NO: 25329 - protein, 179 aa, Artificial Sequence
  Synthetic sequence.
DEAEKAKRDSEKVVEDNRKMLEDSTRRAERLNEENKKELKKSTEEAEKILREIDETKRRGTDDEVVKDLIRRVEELLERSRKKLEDLTRDNERVLDESRRRLEKLIRDNERIVKDLTDRVVRVDEVLKRLKEEHRRLIEELEEVLRRNEEIIRRSIEDLERVLDRNRRELEDVIRRLKE

SEQ ID NO: 25330 - protein, 179 aa, Artificial Sequence; identical to SEQ ID NO: 25329
  Synthetic sequence.

SEQ ID NO: 25331 - protein, 179 aa, Artificial Sequence
  Synthetic sequence.
REAEEVERKVEELNRRNRKVLDDARKESEEVVRRNREFLRRLEERVRTILRELDKRKRDGTSEEVIKRLIDRVRKILEDIRRLVDELIKRNERIVEKLTRIVEELIRRNKKLLEDIRRELVKVDEVLRRLAEDIERSIRELEKVLRELERIHRELIKELKEVLKRLEKDAKEVIERLRT

SEQ ID NO: 25332 - protein, 179 aa, Artificial Sequence; identical to SEQ ID NO: 25331
  Synthetic sequence.

SEQ ID NO: 25333 - protein, 186 aa, Artificial Sequence
  Synthetic sequence.
SLAEEIDKTIRELAKRHEKTVEDIKKIITELEKKHRDTAEELERIVREIEKKIRELKKRLKDDKDKLRELKDELRRILEDAARKSKRVVEETEEVNREINKRSEEVVRDTERVLRKIADDLRRRIRREELERVLREAEETLRRLIEKDEKVNREADEKSERLIREDEKVLEDVAREVERLLRELDK

SEQ ID NO: 25334 - protein, 186 aa, Artificial Sequence; identical to SEQ ID NO: 25333
  Synthetic sequence.

SEQ ID NO: 25335 - protein, 186 aa, Artificial Sequence
  Synthetic sequence.
DEDREARELVERLREEHRRTAEEIKKIIEDLERKHRETMERLKRIIEKIERDIRRLKRDLKDDKEMVERLKKKIKDILKKLAEESKKVVEETEKVNEDINRKSKEVIDRSRKLLEDLRRKLEERSRDKELERVLEKVARDLKKLVDDDRRVNETANRRSRKLIEDDKRVLEEAAKEVKRLLDELDK

SEQ ID NO: 25336 - protein, 186 aa, Artificial Sequence; identical to SEQ ID NO: 25335
  Synthetic sequence.

SEQ ID NO: 25337 - protein, 171 aa, Artificial Sequence
  Synthetic sequence.
DTERTVKEKIRKWKEDVERVERRLEELVDRARKLSKENVDRMRELVRRLEDRVRKDPDKDKLRKEVERLERRIEESHREVKELVERIKKEIKELVDELHRRSEDIKRDLEEKVRVREVLEDARRKIDELNERVERVAETVRRKLDKILEDNKRVVERVKEEIRRVLEELER

SEQ ID NO: 25338 - protein, 171 aa, Artificial Sequence; identical to SEQ ID NO: 25337
  Synthetic sequence.

SEQ ID NO: 25339 - protein, 174 aa, Artificial Sequence
  Synthetic sequence.
SEEEVLREAAKTVEKLLDEIRRSLEKVSKRVEDSNRELKESLDRVRERVRELLEELRKNNVDRTLLEDVRRKLERIEERNEEMNDRSRRKLEELRERNRKILEDIRRTLEDLKRRQLPKDDVERTLREIAKLVDEVDKENKRALRENEERVKTLNRENEEMLKRIEEEVRRATK

SEQ ID NO: 25340 - protein, 174 aa, Artificial Sequence; identical to SEQ ID NO: 25339
  Synthetic sequence.

SEQ ID NO: 25341 - protein, 185 aa, Artificial Sequence
  Synthetic sequence.
DLEEVAKEVKKALDELLKRNEDSARRVKEAIRELLKRINDVTREVEETLDRLLKEVEDGGVPEEDLKRAEDEVRRLKEDLKRRDERLERAARTLEREIDKLLDENRRKVERLKEEIDDLARKGQPAERVVKRLEELLREAAEHSKRSNDELERLLDRLRREVERYERELEKRKKEAKELADKLRK

SEQ ID NO: 25342 - protein, 185 aa, Artificial Sequence; identical to SEQ ID NO: 25341
  Synthetic sequence.

SEQ ID NO: 25343 - protein, 182 aa, Artificial Sequence
  Synthetic sequence.
DLERRLDELLKRIEDRVRELVRTLEESLRELERRVREIIRRLEEHLRRIEKMVRDLKRANKPDKAVKDDVRRLRENADRLNKRVREELKKLREDVKRVNEDVKRELDKLAEEAKDMLRKLREAGIDERVIKKAEEDVRRLLREIEEVSERHKREVDRLEREIEEVSREHKERVEKLLREIER

SEQ ID NO: 25344 - protein, 182 aa, Artificial Sequence; identical to SEQ ID NO: 25343
  Synthetic sequence.

SEQ ID NO: 25345 - protein, 182 aa, Artificial Sequence
  Synthetic sequence.
KLEEDLKRILDELRRMAKEIIDRLEDHLRKIKKDVDKLSKENKDHLKEIEDTVRELKRNNLRREDVKRKAKELEKNVKRANEETERKLRELEKNVKEMNTDVKRRIDELVKRAKDILDRLREEGIDERVIKRVDEEVKKLAEEIRKVSEEHEKRVKKLLKEIEKSSEDHRRRVEELLREIDR

SEQ ID NO: 25346 - protein, 182 aa, Artificial Sequence; identical to SEQ ID NO: 25345
  Synthetic sequence.

SEQ ID NO: 25347 - protein, 177 aa, Artificial Sequence
  Synthetic sequence.
SEEEEVEEELERHHRDVEEYVKRLKELLDKLRRKNETTVRDIARLAKKHHDDVDELKKRNIDEETKDRLREKTEELKRRLEEVKRRLEEEHKRAEDKAREDNERKKRESDRKEEELRRRNVSREVLKRFKDKVKENRDESERVHREIKERLEELKRKNEDVLRKVKKILDDNEERLR

SEQ ID NO: 25348 - protein, 177 aa, Artificial Sequence; identical to SEQ ID NO: 25347
  Synthetic sequence.

SEQ ID NO: 25349 - protein, 180 aa, Artificial Sequence
  Synthetic sequence.
KDLEKLVEDIRRLLEELKKTVEDNKREIKELLDRLREKVKENLKRHKELNKRLRDTGAVSEDELRETEKKSRELEKRSRDLLKKLEERVEEIERRSDEELKRLEDRVRKIEDDLRREGDRGKEVKDRIEEVLRELREAVRRHHEKVKEVLRELKEALDKHHKDVTDSLRDVERLVEEARR

SEQ ID NO: 25350 - protein, 180 aa, Artificial Sequence; identical to SEQ ID NO: 25349
  Synthetic sequence.

SEQ ID NO: 25351 - protein, 174 aa, Artificial Sequence
  Synthetic sequence.
SEKEILDEIRDRIRKLLEEIKDYLEKSKKKIRDLLEKIKKVLEDNKERVDRLLDVIRKNRIRDEDLKKAIEEDERRLEKIRRELEKAKRDIEKANEELEEKLRRAATKIKEDLDRKNIDDDVRREAKRLLEEVAEAVRRIHETSKRLLERVDEEMKRVEETIRKTNKEVEDAKR

SEQ ID NO: 25352 - protein, 174 aa, Artificial Sequence; identical to SEQ ID NO: 25351
  Synthetic sequence.

SEQ ID NO: 25353 - protein, 176 aa, Artificial Sequence
  Synthetic sequence.
SDVEKLIRDAEKKMDDFRKDSERLVRELEEKLKRHEERVRDLLRELKELLEEVRRKDSRDEELRRLEEEIDKKLEEVDRRTEELKRRIDKELEDHRRKLEKLREELDRTLEDLVRKKGRSSEKIKEAVDRIKKALRDSHKELAEVVERIKRKLDETNRELKDEARKIKEELRRVEK

SEQ ID NO: 25354 - protein, 176 aa, Artificial Sequence; identical to SEQ ID NO: 25353
  Synthetic sequence.

SEQ ID NO: 25355 - protein, 182 aa, Artificial Sequence
  Synthetic sequence.
SEVETVKKRLEDSTKESEDTVRKVKRELERLIERSEDTLRRIKKRLDDLIRTIEDLKRRGNSDDRMEKRLEDELKKIEDELRKYHEEVKRKLDELRKELRREDERVTREHDTLREELTRREGGKELLDTLRRLLEENKRRHKETVDEIERLIKEVERANREILTRIKKALDDVRRAVEEIKR

SEQ ID NO: 25356 - protein, 182 aa, Artificial Sequence; identical to SEQ ID NO: 25355
  Synthetic sequence.

SEQ ID NO: 25357 - protein, 174 aa, Artificial Sequence
  Synthetic sequence.
REVEEVLRKVREDSKRNKDELKRLLDEARKESEDNKRDLEKLLKEVREEVRRVEEILRKTRIDDEELERLKKRVREAEKRVEDRTRELEKRVREVEKEVKKRNRDMEETVKDIRRKLKDEDVLREIETLLDKNHKDNKKVLDDIRELLKENADRNRRVLEEIKKLVEDVERKVK

SEQ ID NO: 25358 - protein, 174 aa, Artificial Sequence; identical to SEQ ID NO: 25357
  Synthetic sequence.

SEQ ID NO: 25359 - protein, 179 aa, Artificial Sequence
  Synthetic sequence.
DEDEKALREIKKLIEDNERLNREVNERIERLIDRARRLMERVNREIERLIKEVRERLGEEDKRAREILRRLKEELKKHKKESDDLLEKLKRRLDEHRKDSKRSKDDLKRELDRVAAKRLRGEELEKTLRDIRKRSKEDADKVKKSLEEVEEEIRRIEKRLRESLKKVEDDIERIRREAT

SEQ ID NO: 25360 - protein, 179 aa, Artificial Sequence; identical to SEQ ID NO: 25359
  Synthetic sequence.

SEQ ID NO: 25361 - protein, 176 aa, Artificial Sequence
  Synthetic sequence.
SEIEKLTKEIRDLIRTSREEIKKLMEELERNVREAEESIKRLLEKAEELIRRIAEENKDVRELLKKLEDDLRELAKELKKVVEDSRKKLKELIDELKKYIEDLDEELRRLEDVLRRNQTRKEDVKRELERIKKSSDDVRKKVEDESRKHREEVERLERELDRKLEDIRRKVEETKT

SEQ ID NO: 25362 - protein, 176 aa, Artificial Sequence; identical to SEQ ID NO: 25361
  Synthetic sequence.

SEQ ID NO: 25363 - protein, 186 aa, Artificial Sequence
  Synthetic sequence.
SEIEKLAEDVERIAKKIEDVVRELRKANEDIIKEVRDINKELRDKVEEILRRIEKIVRDRLKDDKDEIDKVERDIERIRDEIRKSSKRVEDTIRRSERETDKLAREVEDTIERIREELEEVKRRQVDKEILDRIRKKLRETLERVRDRLRKYLEDLERRLEELRREHRKTLEELKEKLKRLADRVK

SEQ ID NO: 25364 - protein, 186 aa, Artificial Sequence; identical to SEQ ID NO: 25363
  Synthetic sequence.

SEQ ID NO: 25365 - protein, 178 aa, Artificial Sequence
  Synthetic sequence.
SEVEDLERRAREVNKRIKDLIDRLRERVRKIEEDIRRLNKELKEEVDKIIEEIRKDGGENREEVRRLEEEIKKKIEESNRDVERVIKEIREKIRELKKRADDLSEESKRKIEEVRRVRDGKLIEELLREHEKMLKEIEDRIRKIERELDELLKTLEDKHREILDELEKELRKAKERRR

SEQ ID NO: 25366 - protein, 178 aa, Artificial Sequence; identical to SEQ ID NO: 25365
  Synthetic sequence.

SEQ ID NO: 25367 - protein, 182 aa, Artificial Sequence
  Synthetic sequence.
SDIERILEENEKTNRENRKRIEDIRRELEERLDRNRRRIEEILRRAEKMLEEIEDIFRRSDISEDIVREAEKTLRDIKRELDENLRRNEETARRIEEELRENLRRNEEKHRRIEKRLDEKVRDEDKLRDLKKKLRDSLRTLEELHRKLKKDLDEILRRLEELHRKLKEDLDRILKAVRDTAK

SEQ ID NO: 25368 - protein, 182 aa, Artificial Sequence; identical to SEQ ID NO: 25367
  Synthetic sequence.

SEQ ID NO: 25369 - protein, 182 aa, Artificial Sequence
  Synthetic sequence.
SEIEDIKRRNEENNRRNKKRIDDILEELKRRVEENRRRLEDIERKLREDKERLKDIFRRSRIDDKAVEEAKRRLERIKEELEKNLTRNKDDAERIKRELDENLKRNEELHRRIREDLRRRVTDEDKLRKLEEDLRRSLETLREIHRKLKEELDRILEELKRLHERLKRRLDEIADEVARTAR

SEQ ID NO: 25370 - protein, 182 aa, Artificial Sequence; identical to SEQ ID NO: 25369
  Synthetic sequence.

SEQ ID NO: 25371 - protein, 182 aa, Artificial Sequence
  Synthetic sequence.
SDIEEIERRNRENNERNKRRIEEIEKRNREENKENEKDIERILRRAEELLKRAKEILRESDISEEVLKEMEERIKRIKERLERNLRRNAERHKEIKKELRENLERNRELHKRIADELRRRVRDEKKLRELKKKLDDSLRTLEELHRELMKRLDESLKTLKELHDELKERLDRILKEIRDDAK

SEQ ID NO: 25372 - protein, 182 aa, Artificial Sequence; identical to SEQ ID NO: 25371
  Synthetic sequence.

SEQ ID NO: 25373 - protein, 182 aa, Artificial Sequence
  Synthetic sequence.
SELEKTLEDLKRHSEENKKKLEEDLRDMERNLKENKDRLKKILEEAEKTLKDLERRFREGDIDERELERVRRKMEEIKKRLDENVERNRRKAEDIKRKLDENVKRSEDRVKEIKEDIRRRVRDKDKAEELERRLDELVKENREIHERVKKALDDIVKELEELHERLKRRLEEILRRIAETVR

SEQ ID NO: 25374 - protein, 182 aa, Artificial Sequence; identical to SEQ ID NO: 25373
  Synthetic sequence.

SEQ ID NO: 25375 - protein, 175 aa, Artificial Sequence
  Synthetic sequence.
SSVERFEKAVKESIENIRRLLEELEREIRESMKHLRELVKELKEALDRIVERLRRTVRDEDELRELIKELEDIVRRAEEKLERYRKRLEDLIDEARRTVEDVERRHREKIEEVRRRNRVEEEDLKRLDKENKDIEKKIRDLVKEARDENRKLKRDIERTLRELEERLKEVEDRET

SEQ ID NO: 25376 - protein, 175 aa, Artificial Sequence; identical to SEQ ID NO: 25375
  Synthetic sequence.

SEQ ID NO: 25377 - protein, 179 aa, Artificial Sequence
  Synthetic sequence.
SDIEKRLEENERHNERSEERIRELLKELEDHLRRTKREIEKKLEDLKRLLDRLREEDVKREEALRDLAEKVKKIKRELREHHERNRRKVEEIKEELRKHHEDNKETHERIKRDLDRKIRGNEELKRVKDELDKSLKHSRELIERAKERLEEIKKRSKELVDRAEKRLDEILKEVKDDFD

SEQ ID NO: 25378 - protein, 179 aa, Artificial Sequence; identical to SEQ ID NO: 25377
  Synthetic sequence.

SEQ ID NO: 25379 - protein, 179 aa, Artificial Sequence
  Synthetic sequence.
DEIKEREDDVKRHLDRTREEIEKLLKEMEEHTERSRRKIKKVAEDAEERLRKVEEENSKDRRVLTKLKEDVERLKEELKEHLRRNKKTVEDIKRELREHLKRNKKRVEDIKRELDRDIRGNKELEEVKRKLDRILEESEKLVREAEKRLDELLKDNKRLVEELEKELDRILEELRKRVD

SEQ ID NO: 25380 - protein, 179 aa, Artificial Sequence; identical to SEQ ID NO: 25379
  Synthetic sequence.

SEQ ID NO: 25381 - protein, 176 aa, Artificial Sequence
  Synthetic sequence.
DSIEDLERRAKESDDHLEKLIRELRDELRRSLETVRRNIEDLRRTLEEVLRRLEEDGADKDLLKDLADKVDTIRKELERSLEEHRKRIEEIEERLKDLHRRHRERIEKIKKDLKDVGEEMLREIKKELEETNKRAEDDVRKIREELREHNERHKERSKRIKEELKRTLDELKKKRK

SEQ ID NO: 25382 - protein, 176 aa, Artificial Sequence; identical to SEQ ID NO: 25381
  Synthetic sequence.

SEQ ID NO: 25383 - protein, 186 aa, Artificial Sequence
  Synthetic sequence.
SRIETLVRRMKELLKEVEDKSEKSKRRWEDRLKKVAEDSKRRVEEMDRELDEVRRKRERGDRDRKEFSDELRKIKEELDKKLREHHERIKEIEKELEDENRKHHEEIKKIKKELDDIVKEAAEEGADERLLRELKRIVDEVKKELDRLDTEHNKAIEDVKRELRKLDEEVRRIVERVKRELDRLEK

SEQ ID NO: 25384 - protein, 186 aa, Artificial Sequence; identical to SEQ ID NO: 25383
  Synthetic sequence.

SEQ ID NO: 25385 - protein, 186 aa, Artificial Sequence
  Synthetic sequence.
SEIEDLIRRIRETLKRVEEDSRRSKEEAKRKLDKVKEDSERLVEKMRRDLEKVKRETDKGDRPDEDLRRKLERIKKELERELKEHHDRIERVKRDLRRLNREHHEKIRKIKEDLKRILDDAARKGADEELLKRLKEVVEDVIRKLDRLDKEHTEIVEEVERRLDKLDKDVERIVEEVKKALDETEK

SEQ ID NO: 25386 - protein, 186 aa, Artificial Sequence; identical to SEQ ID NO: 25385
  Synthetic sequence.

SEQ ID NO: 25387 - protein, 186 aa, Artificial Sequence
  Synthetic sequence.
SEIEKLIEDIRRRLKKLEDESRKSVKDARDMLRRVEERSRDSVRKMREELERVEDESRRGDRPKEALEEIIRRIKKKLDENHKRHHDEIEKIKEELERLNREHHDRVRRAKEDLDRILEKAAREGLDDELLKRLEDVVRDVKRKLDELDERHTRIVEDVKRRLDDLDREHRKIVEEVKKELDKLLK

SEQ ID NO: 25388 - protein, 186 aa, Artificial Sequence; identical to SEQ ID NO: 25387
  Synthetic sequence.

SEQ ID NO: 25389 - protein, 186 aa, Artificial Sequence
  Synthetic sequence.
SEIEKLIEELRRELEKVKDELERSIEEMDRELDDVRRDSKRLVDEIKRELREVTERTKRGDRPEEVLRKELEDIKRKLRRILEEHHEKIRRIKEKLRRENKRVRDELKRIKDEIDEKVKDVRRKGADEELLKRLEEVAEDVKRALEELLKKHTRVVERVEKALDELDKELERIVREAEKELDRREK

SEQ ID NO: 25390 - protein, 186 aa, Artificial Sequence; identical to SEQ ID NO: 25389
  Synthetic sequence.

SEQ ID NO: 25391 - protein, 186 aa, Artificial Sequence
  Synthetic sequence.
SEVEEEEKTAEKILEEVAEEIKESIKRIREEVKKNEDDSERSVREMERRLREVEERIRRGDKPKEAVEKEVREIKDELRRNHEEHHRHLRRNERRLDRENEELRRRLEKIKKELEDRLRRLAEEGQDEELLRRLKRVVERVKERLDRLLEEHTRVVEEAKERHRELDERHEKIVRDVVRELDRRVK

SEQ ID NO: 25392 - protein, 186 aa, Artificial Sequence; identical to SEQ ID NO: 25391
  Synthetic sequence.

SEQ ID NO: 25393 - protein, 186 aa, Artificial Sequence
  Synthetic sequence.
SEVEKVVKELEDELRRVAEDSERSIREMEKRLDDFRKRVRETAEKMKEDLRRVEERARRGDQPEEALTRELERIKRELEKKLREAREDVKRIKDELEKLNREHHKKIKEIKDELRRTLDKLRKDGLEERILKRVEDIVRRVEEELDKLDEKHTRVVKKVSDALDRIVEELEKIVREVAKRLEDLRK

SEQ ID NO: 25394 - protein, 186 aa, Artificial Sequence; identical to SEQ ID NO: 25393
  Synthetic sequence.

SEQ ID NO: 25395 - protein, 186 aa, Artificial Sequence
  Synthetic sequence.
SEVEKKIEEMRRTLDEARRRSEESKREIKKELDEARKRVEESLKRLRETLKKVEDERRRGDTDKEELKRRIERIKRELDENHKRLKKELEEIKERLRRKNEEHHKEIERIKRELEKKLKDLERKGLEERLLRRVAKVVEDVKRELDRLDEDHTRAVEEVERALDDLLKKHEDVVREVKTELEKLLK

SEQ ID NO: 25396 - protein, 186 aa, Artificial Sequence; identical to SEQ ID NO: 25395
  Synthetic sequence.

SEQ ID NO: 25397 - protein, 176 aa, Artificial Sequence
  Synthetic sequence.
SELEELIRDIERKLEKVKRDSERSMREIEEDLKRVRKKTEESERRIRDLLDKVRKRKVDKDKLKRIKEELRKLNKDHRDDIERIKRRLDKLNKEHREEIERIKKELRELVKRVEDAGLDRTEDLRRVAKRVEEELDRSNEEHSKIVDKAKRDLDKSNKEHSKVVEDAERTLDRVED

SEQ ID NO: 25398 - protein, 176 aa, Artificial Sequence; identical to SEQ ID NO: 25397
  Synthetic sequence.

SEQ ID NO: 25399 - protein, 176 aa, Artificial Sequence
  Synthetic sequence.
SELEELEERIERLLEKVRRESEKLLRELEKKLKDVERKIEDSIRKIRDDLRKVRERKVDREKLEEIKRKLEKLNDEVRDDLRRIKREIAELVKTHEKRIREIKEELDRTLERVERTGLDRTEDLRRVLDRVKKDLDRSNEEVRREADRIMKELDKLLKKHSDVVKEVLEALDDTDR

SEQ ID NO: 25400 - protein, 176 aa, Artificial Sequence; identical to SEQ ID NO: 25399
  Synthetic sequence.

SEQ ID NO: 25401 - protein, 182 aa, Artificial Sequence
  Synthetic sequence.
SEIEEIKRRLEETNKRVREKNKRSVDRIKEHLERSRRRVEEIIRRIEKLLEELEEKARRTDISDDVIRELKKRLEDILKELEEHHKRNKEDSDRNRKELEETLRRLKKKHEDIKRELEKMDVDEKLLRDLEKALRDSIRTLKRSVEENDRINKEANEDSERLLRELKKVLEKAKKDVDELRR

SEQ ID NO: 25402 - protein, 182 aa, Artificial Sequence; identical to SEQ ID NO: 25401
  Synthetic sequence.

SEQ ID NO: 25403 - protein, 184 aa, Artificial Sequence
  Synthetic sequence.
SLEEELRELARRLKEEVRKLEETLEKVLEDSARNIKRLIDDLKRVNDELRKRVDDLIREVGDKETVDRMKKEIDDSSKEVEKLVRELEKEVDDLRKEHEKLVRDIRRKIKELEDEIRDLERKRIEKEALDRVRKKLEDALKKLRDEVREMKKKNDKTNKEVKDKADELRKKHEDTLEELKKRVK

SEQ ID NO: 25404 - protein, 184 aa, Artificial Sequence; identical to SEQ ID NO: 25403
  Synthetic sequence.

SEQ ID NO: 25405 - protein, 178 aa, Artificial Sequence
  Synthetic sequence.
SEVDEIIKRIEDLLKEVRDESKRNEDRIREKLKRLKKKSEDNAEKIKDELKKIRDRKVDDEEIKKIKEELRENLKRVEEDVRRIKEDLDRNLDEVRRRLEDIKRKLEEMLKDAERRGEPKEVLDTLRDAIRRVKEELDRNLEKNTELIKRVKETLDDLLRRNKELIRKAEETLDEERR

SEQ ID NO: 25406 - protein, 178 aa, Artificial Sequence; identical to SEQ ID NO: 25405
  Synthetic sequence.

SEQ ID NO: 25407 - protein, 182 aa, Artificial Sequence
  Synthetic sequence.
DELEKIRKELEDLSRENKEKLERIARELKRLSEENTETLEKLKEEIRRLLEKLKRIVEKDGTRDELIKEIEDELRRLLDEVRKNVEDNKRKLDEIRKEAEKDLRDNERKLEEIERRARKRGLPKEMLDRIKELLDTHRRILEDIKREIDKLLEDHRRRLEELLRDLKRALDRVREEVDRLRR

SEQ ID NO: 25408 - protein, 182 aa, Artificial Sequence; identical to SEQ ID NO: 25407
  Synthetic sequence.

SEQ ID NO: 25409 - protein, 176 aa, Artificial Sequence
  Synthetic sequence.
DDVRRIEEEIRRTLRELRETLKRVERRNREENEDLKDKMRRMKKENEDTNERVKKEGGGGEELKRRVEELARRHEKLVREIRKRLRDLAEEHKKLVEEIKRKLDEIRRRIEEAKRRGTEDKERLDKLLEDLAKEARKVIEDLKEILRRTKESIDEVEKTLREILKKSKETADRVET

SEQ ID NO: 25410 - protein, 176 aa, Artificial Sequence; identical to SEQ ID NO: 25409
  Synthetic sequence.

SEQ ID NO: 25411 - protein, 176 aa, Artificial Sequence
  Synthetic sequence.
SDLERLKKRNDDANRKLKETLDRVEKENRDVNRKLEKELKEVEEKNRRENKKVRDRGGGGKELEDRVRELKEEHERLVEEIKKELEELEKRHRKLVRDIEEIVRTLAKEHEDMKRKGTDDKEELDKILTRSEEVARRIIEELKKILEETRKSAERVIRRLEEILKESEREVREVET

SEQ ID NO: 25412 - protein, 176 aa, Artificial Sequence; identical to SEQ ID NO: 25411
  Synthetic sequence.

SEQ ID NO: 25413 - protein, 178 aa, Artificial Sequence
  Synthetic sequence.
SEVEETIKRVRDTLKKHNEESEKAIRELEEELKRLDDKNREAVEDVKRTLDELRRTKSSEDTLRKVLDKLRRDVERLVREHEAVLKKLEDRIRELKEKTKKVLEEVARIVTEVERKVKDKDLRKRLEELLREVEEDLKRNIEKLDKALKEAKEVIERSIEHLRRVLEEVERVLRELAR

SEQ ID NO: 25414 - protein, 178 aa, Artificial Sequence; identical to SEQ ID NO: 25413
  Synthetic sequence.

SEQ ID NO: 25415 - protein, 182 aa, Artificial Sequence
  Synthetic sequence.
RKEDEMRKLLDEIEKDLKRNDERVRRVLKRSKENLRRLEERAEKLLETVEREIKRLEEEGKIREDEARELRKRLEDRRREVKRELEEWERKLKEILDEVRESLKRVRERLEEIRERMEKEDRDEREVKRTIDELKDELRKHNDKTEKLIRRARETDKELNDRVAKREEEARRELEEVDRRVR

SEQ ID NO: 25416 - protein, 182 aa, Artificial Sequence; identical to SEQ ID NO: 25415
  Synthetic sequence.

SEQ ID NO: 25417 - protein, 182 aa, Artificial Sequence
  Synthetic sequence.
SLEEAVEKLLRDSEENLKKNEEDVRRLLKKSKENADRLRDEVRKLLETAEREIKRLEDEGKISEEEAKKLREELKRILDDVDKKLREWERALEEIERKVKRSLEEWRRELREIKDRVKKEDLDERLIRETEKDVKRRDEEHNTRTEREIREAKKEDEKLNKEVRDTEKRLRDELRRVEERVR

SEQ ID NO: 25418 - protein, 182 aa, Artificial Sequence; identical to SEQ ID NO: 25417
  Synthetic sequence.

SEQ ID NO: 25419 - protein, 182 aa, Artificial Sequence
  Synthetic sequence.
SKEDKVRELLRRSKENLDRVREEVRKLLKKSRDTLEELRERAKRLLEEVEEVIKRLEEEGVISEDTARRLRKALEDIKRDVERSLKEWEDRLREILEDVRKELEDWARALDEIRKRVEEEDRDEKEIEETIRRVEDMDRRLNERLRKKIEDAERMDEALRERVERLIRRVRKELEDVERRVR

SEQ ID NO: 25420 - protein, 182 aa, Artificial Sequence; identical to SEQ ID NO: 25419
  Synthetic sequence.

SEQ ID NO: 25421 - protein, 174 aa, Artificial Sequence
  Synthetic sequence.
SELEEVARRIEKMIRDLEKDLRELERKVRESDERLKRDLERNEKEHRDTIEAMRRREPDSRVDEEVKRLEDKNRKKNKEVKDESRDLKRELETTLRRIEKEIKKIEDDVRRREGDKDVRDALKKLLDELKKAVEDVRREIERLIREHKRVTEEVERADKELNDRTRKAADELRR

SEQ ID NO: 25422 - protein, 174 aa, Artificial Sequence; identical to SEQ ID NO: 25421
  Synthetic sequence.

SEQ ID NO: 25423 - protein, 175 aa, Artificial Sequence
  Synthetic sequence.
EEVERLEEEVRRRKKEWEDRLEEVKRRNEKAKRESERENEKIAREVREVVKELRERGGGGEELRKRLEDLARKLEKYKEELRRRSRKMAEEVERVKKELRERNEELARRVEELERAGADKRRLEELLRDHSRMIRRVEAELDKSLEDHKRALDENEKRIDEWLERLRKIVEEVEK

SEQ ID NO: 25424 - protein, 175 aa, Artificial Sequence; identical to SEQ ID NO: 25423
  Synthetic sequence.

SEQ ID NO: 25425 - protein, 175 aa, Artificial Sequence
  Synthetic sequence.
SKIEEIERRVRELEETWRRKLEEVEKDSRRSVKKMEEDLERAARETEEIKRRLREEDIREEELKETVDRHHKKIEEIKRELEKENKDHHKKIRDVERELDKANKELADDMERVKKDNGDERKLEELLRKHNEVIKRVKEELKRLDKEHTDIVEEVKKELDKLDEDLKRVADEKRK

SEQ ID NO: 25426 - protein, 175 aa, Artificial Sequence; identical to SEQ ID NO: 25425
  Synthetic sequence.

SEQ ID NO: 25427 - protein, 175 aa, Artificial Sequence
  Synthetic sequence.
DEDEDLERLLRKLKRVLDEIRKRIRENIEENREVVERAAREVKKSIDENRKVVDDVQLPDEELRKLREDSERKVREIERRIEEIKKDSDRLARELEKTLEDLARKVEKTERELRREGGKGEEVRKKIEDLERELRRTLEEIHKENEKSKRKIEKALRDIREENKKHIREIEETKR

SEQ ID NO: 25428 - protein, 175 aa, Artificial Sequence; identical to SEQ ID NO: 25427
  Synthetic sequence.

SEQ ID NO: 25429 - protein, 182 aa, Artificial Sequence
  Synthetic sequence.
SDIETLTRDVERSIKELEDHLKKHHEEVKERIRRLEEHADELRRRAEKLKEELKRMKDRGDSDEEVLKDILRRVKEEVDRVKKTNEDLEREVRDSEEKVKEKNRRHKEEIKKRVKEMKDRDTKTKVEEDVKRLVKKLDEVNERHRREIERNRKELEDVSRRHKEKVDRILEDIKEALDRVRK

SEQ ID NO: 25430 - protein, 182 aa, Artificial Sequence; identical to SEQ ID NO: 25429
  Synthetic sequence.

SEQ ID NO: 25431 - protein, 178 aa, Artificial Sequence
  Synthetic sequence.
SESETVKKENEDHIRKLEDDLRKLEEDNKRHVDDIERRLRDLKRENERFAEEVKKRGGGGEELKERLKELERRHEEELKDLRRSHEEYAKRVEEVLRRARRSSEEVERKLDRIRKEIDDEEVKKTLETLVRTNRRAIREVERRLKESLDHNREVLKRAEEDLRRSIRHLREVVREADR

SEQ ID NO: 25432 - protein, 178 aa, Artificial Sequence; identical to SEQ ID NO: 25431
  Synthetic sequence.

SEQ ID NO: 25433 - protein, 185 aa, Artificial Sequence
  Synthetic sequence.
SIEDELRELKERLERVVEELRRLHEKTIEDLKRVVEKSEKTLRDIRRELERVVEEVRRRRKDLEELLRRLDKKLTELEKELKKLLEDHRRVLRRLTEENRKALEKWEELLRRLTKELKEVKDRRVDKEVLDRLRKKVEDTIRKMKDEAKKLDDEHKKAVRRLEERNEETARRVRKAVEDIERETK

SEQ ID NO: 25434 - protein, 185 aa, Artificial Sequence; identical to SEQ ID NO: 25433
  Synthetic sequence.

SEQ ID NO: 25435 - protein, 185 aa, Artificial Sequence
  Synthetic sequence.
SIEDILRKLTKDLEDVIRRSRKTSEDLKEELKRVLDKHKEKLDRILEDVERVVREVEERRKDLEELKKRIRDELRKIKKRLEESLKRTEETLRELERRNRELNERHERTAREVRKRLEEVREKRVDKEILDRLEEEVRRLIEELDKENDEARKEHREVAKRNEEEIKKLEEEAKDSIRRLREESR

SEQ ID NO: 25436 - protein, 185 aa, Artificial Sequence; identical to SEQ ID NO: 25435
  Synthetic sequence.

SEQ ID NO: 25437 - protein, 178 aa, Artificial Sequence
  Synthetic sequence.
RESEELDKRLKEIAKDIRDKLDEIRRENEKTAKEIEDTIREIERDNERIDREMERRGGGGEEVERRMREAKRRHDKILKDIEDRIRTLERKHDEILKEIRREIKRVEEELREREKERDDKRFKDVIRRLEEELKKLLKRAEEEIRDSKRHLRELLKKVEKVIRESKANLDRTLKKLRD

SEQ ID NO: 25438 - protein, 178 aa, Artificial Sequence; identical to SEQ ID NO: 25437
  Synthetic sequence.

SEQ ID NO: 25439 - protein, 185 aa, Artificial Sequence
  Synthetic sequence.
SEEEDLRRKVEELEERVERYKEELKKEIERIETENKRHVEELERRLRKIAREVDDAKRRQLSREEVEEMLRRLEDALRRIEKNVRDVNRRSKKELEELERTSKEVLDRIEESLRRLAEEVKRSPRTEDLDRLLDEMRREAERLLDELRKVTERIAREVKRSNEENKKVLDEIRKAIKDLLDKLRK

SEQ ID NO: 25440 - protein, 185 aa, Artificial Sequence; identical to SEQ ID NO: 25439
  Synthetic sequence.

SEQ ID NO: 25441 - protein, 179 aa, Artificial Sequence
  Synthetic sequence.
STEEKVEEDLRRLEEKNRRHVREIEERLERMKEENRDHVRKLEEKLRRLDEEVRKVKEGGETKDEELRRLEEELRRTLEELRRSVDKSRKDHRREEETITRSHEKLEEEHRRVLDDLRKKIRNRETLKRAERKLRESLRHNREVLERARRELKKSLDHNDKALEDAERRIREIREELEK

SEQ ID NO: 25442 - protein, 179 aa, Artificial Sequence; identical to SEQ ID NO: 25441
  Synthetic sequence.

SEQ ID NO: 25443 - protein, 180 aa, Artificial Sequence
  Synthetic sequence.
DLKEVLDKLRELVREVTERIKRTIEEIERLLRKVEREMRETIRTDEELLKTVVDELRRKNADERLLRTVTEASKTSIKLNEDLMREVERAVREVIRINEELLRRVREVAKRVLEIIKNSTDRRKIKKVLDDLRKIIEDIERESRESLERLREIIERLKRRSDKTLKDSKKVIDDIRRRTK

SEQ ID NO: 25444 - protein, 180 aa, Artificial Sequence; identical to SEQ ID NO: 25443
  Synthetic sequence.

SEQ ID NO: 25445 - protein, 180 aa, Artificial Sequence
  Synthetic sequence.
DLEEVLEDLRRLMEEVKRRIERTIEEDKRLLDEVERRIRETIRRDRELLKEAERDLREKRVDERLMDTVRRVSEESVRRNEKLLREVKRVSEESIKINEDLLKEVTRVAKEVLKIIRRSDKRDKIRKVRKELREIIDRIRRESERSLEESRRVIEKIDEKSKRTLEESRRVIEEIKEKAR

SEQ ID NO: 25446 - protein, 180 aa, Artificial Sequence; identical to SEQ ID NO: 25445
  Synthetic sequence.

SEQ ID NO: 25447 - protein, 169 aa, Artificial Sequence
  Synthetic sequence.
SSEEMLRTVEELIKEARKRLDESLEEVRKRIEDAKRRHEESNDENRRLVEDAKRRVNTEEAKKRIDEVLKKSEEVNRKAKKDLDEVLKEHERVIRRIKKELDEVLEKVRRLGEDKDVLEELREIIDRLRRESEDSLRRLEKIIKDSEDRSRESSEELKEIIKRLLEEDK

SEQ ID NO: 25448 - protein, 169 aa, Artificial Sequence; identical to SEQ ID NO: 25447
  Synthetic sequence.

SEQ ID NO: 25449 - protein, 169 aa, Artificial Sequence
  Synthetic sequence.
SKDEVLEEVERRIRTAERDLERMVRRNEELIRDAKREHERSNRENERLVTEAKREIDIEEVKRELDEVLKKSKRVNDKAKEELDRVLEKSKRVADEIRRLLREVLDKVRKLGNDKDVLDELRDIIRRLREELKKSSDDLERIIRRSVKESRDSSEELRKIIEDLKREAT

SEQ ID NO: 25450 - protein, 169 aa, Artificial Sequence; identical to SEQ ID NO: 25449
  Synthetic sequence.

SEQ ID NO: 25451 - protein, 169 aa, Artificial Sequence
  Synthetic sequence.
SEKEVLDEVKELIERAKERLRRMLERNERLVRDAERKLKRLLDEDRESIERVKKRLDIEEVKRLLDKVHEKSKRVAERLLDELRKVLKKSEKVIRDITRTLDEVLKKVEELGRDERVLEELKKEIRRLEEEVKKSSEELERIIEKLLEELKRSLEESEDIIRRLEEETR

SEQ ID NO: 25452 - protein, 169 aa, Artificial Sequence; identical to SEQ ID NO: 25451
  Synthetic sequence.

SEQ ID NO: 25453 - protein, 169 aa, Artificial Sequence
  Synthetic sequence.
RKDELLRRVEEEIKKVKKRLKEMLDTDRKLIEDAERKLEEAERRDSDLIRRAKERVRDERVKEDLDRVNDKSREVVDRIKKKLREVHEKSREVVERIEEELDKVLKEVRDLGEDDRVLEELERIIEELKREIEKSLRETEKIIKELEDELRKSLEETERIIRKLEEESK

SEQ ID NO: 25454 - protein, 169 aa, Artificial Sequence; identical to SEQ ID NO: 25453
  Synthetic sequence.

SEQ ID NO: 25455 - protein, 169 aa, Artificial Sequence
  Synthetic sequence.
RSEEVLREVEKAIRRAKEELKRAVETDRRRNTEAARALEEILDTDRRLIEEAKRRLRIDDVKRLLDEAHDKSRKVVEDAKRLSNEASKRSEDVAREIEKLLDDVLREVEKLGDDEKVLRDLKKIIDDLRRRIEESLRDSERIIEKLRRDLEASLEESRRIIERLKEKAD

SEQ ID NO: 25456 - protein, 169 aa, Artificial Sequence; identical to SEQ ID NO: 25455
  Synthetic sequence.

SEQ ID NO: 25457 - protein, 169 aa, Artificial Sequence
  Synthetic sequence.
REKELLDKVKELVERAKRELERLVREDDKLNEDLKRRLTKILKEDSDRIKEVKERLKDEEVKKKLEEVNKKSEDVIRRIVEESDEASRKSKEVAKKLLDDLDRVLDEVRKLGGDDKVLEDLRKIIEDLLREIEESLRESREIIKKLEKRAKDSLKETEEIIEELERRDT

SEQ ID NO: 25458 - protein, 169 aa, Artificial Sequence; identical to SEQ ID NO: 25457
  Synthetic sequence.

SEQ ID NO: 25459 - protein, 182 aa, Artificial Sequence
  Synthetic sequence.
SEVEELLDRVKKVADESRREAKRLLDESKRVIDKSLDEVRRLLKESREVIEEVKKRVDEKRDLREMVKRLLEELKKISRESIERNKRLLEDLRRISRESLEANKELLRTLKEIVDKVIRDIRRRNADEVLKRLEDLLRKVAEEHRRITREDEELLKRAEEEHERFSKEDEDLLRKAEKEVED

SEQ ID NO: 25460 - protein, 182 aa, Artificial Sequence; identical to SEQ ID NO: 25459
  Synthetic sequence.

SEQ ID NO: 25461 - protein, 182 aa, Artificial Sequence
  Synthetic sequence.
SRVDELVKRVRDVAREVKRINDELLKRVEEVIKESRDRVRELLKKVEDVIRRAAEEIDRIRRDREVVKDLLRRLKEDVDEVIKDNERLLEEVKRIVEDVVRKAEKTLEDLRKIVEDVIRDLDRDRAKEVVREIEKLLEDVRRTSEDTVRKIRELVAEVDDDHRRASETIRRLLKEAEDRARK

SEQ ID NO: 25462 - protein, 182 aa, Artificial Sequence; identical to SEQ ID NO: 25461
  Synthetic sequence.

SEQ ID NO: 25463 - protein, 182 aa, Artificial Sequence
  Synthetic sequence.
SEVEELLKDVERVIKRSEDEVRRLEREVEKSSEDVERINRKLLRDSREVIKKVIEDVRRVKDDKDVVRKLLEDLRRISEKSVEDMKRTLDRDREIVDKVLKENERLLEELEEIVREVERRLDERRAKEVLDRIRELLETARRRHKEATKKIKRILEESEKKSRRSIEEDKRLLDEAKEEVRR

SEQ ID NO: 25464 - protein, 182 aa, Artificial Sequence; identical to SEQ ID NO: 25463
  Synthetic sequence.

SEQ ID NO: 25465 - protein, 181 aa, Artificial Sequence
  Synthetic sequence.
SVEEVVRDNERRLEEDAERTRRVARRIEKLLDELRKKVEDVIREAKERLERLLEEIGEESDVIREVEERVKKLLKRVTDLLDKVRREVEKLLRELEESLRKSEEDVRRSIEDVKRKMSDERAEDLLREVNKRNEEVIRRNKELLDEVEKRIREVIKRLEELLEKVKRELERVADELRKAKK

SEQ ID NO: 25466 - protein, 181 aa, Artificial Sequence; identical to SEQ ID NO: 25465
  Synthetic sequence.

SEQ ID NO: 25467 - protein, 181 aa, Artificial Sequence
  Synthetic sequence.
DVERVLKENKETLDEDRKRTKEVIDRNKKKLEDLAREVRKVIEEIKKRLKELLDKTGEESEEIRDVERRVRKLLREVEEALRRVEELARRTSEEAKESLRRSEETVKRSIDEVRRKMSREEAEELLRRVNKDNEKVVRENEKLLKEVLDDSERVIKELRDLLEEVRRRIEKVIRDLEERRR

SEQ ID NO: 25468 - protein, 181 aa, Artificial Sequence; identical to SEQ ID NO: 25467
  Synthetic sequence.

SEQ ID NO: 25469 - protein, 177 aa, Artificial Sequence
  Synthetic sequence.
STDEFIERLKKILRENEEKVKEVLKRNEDLLKEDEDRTRKAIKELEDKLRRVKERVERQRADERVLRELKRVVERILEELKKSLEKSKRISEEDIRAIDEWLKRSETMVRRLLKLLRDGVDVKEIEKELRRVSEESERELRKHDENTKRVSEENKERIDRLRKTLDEVIERAEERAK

SEQ ID NO: 25470 - protein, 177 aa, Artificial Sequence; identical to SEQ ID NO: 25469
  Synthetic sequence.

SEQ ID NO: 25471 - protein, 177 aa, Artificial Sequence
  Synthetic sequence.
SLDEVIRRLEETLRKDEEDTRDVIRKVRRILEENRKEVKRVIDELRRRLEEVKKRVEDSKMDERVLRELEKVVRDILRRIDEVAKESERVVRRVEEEARRSLKESKEMVERLLKLLRDGVDADTIREELRKVLEDNKRILRRLLEELKRVSEESRDRLRRLKEELERVIEEVERRAK

SEQ ID NO: 25472 - protein, 177 aa, Artificial Sequence; identical to SEQ ID NO: 25471
  Synthetic sequence.

SEQ ID NO: 25473 - protein, 186 aa, Artificial Sequence
  Synthetic sequence.
SIARKVLTDLRKIVEDLERDVERSDRDSERVVREVLERNEEVLKRLRDIVEEIKKVIREVRKDREVLKELVDRAKEVVERVKKITEELLEEVADVVRKSKKRLEDLLEELRKAVEEVKKILDRDVEDRDDVERIKRDLERILKEVARKATESVKRNERILEEVKRHAEKSTEDVERLLRELEDTVR

SEQ ID NO: 25474 - protein, 186 aa, Artificial Sequence; identical to SEQ ID NO: 25473
  Synthetic sequence.

SEQ ID NO: 25475 - protein, 186 aa, Artificial Sequence
  Synthetic sequence.
DEIEDALREARRVTEEVRREIEKSDKESEDVVREVLRRNEEVLRRLREIVKEILDELRKRREEREVLKKLVDDLARVVKEAKRITDELVEEVERVVRESKRRLEELVKEDRRVVTEVKEILKRDVEDEKRVREVLRDLERLHEESKRTVERSVERNKTILKEVRKHAETSKRELERILEDVKRATK

SEQ ID NO: 25476 - protein, 186 aa, Artificial Sequence; identical to SEQ ID NO: 25475
  Synthetic sequence.

SEQ ID NO: 25477 - protein, 186 aa, Artificial Sequence
  Synthetic sequence.
SEIDKVKKDLEKITRDVERAIKKSDDDSRKNSKEVLETNERVLEELRRIVKEVLDEIRRVRKDKEVLKRLVEEVERVAREVEEITRRLVRHNEESVRTSERILRELVKRDRDVVKEVSEIIERDVEDRDRARDVDKKIKDLHKKSEDEVRKSVKRNRDLLEESKRHAEESREDIRRLLDEVREEAK

SEQ ID NO: 25478 - protein, 186 aa, Artificial Sequence; identical to SEQ ID NO: 25477
  Synthetic sequence.

SEQ ID NO: 25479 - protein, 186 aa, Artificial Sequence
  Synthetic sequence.
SSAETVLTELRKIVRDILEKSKKSNDDLRKIVEEILKDNEDVLRELREILRRIKEKIDERREDKEELDRLVKEAEDVVREVRKRTRELVEELRRVIREVEEINRDLVRKIDKVVKEVEEILKREVEDKEKVDRIRDDIRRLLKKLRDDVERSVRDVRRILKEVKEHAERSEEEVKRLLKELRDRAK

SEQ ID NO: 25480 - protein, 186 aa, Artificial Sequence; identical to SEQ ID NO: 25479
  Synthetic sequence.

SEQ ID NO: 25481 - protein, 186 aa, Artificial Sequence
  Synthetic sequence.
DEMDKVLKDAEDVTRRVKEELRKVDEESRRVVKRILDENRRVLKELEDRVRDLRRLIREIREDKDALAELVKEVEKVVRRVDEITKKLLDDVAEVVKRSKERLEKLVEDDRRVVETVKRILDRDVSSEEDVRKIKEDLERLHRESKRDVERSARDNERILEEVKRHADESRREVKRLLDEAKEEVD

SEQ ID NO: 25482 - protein, 186 aa, Artificial Sequence; identical to SEQ ID NO: 25481
  Synthetic sequence.

SEQ ID NO: 25483 - protein, 182 aa, Artificial Sequence
  Synthetic sequence.
DDLERVLRELERLVDEIRKEIEKVDRESEELDRRVKETIKELDERSKRLVEEVEDMIRRNRDSKELLERLIRLIRKSVEDVKRTLEKLIEDSERSVKEVKDRLEKLIEDLRKVVEDLKKLADERKAPEEVVRRVEKIVRELRKTVEDSIRRNEKSVEETRREAEKSEKRNRELVKRLEEKAK

SEQ ID NO: 25484 - protein, 182 aa, Artificial Sequence; identical to SEQ ID NO: 25483
  Synthetic sequence.

SEQ ID NO: 25485 - protein, 182 aa, Artificial Sequence
  Synthetic sequence.
SEAEKVLKELEDLVRRIEEDIRRTNEEVRKLDEDVLEDIKRVDEESKKLVREIEERIRSRRDKKDELKKLLERLRRSVEEVRRRLRELIELSREVVKRNEDRLKKLIDDLRRRVKELEKVIDERKFPEEFVRRLEELVKRLADKVKESVDTSRTSVKRTEDEARKSVRRNEDLVRRLEEDAK

SEQ ID NO: 25486 - protein, 182 aa, Artificial Sequence; identical to SEQ ID NO: 25485
  Synthetic sequence.

SEQ ID NO: 25487 - protein, 182 aa, Artificial Sequence
  Synthetic sequence.
SELEKVLEELERLVKRIEEEIKRTNKEVRDLDEEIRKAIERSNRETERLAREVLERIREERDSKELAKKLIEDVRRVVEESKKELKRLIEESRRVVEKNERDLRRLIEELRRVVKELEELADRKKAPEEVVRRLEDLVRRLEESVERSVRTSRKSVKETEDRIREVERHDERLVEELERAAK

SEQ ID NO: 25488 - protein, 182 aa, Artificial Sequence; identical to SEQ ID NO: 25487
  Synthetic sequence.

SEQ ID NO: 25489 - protein, 182 aa, Artificial Sequence
  Synthetic sequence.
SDLEDVLRKVEDLDRKIAEDIRRTNEDVKRLDEEIEEKIRRSNEKLRELVRRVLKAIRDRRDDKDLIKKLIEELEEALRRNEELLRKLIEESRDVVRKNEKVLKDLEDESRTVVDELRELADRKKAPEEVVRRLEESVRRTKERIDRSLKTSRDSVRETERKIKESKDTSEKLVKDLRDAAK

SEQ ID NO: 25490 - protein, 182 aa, Artificial Sequence; identical to SEQ ID NO: 25489
  Synthetic sequence.

SEQ ID NO: 25491 - protein, 178 aa, Artificial Sequence
  Synthetic sequence.
SEVDDILRRLREIDEKLLRENEESLKRLKDEVDRLKRKNEKSLDDLRKLVEKLIDDLRKRKEVEELARRVDDEARRVLKRNKEVVERIREELERVLRRNKEVVETIRKLSEDVVDELRSGGVDEKVLEEVKRSVDRTRDHLRKSEEDVRRLLDELRRHLEDSERRVRELLRKLREKVR

SEQ ID NO: 25492 - protein, 178 aa, Artificial Sequence; identical to SEQ ID NO: 25491
  Synthetic sequence.

SEQ ID NO: 25493 - protein, 178 aa, Artificial Sequence
  Synthetic sequence.
SKVDEILRELKRLVDELLRRIEKTLKELEDLVRELLKENTRSLEELRELVERLLEELRRRKESEELVRRAIKAVRDVLEKNRDVVRRIKEELRRVLEENREVSREVIELARKVLDELRRGGVDREFVERVRELLKRLEDELRKSNRTIEKLLRDLARHLEDSIRRVEELLRELEEKAT

SEQ ID NO: 25494 - protein, 178 aa, Artificial Sequence; identical to SEQ ID NO: 25493
  Synthetic sequence.

SEQ ID NO: 25495 - protein, 178 aa, Artificial Sequence
  Synthetic sequence.
KEVEDILRELEKIAKDLRDEIRESDDESRRLVEELLKRSEDTLKELRDLVKKLLDRLRERKESEDLVREIRKRVKEVLDKNREVNDEIIKRVAEALKKTRKVLEKVKELVKRALEKLRRSGVSEEVVKRVEELIRRVEEEVRRSTRRNEKLLEDLRRELERSDRELEKLMDDLRRKLK

SEQ ID NO: 25496 - protein, 178 aa, Artificial Sequence; identical to SEQ ID NO: 25495
  Synthetic sequence.

SEQ ID NO: 25497 - protein, 178 aa, Artificial Sequence
  Synthetic sequence.
DDVEKILEDLKRIDTELTKRTRDSNKELEDEVRRLMERSRRTLKELEDEVRKLLDRLRKRKESEELAREVERRAEEVLEKNRRVNKEIIKRARDVVEKNTRVNKKIKDDSREVVKRLEDRGVDRKVLEDVRRSLERTERELRESDKSVKKLLDELKEELDRSDREVERLLEELRDAVR

SEQ ID NO: 25498 - protein, 178 aa, Artificial Sequence; identical to SEQ ID NO: 25497
  Synthetic sequence.

SEQ ID NO: 25499 - protein, 178 aa, Artificial Sequence
  Synthetic sequence.
SEVDEILRKLRELVKELIRRTEESNEKLRKLVEDLRDESRKSLEELRELVERLADELRKRSESEELARRVIRRVEEVVRKNSDVNRRIIEAVKRVVDENTEVNKEIIEEAKRVVEELRRSGVEERVVREVEELLKELKRRLEESDKSVAELLRRLEKDLRESDRRVEELLKRLEDEVK

SEQ ID NO: 25500 - protein, 178 aa, Artificial Sequence; identical to SEQ ID NO: 25499
  Synthetic sequence.

SEQ ID NO: 25501 - protein, 178 aa, Artificial Sequence
  Synthetic sequence.
SEAEKILTELEEIDRRLVKRTEDSNRKLRDTVRKLEEESKKSLEELRELVDRLLKRLDERKESKELAEEVIRRVEEVVRRNSEVNKRIEDEVKRVVEENTRVNEEIRETSREVVKRLEDSGVDREILERVRESLERTDKRLRESDESVKKLLEDLKRKLEESDRRAERLLEELRKRAT

SEQ ID NO: 25502 - protein, 178 aa, Artificial Sequence; identical to SEQ ID NO: 25501
  Synthetic sequence.

SEQ ID NO: 25503 - protein, 181 aa, Artificial Sequence
  Synthetic sequence.
SELEEVLKRVEETVRRLTKRLEESLEETRRIVDKLREDLRRSLERTERIVRELTEKLGGTDEARELLKRANEHDKRVVDEIRKRLEEALEKDRRLVDEIRERLKELLEEVKDVVDKIRSKGREEELREVEKKAEKLVRELEERLKRVIEDSERLVTDLKEKLERVLETSKKLLADLEERAR

SEQ ID NO: 25504 - protein, 181 aa, Artificial Sequence; identical to SEQ ID NO: 25503
  Synthetic sequence.

SEQ ID NO: 25505 - protein, 181 aa, Artificial Sequence
  Synthetic sequence.
KELDEVLEKVKRIVDELERKLERSLRETKRIVDELREELKKSLKETEDIVRELERDLGGTKEADKLLEELLRRDKEVVRRIKEELERMNEHDRRVVEEIKELLERALEEVKDVVRRISKEGRDERLTEVEERAKRLVDTLAEKLKEVERRSEELVKTLEEELRRVLDTSRRLVEELREKAR

SEQ ID NO: 25506 - protein, 181 aa, Artificial Sequence; identical to SEQ ID NO: 25505
  Synthetic sequence.

SEQ ID NO: 25507 - protein, 181 aa, Artificial Sequence
  Synthetic sequence.
SELEEVLKEVEEIVRRLEEELRKSLKETREIVTKLLKKLKESLEDSERIVRELSRKLGGTDEARKLLEEANDHDRRVIEEIKRELKRLLDKDREVVKKIEDELRKLLKKVREVVERLKDKGRDEEARKVLETAKKLVDDLKRKLERVKEESAKLVDELRKELRRVNERSKELVEKLEREAK

SEQ ID NO: 25508 - protein, 181 aa, Artificial Sequence; identical to SEQ ID NO: 25507
  Synthetic sequence.

SEQ ID NO: 25509 - protein, 181 aa, Artificial Sequence
  Synthetic sequence.
SELEKVLREVEEEVRRLKKKLKESLDRTKEIVDRLKKDLKRSLDETKKIVDELREKLGGRKEADELLKRANEHDKRVIDKIRELLERALREDERVVREIRKRLKELLERVREVVERLKDEGRDKDLKDVERKAEKLVEDLDRELKEVEKTSRKLVKELEAELREVDKTSKKLVDDLRKDAK

SEQ ID NO: 25510 - protein, 181 aa, Artificial Sequence; identical to SEQ ID NO: 25509
  Synthetic sequence.

SEQ ID NO: 25511 - protein, 189 aa, Artificial Sequence
  Synthetic sequence.
REVEELLKEVEESTRTSKKIIEDLLRRVKESSDKSKKDIRRLLEEVRRIVDTVRKILERRGKKDKDAEKIIEDVERRVREVLERARRLSEENEKLVREVLRRLEESTRRDEKLVREVLKRARDSVREEELEKRVREVEETLKRLVDENRETLERVARKAKRLVEDDKRDLEEVVRELEELLKRLKEELD

SEQ ID NO: 25512 - protein, 189 aa, Artificial Sequence; identical to SEQ ID NO: 25511
  Synthetic sequence.

SEQ ID NO: 25513 - protein, 189 aa, Artificial Sequence
  Synthetic sequence.
SSVDRLLERVKRTTDESKERVERLLERVKESSERSEREIKRLLEEVERIVREVKKEVERRGKDAEDVRRIIKEVEDRVKRVLEDVRRSTDEDRKLLDRVREEVRKISEDNAREVEEVLDEVRKQSREEEVEKRVREVERTVEELVKEDREAVKRVEETIRRLLKKNEDTVKKVEDDLRKLLEDLKRDVK

SEQ ID NO: 25514 - protein, 189 aa, Artificial Sequence; identical to SEQ ID NO: 25513
  Synthetic sequence.

SEQ ID NO: 25515 - protein, 188 aa, Artificial Sequence
  Synthetic sequence.
SEIEELLRRVKKVNDESRERIKELDKRSREVNERSRRKNEELLKRVEEVVREVEERIDRTRDKETVRRLIEELEEIMREAVRRSRKSSEELRKRVEESVKELKRSSDELRRIVKEVIEEAKRNSREKELEDRVRDAVRRLERSLKENEDRVRESIERNKDSVRRNEEHVDESIKRLEKEVDRVRKRAE

SEQ ID NO: 25516 - protein, 188 aa, Artificial Sequence; identical to SEQ ID NO: 25515
  Synthetic sequence.

SEQ ID NO: 25517 - protein, 188 aa, Artificial Sequence
  Synthetic sequence.
SEIEKLLEDVRKVAEEVKRAIDRLNEENKRVNEKSKERIDRLLEEVRKVVEEVLRRVKTSKDKKTLDELLKELRKDVKRVVDEARKSSEELEKISREVNETLKELLERLRRIVEEVIKEAERRTREEEVEKRVRRVVEKLREIVKEVEEKVRRALDENRRSLEENRRRVKRVIEELEKILKEVEDEVR

SEQ ID NO: 25518 - protein, 188 aa, Artificial Sequence; identical to SEQ ID NO: 25517
  Synthetic sequence.

SEQ ID NO: 25519 - protein, 181 aa, Artificial Sequence
  Synthetic sequence.
DEVEEMEKELKKLLDDSKRRSDELIEEMRKLNEESKKRSRELEKRLRDINKEIRDRLDRDKAREVLRKSERVTEESRRLAEESDKKSEDVTRRSADRLRRVNKKVADVVERIKELLDEKRDDSKLLDDLRKTIEKVIRESRELLEELRKENERVIEESEKLLRDLLRENEKVAEEVRRTAT

SEQ ID NO: 25520 - protein, 181 aa, Artificial Sequence; identical to SEQ ID NO: 25519
  Synthetic sequence.

SEQ ID NO: 25521 - protein, 181 aa, Artificial Sequence
  Synthetic sequence.
SEVEELIRRLEKLLREVEKRARRLIEEAKRLNDESNKESRRLIEELERLVEDVAREARRDKVKELLRKLREVVKRIVEALERSDRKSKEVTERSVRLVEKAVRDLERVIREIVKRADEARDDEKLLRDLERAIRDVVRKLEELLRRLREENERVIKESEELLERVRKEIEDVLREAREAAR

SEQ ID NO: 25522 - protein, 181 aa, Artificial Sequence; identical to SEQ ID NO: 25521
  Synthetic sequence.

SEQ ID NO: 25523 - protein, 181 aa, Artificial Sequence
  Synthetic sequence.
SKVEKLITELEKLLKDSNKKTEDVERELERLNKKSNDDSRRIIEEHKKIVEEIARRVTKDKARDALREARRNVEENRELVERSDKKSKDVTEKSRKAAKESDDRLEEVIREIKRRLDEFRDDEELLKRLKDRIKKVVEESEKLLRDLVKENREVIKESEEILRRLAENLKRVKEEVDRRTT

SEQ ID NO: 25524 - protein, 181 aa, Artificial Sequence; identical to SEQ ID NO: 25523
  Synthetic sequence.

SEQ ID NO: 25525 - protein, 181 aa, Artificial Sequence
  Synthetic sequence.
EEVERLIKELDDLLRRSNARTRDLIRKADEELRRSNEESRRIVERMEEINKRIADEVQRDKAKDVLEKSKEVTKKSKRLVEESDRKVEEVIREIRKRAKESDEKVKRVIEEIRERLDRKRDDKKLLDDLKRKIETVIKESEDILRKLEEDLKRVIEESKELLDRLLEENKRVMEEARRRTK

SEQ ID NO: 25526 - protein, 181 aa, Artificial Sequence; identical to SEQ ID NO: 25525
  Synthetic sequence.

SEQ ID NO: 25527 - protein, 177 aa, Artificial Sequence
  Synthetic sequence.
DEVEEIKKEAKRIVEDLKRRNEELKRRLERLVEEVKKRNEESKKRLEDIVRKIKEDIKDGRSEVVKEVEEIIDRLVKESEKSLRDLEKTVEDLVRDSRRSLEDARRIVDELLKILDRGDKDLKEVRKTLEKARKENEDVIRKIEEDAKEVLRRDEESNRDINRKVDEVRKRVEERRK

SEQ ID NO: 25528 - protein, 177 aa, Artificial Sequence; identical to SEQ ID NO: 25527
  Synthetic sequence.

SEQ ID NO: 25529 - protein, 177 aa, Artificial Sequence
  Synthetic sequence.
REVEEVKKDLERIVEEVKKRNEELKRRLEELLKENKRRNEKSDEDLKRIVDRIDERVREGRKEVVDEATRIVEKLRKDSEKSLRDAKRRIDELMRRSDESLKRLEDIIRRLLEILDRGDKDLKDVKRVVEKVRRENEKVLREILTDAEKVSRDDETSNRDLNRKLEEARERVERKAK

SEQ ID NO: 25530 - protein, 177 aa, Artificial Sequence; identical to SEQ ID NO: 25529
  Synthetic sequence.

SEQ ID NO: 25531 - protein, 177 aa, Artificial Sequence
  Synthetic sequence.
SEVEEIKERLKRLVEEVERRNRKVIRESEETVKENEKENRKSKKRLKEILDEIVERIKDGRSEVVEELERIIRELARRSEKSLRDVERISRKLVKESRDSLRELKRRIEELLEILDRGDKDLKDVKRDVERVLKENKEVLDRLRKEDEEVSRRDKKSNEDINRVVEDVKRKLEEKAK

SEQ ID NO: 25532 - protein, 177 aa, Artificial Sequence; identical to SEQ ID NO: 25531
  Synthetic sequence.

SEQ ID NO: 25533 - protein, 177 aa, Artificial Sequence
  Synthetic sequence.
SEVEKVKEDLKKLVKEVEDRNRESKRRSEETVKENTKKNEDSKRRLKEIVDRIREEVKEGRDEVVKKAERIVEDLARRSEESLRRMEKISKDLVRESKRSLDELKRIIEELMEILDRGDKDLKDVRREVKRVLDEDKDTNDKLNDRDRKASEEDERSNRELNKTIARAEEEVKEARR

SEQ ID NO: 25534 - protein, 177 aa, Artificial Sequence; identical to SEQ ID NO: 25533
  Synthetic sequence.

SEQ ID NO: 25535 - protein, 177 aa, Artificial Sequence
  Synthetic sequence.
KEVEDVKEKLKELVERNRDENRKTKEELRRLVEKNRKENEESKKRLKEIVEEIRERVKEGRSEAVERVRKTIEDIMEDLDRSLRRVEDIVTKLAKESDDSLRRVEEIIRELLKILDRGDKDLREVEKTAEKVSKEDKETNDRIRKDLKKVSDEDKRSNEEVNKRVDKVRKEIEEERK

SEQ ID NO: 25536 - protein, 177 aa, Artificial Sequence; identical to SEQ ID NO: 25535
  Synthetic sequence.

SEQ ID NO: 25537 - protein, 170 aa, Artificial Sequence
  Synthetic sequence.
EESERLDELIKEVVERVKKLNEEARELIKDVLRRNEEVNTRLEELNRKVEKEVREEKDKDRLVRRAEAVSKTTEDLVRETIEEAKEVVKEVRDLVRRSNEDLRRVVEEVRERGVDRKVLEKIRRALEKVHEDNRRSIRDVERMLEKVEDDNRKTIERSRRLVKRVEEELR

SEQ ID NO: 25538 - protein, 170 aa, Artificial Sequence; identical to SEQ ID NO: 25537
  Synthetic sequence.

SEQ ID NO: 25539 - protein, 185 aa, Artificial Sequence
  Synthetic sequence.
RSLEELKKEVERVARAVRKVSEDNKRLLDRVREEVKRVSKENRDLVREVERRVEEVKRRVEDRKELKERVTKLLKELEDSSREVIKRVEELIDRMRRSSKEVEDRVRELLRELERVVRDVKRKVKDLERVDRLKEEIEEILRDLERKVRENKERSKKIAEDLRKHAEDNAREVKKALRDLEEKVR

SEQ ID NO: 25540 - protein, 185 aa, Artificial Sequence; identical to SEQ ID NO: 25539
  Synthetic sequence.

SEQ ID NO: 25541 - protein, 182 aa, Artificial Sequence
  Synthetic sequence.
SELERVLREIREVSRETRERSERSLEEIRRVVEDVRRKNKESLDRNREVLEEIRKALEKGPEELMRELLKEIKESSRESNRTSDESVEEVRDVARKVERRNEELLERSRRVAKRVEEEARRAPEDRVERVKRELERLVEENERIVRESRKTLEKLVRDVDRTSKRVKDENRKLLRRVEEEAR

SEQ ID NO: 25542 - protein, 182 aa, Artificial Sequence; identical to SEQ ID NO: 25541
  Synthetic sequence.

SEQ ID NO: 25543 - protein, 182 aa, Artificial Sequence
  Synthetic sequence.
SEVEDLLRRIRKVVEEVERRSRDSLRRNEEVVKEVEERSEKSLRDDKKVIDDVKRRLREGPEEEVRRLLDEVRKSSEDVVEENRRLLKRVEESSREVVKINDRLLEEVRRVVREVLEELRRAPKDEVRKAEEELRKLVRKAEEVVKKSKEDLERTTRKVEKVVRKSEEDSRRLLREVAEEAR

SEQ ID NO: 25544 - protein, 182 aa, Artificial Sequence; identical to SEQ ID NO: 25543
  Synthetic sequence.

SEQ ID NO: 25545 - protein, 182 aa, Artificial Sequence
  Synthetic sequence.
SKLDKILEELRRIVEEVKRRSEESLEEIERVVEEVKRRSRRSNEELKRIVDKIKKDLRDGPKELIRELLKEIERVAREVKKINRDLLEDVKRVVDKVRRENEKLLEDVRRVVEDVKRRISEVQEDDVDRVRREADKIVEDVRRVVERSKRRLDELRRDAEKVVRDSERRIDRIVDDVRRTAK

SEQ ID NO: 25546 - protein, 182 aa, Artificial Sequence; identical to SEQ ID NO: 25545
  Synthetic sequence.

SEQ ID NO: 25547 - protein, 182 aa, Artificial Sequence
  Synthetic sequence.
SDLEEVLKKLEDILRKIKETNDKALREIEEVLRRVKERSRRSNKEAEKVLREVEKMLEKGPKELARKLLEEVERVVRKVTEDNDRLLKEVEDVVRRVEELSRESLKTIEKVVRDVARDVERVEEDEVRRIKERLERLLRTAERVSREIKKRLEELVDDVRREVKRSKDRLKRLVDEVAERVR

SEQ ID NO: 25548 - protein, 182 aa, Artificial Sequence; identical to SEQ ID NO: 25547
  Synthetic sequence.

SEQ ID NO: 25549 - protein, 182 aa, Artificial Sequence
  Synthetic sequence.
SKVDEILKDIERVVREVEKKSRKSNEELKRISEESKRRNEDALRRLKEIADRVRERLDKGDKEEVRELLKTVRDVVKKVKEESDRSVKRSEEVAEEVKRRNEALLKEVEDVARDVEEKLREAPEDKVRDARRRLKELVDRVKRVVEESEKRIRKLVKENRDVSRRIEEELKRIVREIEEEAK

SEQ ID NO: 25550 - protein, 182 aa, Artificial Sequence; identical to SEQ ID NO: 25549
  Synthetic sequence.

SEQ ID NO: 25551 - protein, 182 aa, Artificial Sequence
  Synthetic sequence.
SKLEEILKKVEKVSEDTKRKSEDSNRRIKKVSDESKELNKKALRDITEMAKEVDRVLKEGREDEVKKLLDEVREVVERVRKISEDSVRRSEEVVRRVEEINRELLKDSKRVVDEAAERIREAPEDRVDEARRRLERLVEDNARVVKRSEDELRKLVEDNRRVSEEIERKLKELLKRVAESVT

SEQ ID NO: 25552 - protein, 182 aa, Artificial Sequence; identical to SEQ ID NO: 25551
  Synthetic sequence.

SEQ ID NO: 25553 - protein, 182 aa, Artificial Sequence
  Synthetic sequence.
SKAEEALKELERVADEARRASEKSNREAKKAADDAKRASEKSLREAERAAREAEKALREGPEEDARRLLKEVEEVARRAAKINKELADRVRKVAEDAARINDKLLEEVRDAARRAKEAAREAPKDDAKRIKDEADKIVKRAEDAARESKKRLKRLVEDAERAAKESKEELDRLVREAEEKAR

SEQ ID NO: 25554 - protein, 182 aa, Artificial Sequence; identical to SEQ ID NO: 25553
  Synthetic sequence.

SEQ ID NO: 25555 - protein, 178 aa, Artificial Sequence
  Synthetic sequence.
SEVERVLKELEDLIRKLEEEIERSLRELEKLIEELKKEIKESLDELEKLIRDLIRRLDERKESEELAREVRELVRRVLEKDREVLERVIREVRKALEKNKRVLDRVRKLVEEVLEKLRRGDVSEEADKRAKELLDKLRKVIEKSKEDSRKILKDLERTVKRSEEESRKVLEKLERRVQ

SEQ ID NO: 25556 - protein, 178 aa, Artificial Sequence; identical to SEQ ID NO: 25555
  Synthetic sequence.

SEQ ID NO: 25557 - protein, 178 aa, Artificial Sequence
  Synthetic sequence.
DEVERVLRELRELIKRLEEEIRKSLKELEDLIRRLIEEIEETLKKVEKIIRELKARLEERKESEELARKVEEDVRRALKENKRVLEEVIRRVRKVLEDDRRVLEEVIRRVEKMLEDLKKAGVSDELREEAKKLLRRLEKTVEKSKRDSEKVLRDLEEVVRESERASKELLKDLKRKVD

SEQ ID NO: 25558 - protein, 178 aa, Artificial Sequence; identical to SEQ ID NO: 25557
  Synthetic sequence.

SEQ ID NO: 25559 - protein, 189 aa, Artificial Sequence
  Synthetic sequence.
SELERLLREVEKSSRESVETSRKLNEEVEKTTRESKRRIEELLRRVEKIVDEVKKVIDRDGKDSEEVRRIVEEVKKFIETILEEIKRSSEEDERRIRDVLRKSEKSSEDDRRLLDEVLKEVARRTRTDEARERLRRVAEEIKRLAKENKRVAEESKRRAKELLDDNKDTVRRVSERLKELLEDLDRKLK

SEQ ID NO: 25560 - protein, 189 aa, Artificial Sequence; identical to SEQ ID NO: 25559
  Synthetic sequence.

SEQ ID NO: 25561 - protein, 189 aa, Artificial Sequence
  Synthetic sequence.
DEIEDLLRRVRKTTEESKKRSEDLNKEVKDSTREVKKRIKELLEEVERRVKEVKERMERDGLKSEEVKRIVDEVERELERVVDTVRKIVEDDKRLIEDVVRRSKDLSRRDVELIKTILKEIEDRSRTEEAEKRVRRAKEEAERLIRDNERKLKESEEELRRLIKETEDVLRKAEEDIRRILADLRRRLK

SEQ ID NO: 25562 - protein, 189 aa, Artificial Sequence; identical to SEQ ID NO: 25561
  Synthetic sequence.

SEQ ID NO: 25563 - protein, 189 aa, Artificial Sequence
  Synthetic sequence.
SEVEKLLEDVRESTKRVKELSKRLNEEVERTTKESEDRTRRLLEEVKRIVEDVKDKLRKRGKDSEDARRIVEEVKKRIREIVETSTRLSEDDKRLIEEVLKESERIVREDEELLRRVLEEVERRSRTEEAKKRVKEISDEIRKLAEETREVLERSEKRLRELIRRNEKVNKEVAERLEEILRDLDRKLR

SEQ ID NO: 25564 - protein, 189 aa, Artificial Sequence; identical to SEQ ID NO: 25563
  Synthetic sequence.

SEQ ID NO: 25565 - protein, 174 aa, Artificial Sequence
  Synthetic sequence.
REKEDAKRRLEEILREVKKDLDRVHRENEKLVEDTARTVERIKRELKKLLDRAREVPVEEELIKEIEKIVEDIVRRVEELLRRDKKVSDDVSREVRRLVEDLRRIVETVVELVKAGMDIEELRKRVEDVVRRVKEELERLLKENEDSTREVKKEAERLLDEIRKVLEKVERDAK

SEQ ID NO: 25566 - protein, 174 aa, Artificial Sequence; identical to SEQ ID NO: 25565
  Synthetic sequence.

SEQ ID NO: 25567 - protein, 174 aa, Artificial Sequence
  Synthetic sequence.
REKEEAEDRMRRILEEVRRTLEEVHKENRRLLEDTRRTVERIERENRKIVEEVRRVPVDEKLVKKAEDISRRVTEEVRRLLDEDRRVSEEVSRRAEELVRRLEEIVRRLLELVREGMDIETLERRVREVVERVKKELERLLRENKKSTEEVKRTAEDLLRKNREVVEEVKKAAK

SEQ ID NO: 25568 - protein, 174 aa, Artificial Sequence; identical to SEQ ID NO: 25567
  Synthetic sequence.

SEQ ID NO: 25569 - protein, 184 aa, Artificial Sequence
  Synthetic sequence.
DEVEELERRLEELLKKSRDEVTKLADELDRVLERSREVVKKDRESLKEILKEVERLVREKNDERLKEAVDELRKVVEEIERRNEKAVRENEEVVRDVKRRVKEVVEENERVVRKIKDVLRDKDKSKELLDRLEKELRESVKRSEERLKELADRIRKSLEDSERLSRRTNERIKRVLEEVTERVK

SEQ ID NO: 25570 - protein, 184 aa, Artificial Sequence; identical to SEQ ID NO: 25569
  Synthetic sequence.

SEQ ID NO: 25571 - protein, 184 aa, Artificial Sequence
  Synthetic sequence.
DEVEDVSRKLDEALERSRRITEDLEKKLREVIETSKREVDKLAERLDEVIREIEERIRKKNRKELEELLREAREVVKEVKKRLEDLLRRNEKVVREIRETVERLNEELREVAKRVRDVARKEDKNKELIEKLEEDIRRVLEKIKREHERLLRKIEESLKDSKRRLDKLRRDIERILERIREALR

SEQ ID NO: 25572 - protein, 184 aa, Artificial Sequence; identical to SEQ ID NO: 25571
  Synthetic sequence.

SEQ ID NO: 25573 - protein, 178 aa, Artificial Sequence
  Synthetic sequence.
REIEEALRELEEVLRKVKEDNKRLEEEIRRVLEEVKRINEKLLRDAKKELDRVKEILKDTRDEKAVREVLKEVEDVVRRVKRMSEESVKEVERVVRELVERSRRSLEEVRRVVRRLLERVKDVEEAKKELRRLVKEVEDVVRTSTRRLEELVKEVRRVSEETKRALDELVKEVREEVR

SEQ ID NO: 25574 - protein, 178 aa, Artificial Sequence; identical to SEQ ID NO: 25573
  Synthetic sequence.

SEQ ID NO: 25575 - protein, 178 aa, Artificial Sequence
  Synthetic sequence.
DEIEDVERKIKEVVDRVRDINRRLRDTIRRVLEKVTRINEELRDTVRKVLKEVERILREIKEESKVEEVLKRVREVIEKLARDSRDSLREVERVARELKERSKKSVEDVKKVADDLVREIRESEEIKEKLERLVREVKRISEESAKDLERLVREVEKVVEDSERELRRLVEEVERRRK

SEQ ID NO: 25576 - protein, 178 aa, Artificial Sequence; identical to SEQ ID NO: 25575
  Synthetic sequence.

SEQ ID NO: 25577 - protein, 178 aa, Artificial Sequence
  Synthetic sequence.
SEIEKVRKEIDEVLKRVRKINEDLLRELEEVSKRSKDINDDDLRTNTEVLKEARRILKDSTDERLVEEALKRVEEVTERNVRSSRKSLEESERVVRRLLEASRKSLEEVRKVAKEIKEKIKDSKDVTKELDELVREVEEEVRRSKDTLRRIVEENREVVERSERKLKKSSDDVREERR

SEQ ID NO: 25578 - protein, 178 aa, Artificial Sequence; identical to SEQ ID NO: 25577
  Synthetic sequence.

SEQ ID NO: 25579 - protein, 189 aa, Artificial Sequence
  Synthetic sequence.
SELEKVLRELEENSRRNEEELRRSNDKVRRVLDEIRRKLEEVLRKVEEVLRRIEEELSDKKDDRVAKEVIKRVEDVLRDLDRILKEVIKKVETVLREDERIVEELLDNIRKVLDRLRDILEEVKRRREDVKDKVKKAEDDVRRLLERNRRLVEESKKSSEEFLRRVEKLVDDARKKVEDALRKVRETAR

SEQ ID NO: 25580 - protein, 189 aa, Artificial Sequence; identical to SEQ ID NO: 25579
  Synthetic sequence.

SEQ ID NO: 25581 - protein, 189 aa, Artificial Sequence
  Synthetic sequence.
SELEKVLRDLEKNSRENEELLRRSNKKLKDVVDKIKKKLERALEELREVLEKIRRELSRSTDRKVAKEVIERVERVLRKLEEILRRVIREIEEVLREDREILERVIRNIEKVLEELKEIVREVRRRREDMDDKVRKAEEDVKRILDENRDLVRRSEENSKRLLERVRELVERVKDAADKLLREVREEAR

SEQ ID NO: 25582 - protein, 189 aa, Artificial Sequence; identical to SEQ ID NO: 25581
  Synthetic sequence.

SEQ ID NO: 25583 - protein, 189 aa, Artificial Sequence
  Synthetic sequence.
SELETVLRELEENSRRNEELLRRSLDRVRRVLEDVTKKLREVLEEVRTVLEDVKRKLSRVTDKKEADKLIERIERVLKKLEDILRELIRKAERALEEDKRILDDVIRNIEEVLKKLDKILEEVKRRSDDVRDKVKEAKDRVRKILEDNRRLVEKSEEDSKRILETLRKLVEEMKRELERIETELREAAR

SEQ ID NO: 25584 - protein, 189 aa, Artificial Sequence; identical to SEQ ID NO: 25583
  Synthetic sequence.

SEQ ID NO: 25585 - protein, 189 aa, Artificial Sequence
  Synthetic sequence.
SELETVLRKLEENSRRNKKLLRDVLEEDKTVLRDVERKLREVLDELRKVLEDIRDKLSRKTDDRVAKEVERRVREVLKKLKKILEDLIRKMEDSLRKLKEILKRLIENAERVLRELEKILKDVKDRREDVKDKAETMKKAVEEILDRNRKLVTEAEKRSEDSLRKLRKSVKEVEEKVKRVLEEVKKEAD

SEQ ID NO: 25586 - protein, 189 aa, Artificial Sequence; identical to SEQ ID NO: 25585
  Synthetic sequence.

SEQ ID NO: 25587 - protein, 189 aa, Artificial Sequence
  Synthetic sequence.
DELERLLEELERNSRENKKRLDESRKRVKEVLDRIEKKLRDVLREVEDVLRKIREKLERKRDDRVAKEVKRLIEDVARKLEKILKEVTDAVKKVLDENKKILEDLIRNIEEVLKKIERILEEVKRRAEDVKDKVKELRDRVKELLDRNREEVRKSEEDSKRVLDEVKRLVDELRERLREIRKRVEEEAK

SEQ ID NO: 25588 - protein, 189 aa, Artificial Sequence; identical to SEQ ID NO: 25587
  Synthetic sequence.

SEQ ID NO: 25589 - protein, 189 aa, Artificial Sequence
  Synthetic sequence.
SELEDVRRELEENSRRNEETLRRSLAELEENSERNRRELERVLAEVEKVLKKATETLSRVDDKEVARRLEDEARKVLEDLERILRRLIENIRRVLEKNKKIAEDLIRNLERVLEKLKEILRDVDRRRKDVRKEVKKVEDDVRRILEENRRLVEESERRSRRILEENEELVEDIKRKLREIEKELRERVR

SEQ ID NO: 25590 - protein, 189 aa, Artificial Sequence; identical to SEQ ID NO: 25589
  Synthetic sequence.

SEQ ID NO: 25591 - protein, 183 aa, Artificial Sequence
  Synthetic sequence.
SEVEELEREIRELVERNRELVRRLEEEARRLSRRNEELVRELKERAERLVKELKERLDRVDREELKKIADRVRREAERLVEDVRRSSRKVSEENKELVKEVRKSSTEVIKRLEDLVEKVRRDNDKDTLDEVRKEVRKLSKENEERLREVLEESRRLSKRNEEILKEIAERVKRLVDKLTDDIR

SEQ ID NO: 25592 - protein, 183 aa, Artificial Sequence; identical to SEQ ID NO: 25591
  Synthetic sequence.

SEQ ID NO: 25593 - protein, 175 aa, Artificial Sequence
  Synthetic sequence.
SEVEDVERRVRKLLEENDRLLEENEKSARELMKRDKKVSDENEKSVRDLLDRLRKEIRDEDVVRKVEEILKDLLRKDREVSKENIKILKELLDRSRDSSRRVRETLKRLLDKARKDKDVLEELLKKLRKLSEDNERLLRESNERAKRSTDESERLSRETNERVKDVVTRLKEASK

SEQ ID NO: 25594 - protein, 175 aa, Artificial Sequence; identical to SEQ ID NO: 25593
  Synthetic sequence.

SEQ ID NO: 25595 - protein, 175 aa, Artificial Sequence
  Synthetic sequence.
DEVDEARKEVDKLAKENTELVKRNKDSVKELVREDEDELRKNRESVDELLRRLEEEIRDERVVEDVIRKLEKLLEDSTRASEENKKRLEDLLRESEKSSRDVKKLLDDLLKKLKDVEGVLEEVLKTLREVSDRNKKLLEESNERVRKSTKESKDKLRKSNEEVKRVLKELRDTDT

SEQ ID NO: 25596 - protein, 175 aa, Artificial Sequence; identical to SEQ ID NO: 25595
  Synthetic sequence.

SEQ ID NO: 25597 - protein, 180 aa, Artificial Sequence
  Synthetic sequence.
DELDRLLEEVKRSLEDVEEKLKKLEEEVKRVNDELRKRLTRLLREVERSLKRVEDLIRNGEPKEDILREHERSVKEVLKEVRKVVTEVEEAHKRVMREVERVLREHEETVKRVLEDVTRRNGEKLEEVRERLKESLDRLRKRVEDLKRRLRESLESVRKLVEDLERALRKSLEELRERVR

SEQ ID NO: 25598 - protein, 180 aa, Artificial Sequence; identical to SEQ ID NO: 25597
  Synthetic sequence.

SEQ ID NO: 25599 - protein, 180 aa, Artificial Sequence
  Synthetic sequence.
EELDRLLKRVEESLRRVERILKELLDRVRKVNEDVKRTLDDLLRRSKESLDRVRKLREEGKDKDTVLKEHEKSLRKSTEDAKKVIREVEKVHKEVLDRVRKVLREHEKTVREVLEAVRRRNGEKLEEVEERLKRSLRELERLVRELEEELKKSVKSVRDLLEELKRRNEDSLRRLAEEIK

SEQ ID NO: 25600 - protein, 180 aa, Artificial Sequence; identical to SEQ ID NO: 25599
  Synthetic sequence.

SEQ ID NO: 25601 - protein, 180 aa, Artificial Sequence
  Synthetic sequence.
KELDDLLREVERSLDRVRKRLEDLLREVERVNEEVKKRLRDLLEELKRVADELRKLREDGKPKEKVLEELERAVKRLIDEVRRVIKEIEKFHKDVLDDVRRVLREHEETVKEVEERVRRRNGEKLEDLERELKRSLKELRDEVRELEERLRRSVESVRRVLKELEERARRLLKEVRDEIK

SEQ ID NO: 25602 - protein, 180 aa, Artificial Sequence; identical to SEQ ID NO: 25601
  Synthetic sequence.

SEQ ID NO: 25603 - protein, 180 aa, Artificial Sequence
  Synthetic sequence.
SELDKLLEDVKRSLDEVKRLLKELLDRVKKVNKELEEVLKRLEEDSRRVVEEVEKATRDGKDKDTVLKKLEDALRRSTEEVRRVLREVEEVHERVRKEVRRVIEEHRKTVKDVLDKARKRNGEKLEDLERKLEDSLRRLEELLRRLEDELRKSLTSVRKRVKELEEKNRELLKRVEEKIR

SEQ ID NO: 25604 - protein, 180 aa, Artificial Sequence; identical to SEQ ID NO: 25603
  Synthetic sequence.

SEQ ID NO: 25605 - protein, 180 aa, Artificial Sequence
  Synthetic sequence.
KELDELLKRIEDVVRRLEEELKRLLDEARKVNEDLERRLRKLREDVERSLREVDKMIRNGKPKEEVARRHEESVKEVDKDVKKVLKEVADRHREIVKRVEEVLRRAERVVEEIKREVRRRNGEKLKDLEKALEELLDRVRRLVKELRDRLRDSLRSVEEEVKKLKDELDRSRKAVRDKVK

SEQ ID NO: 25606 - protein, 180 aa, Artificial Sequence; identical to SEQ ID NO: 25605
  Synthetic sequence.

SEQ ID NO: 25607 - protein, 180 aa, Artificial Sequence
  Synthetic sequence.
SELDRLLERVRKSSTDSEKTLKELRDEIRRVNDEVRKVLEELLKESRRVAEEVKKVIDNGEPKEELLKTLEEVIKKSTKDVRDVIRELRRIHEEVLDRVRKSSRKNEESVRKIEEDARRRNGEKLEDLERELRRLLRRDRELVKKLEEDLRRSLKSVEEEARRLERANRELLREVEEKAK

SEQ ID NO: 25608 - protein, 180 aa, Artificial Sequence; identical to SEQ ID NO: 25607
  Synthetic sequence.

SEQ ID NO: 25609 - protein, 180 aa, Artificial Sequence
  Synthetic sequence.
SELDKLLRDVEESSRRSEETLRKLEKEVRDSSTESERILRELRDRIKKVADDVEKVIRDGKPKEKLVEDAKEFVREVEERVRKSSEDNRKTVEDIERRVRESSERNKDSVRRVLEEARKRNGEKLEELEKRLEDLLRRDKKLVDDLRKKLRDLEKRDRDLVEELRRELEELLKRVEDAAR

SEQ ID NO: 25610 - protein, 180 aa, Artificial Sequence; identical to SEQ ID NO: 25609
  Synthetic sequence.

SEQ ID NO: 25611 - protein, 180 aa, Artificial Sequence
  Synthetic sequence.
SELDRLLREVEKSSKRSEETLRDLRREVEDSSRRSEEILRRLLEESEKVAREVRKLIEDGQPKEEILKELARVIEESTRRAERSSRENEDTVRRIVKRVEDSSKRNAESVRDVMRKARERNGEKLEELEKRLRELLKRDKELVDELRKRLEELLKRDRELLKRLEEENRRLLEEVERRAR

SEQ ID NO: 25612 - protein, 180 aa, Artificial Sequence; identical to SEQ ID NO: 25611
  Synthetic sequence.

SEQ ID NO: 25613 - protein, 180 aa, Artificial Sequence
  Synthetic sequence.
KELDELLDEVRRSSETSERILRKLLREAEESTDRSKRTLKELLRELEEVVERVKKMIRDGKPKEKVLKELEDAVRRVLEDVRRSSEENKKSLEEIVRRVRRSSEENERTVRRVVEDARRRNGEKLKDLEKALRDLLDRDRKLVEELEDRLRKLAEEDEKVLRELEEELKRLLEEVAEETR

SEQ ID NO: 25614 - protein, 180 aa, Artificial Sequence; identical to SEQ ID NO: 25613
  Synthetic sequence.

SEQ ID NO: 25615 - protein, 188 aa, Artificial Sequence
  Synthetic sequence.
SLLEKLERDLERVHKESEDLARELRKELKRVHEESRELMKEIDKELRRVLEEVKSLLRRGDGEVLEELIRRAEEVLRTVERLLRRLIRISEEVLKKVEKDLERLERISREVVREVRRVLEEVKREREDVKDKVRRVEEKVEELLDRNRKLVEEVRREVEKVLRDDRRLVREVERKLKEALDEVRERVR

SEQ ID NO: 25616 - protein, 188 aa, Artificial Sequence; identical to SEQ ID NO: 25615
  Synthetic sequence.

SEQ ID NO: 25617 - protein, 180 aa, Artificial Sequence
  Synthetic sequence.
SEVEEVERRVDEVLKELKRKVDRSREESERIARELERLVEESEKKVRDVVRELEDLLRKVDREEVKKLVKEIIDELKRSSDRVRELVRRLIKEAEDSSDEVRRRIEDLLERLKELVEKAAREGRGEDLKEKIKEVEDRVDKVIKENKDLLDDVERRVRKVIKENEDLIKELRKRVEEVAR

SEQ ID NO: 25618 - protein, 180 aa, Artificial Sequence; identical to SEQ ID NO: 25617
  Synthetic sequence.

SEQ ID NO: 25619 - protein, 180 aa, Artificial Sequence
  Synthetic sequence.
SKVEELEKRVRKVMEKLKKLLKDSEKESDDVARRLEELLEESEREVREVLRELEDLLRKVDREEVKDAVRKLLERAKRSSDEVRKRIRDLIEESKRSSEEVKRLIDKLIKELEDVIRKAAKDGRGDDVDETIKRVEEEVKKVVDDNRRLNEEILRKVKKVIDDNRRLIEKVREDVDRMAK

SEQ ID NO: 25620 - protein, 180 aa, Artificial Sequence; identical to SEQ ID NO: 25619
  Synthetic sequence.

SEQ ID NO: 25621 - protein, 183 aa, Artificial Sequence
  Synthetic sequence.
SVVETVDKRLKRLLEKVEKSTEDSRRTAEESKKRVDRSTERVKEVLDRLRREVERLKDDDRADDIVREVVKRADELVKENEKVIKKVIEDNKKSVKENEEVIREVVKRIREVVEEAKRALKGGKKEKVRTVEKRAEDVIREARKLLEESKRRHDKVVEELERLLKKSKEDVDRVIKELEERRK

SEQ ID NO: 25622 - protein, 183 aa, Artificial Sequence; identical to SEQ ID NO: 25621
  Synthetic sequence.

SEQ ID NO: 25623 - protein, 183 aa, Artificial Sequence
  Synthetic sequence.
DEVEEVKKRLDELRKEVERSTREVREVLKKLLKEVKDSTDDVRRTIEKLLRDVERLKDEEEAKRIVDDVKRRIRELLDRNREVIKRVVEEARKVVDKNRRSVERVVDEARKLVEELIRRLKGGKKEELKKVEDRVREVIKDLEELLRDSKRTVEKVERELEDLVRKSEEEAERVERELEERAR

SEQ ID NO: 25624 - protein, 183 aa, Artificial Sequence; identical to SEQ ID NO: 25623
  Synthetic sequence.

SEQ ID NO: 25625 - protein, 183 aa, Artificial Sequence
  Synthetic sequence.
SVVEEVDRLLEELLRKVKKSTDESKETAKESRKEVKRSTEDNDRTVEKLRDEVRRLKDDERVEEVVEELIRRIERSAEENERVIREVIEKNERSMRENKRSVDDVVEKLRTVVDELRKALSKGVDDRVREVETRVKKVIDDVRRLVTESKKDHERVVKELRELVEESKRRNDRVVEEAKETAR

SEQ ID NO: 25626 - protein, 183 aa, Artificial Sequence; identical to SEQ ID NO: 25625
  Synthetic sequence.

SEQ ID NO: 25627 - protein, 183 aa, Artificial Sequence
  Synthetic sequence.
SMVEEVKKVLEKLKRDVDKSTDEVRDMLRRLLEEVRESSREVERRLRELKEEVDRFKDDERAKEIVKRVVEEAKKLVEENERSVRRVVEEIKKLLTRNKEVIDEVVKRARDLVRKLEEKLRGGKKEEVKKVKKEVDEVIRRLKELVRRSEEEARRVIKTLEKLLRDSKKRVEDVIKDLDRTVR

SEQ ID NO: 25628 - protein, 183 aa, Artificial Sequence; identical to SEQ ID NO: 25627
  Synthetic sequence.

SEQ ID NO: 25629 - protein, 183 aa, Artificial Sequence
  Synthetic sequence.
SMVEKVEEDLKKLTRDVEKSTEESRKTAEDSARDVRRSSREVEDVLRRLRKEVEELKDDDRAEEIVRRVVKEARDVVEENERSVRKVVERNRRSVEENKRVIDEVVERAKRLVERLREKLDKGKKEEVKKVEDKVKEVIERLKKLLDESKKRHEDVIRELEKLLEESERKVRKIIRELEETLR

SEQ ID NO: 25630 - protein, 183 aa, Artificial Sequence; identical to SEQ ID NO: 25629
  Synthetic sequence.

SEQ ID NO: 25631 - protein, 183 aa, Artificial Sequence
  Synthetic sequence.
SVVEEVKRRLEELEKRVEDSTRDSKRTLDESERELEESSRDNRRTVEELLDELRRLKDREEARDVARRVVEAIKKSLDDNRRSIDELVKKNEDSVKKNEKVIKEVVDEARKLVEKLVRRLKGGKKEEVEKVEREVREVIKKLRDLVRRSREEHEKVIEKLKRLLEESEDTNRKVIKKVEDDLR

SEQ ID NO: 25632 - protein, 183 aa, Artificial Sequence; identical to SEQ ID NO: 25631
  Synthetic sequence.

SEQ ID NO: 25633 - protein, 186 aa, Artificial Sequence
  Synthetic sequence.
SVTDEVREKLRRLLEELREVVKRVEDISRKTHEETKRVVEKVKRILEKLKREIEEVIRELGKDDRLRKVVERVEREARRVLKELEEAVKRSMKKNEKALRDLRRVAKKVVDALRKILKEVAERLKDRKEDLERLRRDVERVIREIEKLLRDVEEKVKETIKTDEDLLRRVKEDVERVLEEIDRRLK

SEQ ID NO: 25634 - protein, 186 aa, Artificial Sequence; identical to SEQ ID NO: 25633
  Synthetic sequence.

SEQ ID NO: 25635 - protein, 186 aa, Artificial Sequence
  Synthetic sequence.
SVAETVKERLKDLHRRTKESNERAKRISDELNKHNEKSVRDVDREVKRLLEEITEVIKRLGKDERLKKVAREIERILEKVLEDVKRNSEKAAREHKKVVEENHRSVRRSAEELKRILEEVARDLKDDKEALRKLDEEVKKVADDDRRLNEESRKRAKDSIEESRKLVRDVAERVKEVARKIREDLR

SEQ ID NO: 25636 - protein, 186 aa, Artificial Sequence; identical to SEQ ID NO: 25635
  Synthetic sequence.

SEQ ID NO: 25637 - protein, 179 aa, Artificial Sequence
  Synthetic sequence.
DEARELIERVKRVLDRVREENTRVNKELHDILRRVEKRNRDLLRELREILKDVKKKADEVREDKEVLRKLLKEVEKALRRVKEESDRSLKEVRDAVEEVKRISDTSLDKVRKVLEDAKRAVKDSRELEKELRRLIAEVARIVEESRRNLERIEEAIKRISETSEKEIREIEDRIKKDVD

SEQ ID NO: 25638 - protein, 179 aa, Artificial Sequence; identical to SEQ ID NO: 25637
  Synthetic sequence.

SEQ ID NO: 25639 - protein, 176 aa, Artificial Sequence
  Synthetic sequence.
SEAERAREEAKKLKEEIKKSNDELRKAAEKLKRDIERSNDELRKAIEELKRRVESLLRRVEKKLVDEVRRLAEDAARKLKRSLDETRKLVEKVLREIEESLKTVEELVKRLLEEIEKALESDEVLKEVKRIAEELHRHNREVLERIEKIARELEKHNRDVLDDIRRIVEKLERDLN

SEQ ID NO: 25640 - protein, 176 aa, Artificial Sequence; identical to SEQ ID NO: 25639
  Synthetic sequence.

SEQ ID NO: 25641 - protein, 176 aa, Artificial Sequence
  Synthetic sequence.
SEEERAREDLERLREEIRRSNEKLEEDSDKLRRDIEESNRRVEEEIRRLKEDVERKLKDVPEDLARKVRELVERLMDKIRKSLETTRELIRRVLEHDKRSLDEVEKIVREALKLIETRLESEEVLEEVRRLVKKLHEHNEESLRRSEEILKDLERHNRDVLREVEEIVREALERLD

SEQ ID NO: 25642 - protein, 176 aa, Artificial Sequence; identical to SEQ ID NO: 25641
  Synthetic sequence.

SEQ ID NO: 25643 - protein, 176 aa, Artificial Sequence
  Synthetic sequence.
REAEEAKKEADRLEEEVRDSNRKLEEDSKRLEREIRESNRKLKETAERLLRDVERLLKDVEERLVRDVKRKVEEAMEKLKKSLDKTRKLVRELLEHDRKSLEESERLVREVLRLIEEKLESKEVLEDIRRIVKELHDHNKKSMEDSRRIIEELKRHNKRVIDEVKKIVDELREKLR

SEQ ID NO: 25644 - protein, 176 aa, Artificial Sequence; identical to SEQ ID NO: 25643
  Synthetic sequence.

SEQ ID NO: 25645 - protein, 176 aa, Artificial Sequence
  Synthetic sequence.
REAEEAEKELKRLEDDIKKLVEDLDREAKRLKKEVDDSNRELEKESRRVKKEVRELLKDVDEKLVREVEKLVDEALEHDKKSLDDTRKLVEDVLRKLEEVLKEVKKLVDDALEEIRKKLESDRMLEKVKRIVDELRKLLKTVLDDVRRIVEELHRHNKESMERTRKILEDLARRLT

SEQ ID NO: 25646 - protein, 176 aa, Artificial Sequence; identical to SEQ ID NO: 25645
  Synthetic sequence.

SEQ ID NO: 25647 - protein, 176 aa, Artificial Sequence
  Synthetic sequence.
SEAERAREVLERLREEVERSNKRVREELKRLTEDVRRSNKKLREDSEEVRKRVEDLLKDVDKELVDEVRKLVKEALDLDEKSLKETEDLVREVLEEIEDSLRKTDELVKRALKIIEDKLESDEMLRRVRRIIEELHRLNKEALDRVRKIIEDLHRKNEDSLKKTEDILRRLEEELR

SEQ ID NO: 25648 - protein, 176 aa, Artificial Sequence; identical to SEQ ID NO: 25647
  Synthetic sequence.

SEQ ID NO: 25649 - protein, 179 aa, Artificial Sequence
  Synthetic sequence.
SSIEEVLERLRRLSDEVRKRTDDVLERAREISRETEERSRRINEEIERIVEELKKRADKDMVEKVKRDAEELLKKSEDLHRRVIETLRRLVERVREIHEETIRRLEELLKKVEDELKGGDKEAVDRARREVERLVKENEDILKRLEEEVRKLVKRNEDLVEENRREVEKWRKELEDRKR

SEQ ID NO: 25650 - protein, 179 aa, Artificial Sequence; identical to SEQ ID NO: 25649
  Synthetic sequence.

SEQ ID NO: 25651 - protein, 179 aa, Artificial Sequence
  Synthetic sequence.
SEIDEVLKKLRDDSKKVEEDTRRVLEELERISEKTRKDSEEVLREIEDIVEKLKRRSDEDMVRRVMEEADKLLKELEDRHRDAIRRLEELVKRVEEIHREVIERLERLLKEVEKRLSKGVREEVERAEEEVRKLVEENKRIVKEAKERVDELVERNKEIVEEIRREVERLKKELEDRRR

SEQ ID NO: 25652 - protein, 179 aa, Artificial Sequence; identical to SEQ ID NO: 25651
  Synthetic sequence.

SEQ ID NO: 25653 - protein, 179 aa, Artificial Sequence
  Synthetic sequence.
REVEEVTKELRKISKEVEDLTREVLREAREISRRTEEESRRLNKEIAEIVERLRREGDEKAVEEVLREVDKLLEESERLHREAIERLRRLLEEVEEIHRRVIEEMKRLLDDLTRKVDKGSKEDVRRVAEEVKRLVDKNRRIVEEAKKEVDRLVKRNEDLMRRNREEVERWKRELEEDRR

SEQ ID NO: 25654 - protein, 179 aa, Artificial Sequence; identical to SEQ ID NO: 25653
  Synthetic sequence.

SEQ ID NO: 25655 - protein, 179 aa, Artificial Sequence
  Synthetic sequence.
SEVDEVLKTLKKLSDDARKKTKEVLDRLRDISRRVEEESRKVLEEIRRKVEEVKKRRDDDAVKEVMKDADRLLKRLEEIHRKVMDELDKLLKRVEEIHRETIEELKRLLKDVTDKVSKGSKDKVRKVKEDVRRLVEDNKRIVKEAREEVERLKERNKDIVRRIKETVDRLKDELRKRAE

SEQ ID NO: 25656 - protein, 179 aa, Artificial Sequence; identical to SEQ ID NO: 25655
  Synthetic sequence.

SEQ ID NO: 25657 - protein, 179 aa, Artificial Sequence
  Synthetic sequence.
SDVDRVLKELEDISKDVEDKTREVLKRLKEISDEVKKRSEDINREIARIVEDLERRRDERFVERVKREADRLLKESRDIHRRVMRELEKLLEDVERIHREAIKTLEDLLRKVEKKVSKGDKEKVKDARRVVRELVERNKEIVRRAAEVVKKLKKENAKLVEDNTREVKKWKERLERRRR

SEQ ID NO: 25658 - protein, 179 aa, Artificial Sequence; identical to SEQ ID NO: 25657
  Synthetic sequence.

SEQ ID NO: 25659 - protein, 177 aa, Artificial Sequence
  Synthetic sequence.
SEVEDLLRKLKEISDESRERIKRLLEELEEISRKSKEDSERSNEELHRIVKRLKEENRDEAVERVKDALRRVLERDRELVERSIRVLKKVVDDVRRIVEESVKRLRDVVRKVRRDVEREEDLRRAEDDVRRLIEDNKRLLEEAKRRVDDLRRKNEEILRESEKNVRRIEKELEDRRR

SEQ ID NO: 25660 - protein, 177 aa, Artificial Sequence; identical to SEQ ID NO: 25659
  Synthetic sequence.

SEQ ID NO: 25661 - protein, 177 aa, Artificial Sequence
  Synthetic sequence.
SEVEDLLRKAEEISDRSRREIEKLLRELERIVREVRERSKRSNDELHRIVKELKEERRDEAVERVKRVLEEVVKRDEEIVRDVARLLERVVKEVERIVRESVEMLKRIVETIRRDLEDEKKLRDVEKRARELIRDNERLLEDAKRRVDELRRELKKILDDSRRNVERIMKELDDEKR

SEQ ID NO: 25662 - protein, 177 aa, Artificial Sequence; identical to SEQ ID NO: 25661
  Synthetic sequence.

SEQ ID NO: 25663 - protein, 177 aa, Artificial Sequence
  Synthetic sequence.
SEVDELLKRLEEISEESRRRSEDSNREVHEIVKEVKKRSEDSNRRLHKIVEDLKRENKDKAVEEVKEVLREVVERDEEIIRRVRERIRDLVRRDERIVRESVKRLRKVVEDVRRDVEDKDELKRAEDRVRELIKENKRILDESKENAERIDRELKKILEDSKRNVEEIAKRLEEDRK

SEQ ID NO: 25664 - protein, 177 aa, Artificial Sequence; identical to SEQ ID NO: 25663
  Synthetic sequence.

SEQ ID NO: 25665 - protein, 177 aa, Artificial Sequence
  Synthetic sequence.
KDVEKLLRELEKISEDSKRESDKSNKEVHDSSREVERRSRESNRRLHKVVEDLKRTNRDEAVERVKELLKKVVEEDKRIAEEDEERIERVLRRDKEIVRKSVEDLRRVVDKVRTRVERDEDLRRAKREVERLIRENEKILEDSRENLRRIAERSRRVLEESERNVRRLIEELEETRR

SEQ ID NO: 25666 - protein, 177 aa, Artificial Sequence; identical to SEQ ID NO: 25665
  Synthetic sequence.

SEQ ID NO: 25667 - protein, 177 aa, Artificial Sequence
  Synthetic sequence.
REVEELLKDLRRILEEVKRRIEKLLDELRKISEESRRRSEKSNEELHDIVKKLKDENKDEAVERVEEVLKKVLERDKRLVDRSVEELRRVVEEIKRIIDRVVERLEKVVEDVRRDVKDEKTLRDAEREVKKLIDTLRKILEDARREVKKLIDKNEKILRDSEKNVRDIAEELRRTRK

SEQ ID NO: 25668 - protein, 177 aa, Artificial Sequence; identical to SEQ ID NO: 25667
  Synthetic sequence.

SEQ ID NO: 25669 - protein, 177 aa, Artificial Sequence
  Synthetic sequence.
DEVRELLREVKEAVDEVRRRSEESNREAHRVSEESEKRSRESNKRLHEIVEDLKRRNKDEAVEEVKKALRRVVEEDKRLVDESVERLEELVRRDEEIARRLEEKAKKVVEKVRRDLEDEEKLKRAEEEIRKVIEDLRRILRESRENAKRIIRRNREILRESKKNVEDLERELEETRR

SEQ ID NO: 25670 - protein, 177 aa, Artificial Sequence; identical to SEQ ID NO: 25669
  Synthetic sequence.

SEQ ID NO: 25671 - protein, 177 aa, Artificial Sequence
  Synthetic sequence.
SEVEELLKRLRESSRRVRELSKRSNEEVHRSSDKVRRDSEESNRELHKIVEDLKRENRDDAVRRVKKRLDDVVEKDRKIVEDDVKLARDVVERDRRIAEEDVRELERVVKEVERDLEDERKLREARKEVKKLIEESREVLERSERNIRELIKESRRLLEESRRNVERLKKELEDTRK

SEQ ID NO: 25672 - protein, 177 aa, Artificial Sequence; identical to SEQ ID NO: 25671
  Synthetic sequence.

SEQ ID NO: 25673 - protein, 180 aa, Artificial Sequence
  Synthetic sequence.
SEEDEARKDVKELEDRLRKINEDSERAVRRIEEELKRILEENDREVKRLLRKIEELLRRKSSEEIKKLVDDLKKIAEDVLREAKKSVDDLRRILRKVLRDSSELVKELKEILERALRVVEAGVDIETVIRELRKALEEAARRSKRLIDELKKVLEEVKRANEETNKRLTEVVEEVAERIR

SEQ ID NO: 25674 - protein, 180 aa, Artificial Sequence; identical to SEQ ID NO: 25673
  Synthetic sequence.

SEQ ID NO: 25675 - protein, 180 aa, Artificial Sequence
  Synthetic sequence.
KEKEDAEREVERLERESRRVNRESEEEIKRLLRESEKVNEDSEREVRRIREELERLLRKKEDDEARRMVEELEKILKEVLERSSELVERDREILERILRESSRLVDEDRRILEEALRVVREGVDIDKVLTELRRSSEEVTRLSEELIERVARSSRKVKELSRKLIEELRKVLKDVARRLE

SEQ ID NO: 25676 - protein, 180 aa, Artificial Sequence; identical to SEQ ID NO: 25675
  Synthetic sequence.

SEQ ID NO: 25677 - protein, 184 aa, Artificial Sequence
  Synthetic sequence.
EELERLEKDLREVIKDSERSSDDVRRRLEEVIRDNERLLEELDERLKEVIRDVEDLLRKKDREDVKRLLKELRERVDKVRKDAEDLLRRSRKIVTEWIRRSERAVEENRRVVDEVRKEAAKEDKNKKLIDDLRRKIEESLKDSRRLDEEARKEIERISRKTREDIKELLDRIKEVLDEIRERIR

SEQ ID NO: 25678 - protein, 184 aa, Artificial Sequence; identical to SEQ ID NO: 25677
  Synthetic sequence.

SEQ ID NO: 25679 - protein, 184 aa, Artificial Sequence
  Synthetic sequence.
DELEDLERKLKEIIDDSKRLLDELEKRLRESNREVERLLDELRKELEKVIRDVEELLKKKPREEVAKLLEDLRRKVKEVEEELRRMLKKNRDVTREVKKEADKALKENERLADEVRKEATREDKNKELIDKLVRELEKSLEESRRLIEELRKEIERTSREIEKRIRDLLKEIKDVLDDIRRRIE

SEQ ID NO: 25680 - protein, 184 aa, Artificial Sequence; identical to SEQ ID NO: 25679
  Synthetic sequence.

SEQ ID NO: 25681 - protein, 183 aa, Artificial Sequence
  Synthetic sequence.
SELEEVEKRAEELARTLEELNRDVNRRLEELLRRLEKINRTVNDELRKLLEELKDVRRRGKKDVEETLKRVEDRAEELVREVKERTKEVVRRAAELVRKVVEDSRRVAEEIRELAREVAERVESKEDLDRLDKRVRDIVRDLERINEETRKTLEEIRERLERILKRTEENLKEIKEEVRKDEK

SEQ ID NO: 25682 - protein, 183 aa, Artificial Sequence; identical to SEQ ID NO: 25681
  Synthetic sequence.

SEQ ID NO: 25683 - protein, 183 aa, Artificial Sequence
  Synthetic sequence.
SELEKVTEDVRRLLERLRDINRRVNEALRRLAEELKRLNDEVNKLLRELVTELKKASKDGVPNVEEAVDRVLEELERLVKTVKDISREVAKRLEDLVRRVVEETDKVLRKIRDDVDKVLKRVEDKDKLEELKREVERIEKDVREILKRTEDNLRRIVEELKEINERTEDSLRKIVRELSEDRK

SEQ ID NO: 25684 - protein, 183 aa, Artificial Sequence; identical to SEQ ID NO: 25683
  Synthetic sequence.

SEQ ID NO: 25685 - protein, 183 aa, Artificial Sequence
  Synthetic sequence.
REKDELRKKVEELLKRLEEISKRTKDSVERVLRELDKITKESKKRAKKLVDRLKELLKRVTDERVKEIVRDVLRKIDKLVRDVARLNEEVKKRIKDLVREVEKRNRDVLDEIRKLVEEVERRGDERAIEEVLKTIEELIKEVEDVNRRVNETIRELLERLRRANEDVIRKVEKLIKEVEDATR

SEQ ID NO: 25686 - protein, 183 aa, Artificial Sequence; identical to SEQ ID NO: 25685
  Synthetic sequence.

SEQ ID NO: 25687 - protein, 183 aa, Artificial Sequence
  Synthetic sequence.
SEKERLRDMLRKIRETLDRISEDTKRSLDEVRRRLEEISKRTKDNARKLVRELEELLRRVSRKEVKKIVDDVRRRIEELVKEVEETNKRVLEEAKKLVEEVVKLNKTVLKEATRLIEEVERRMDEEFVKRVEDTLRELLDRVRRENERVNRDIDRLLKEVEERNKRVNDELRKLIEDVKEAAR

SEQ ID NO: 25688 - protein, 183 aa, Artificial Sequence; identical to SEQ ID NO: 25687
  Synthetic sequence.

SEQ ID NO: 25689 - protein, 186 aa, Artificial Sequence
  Synthetic sequence.
DDVRELIERLERILKRVEDINRDVNRKLRRVLERVRKDNEDSNRKTEKVLRDVKERADEIRSDEDALKKLVEEVERVLEEDIRRSEESVDEVRRVLEEVIRRSEETVKEVEEVIKEVEDAVRRASISEKLLRDVERELKRVREDLERILRESRDVVRRVKEELDKILEESRRKVEKVRKDLEDTRK

SEQ ID NO: 25690 - protein, 186 aa, Artificial Sequence; identical to SEQ ID NO: 25689
  Synthetic sequence.

SEQ ID NO: 25691 - protein, 186 aa, Artificial Sequence
  Synthetic sequence.
SEVEKLITDLRRILKEVEERNRELNKRNDETLKRVEETNRRVNKELKEILDRVIDEARRKREDRDLLRKLVREVEEVLKKVLRDSEETAKEVERSTREVETISRKTVDEVRKVIERVKEAVERLEISEDLLRRVEEELRKVEKDLKRILDKSRDDLRKSRERLERILRRSEEIVREVEERLRRAAT

SEQ ID NO: 25692 - protein, 186 aa, Artificial Sequence; identical to SEQ ID NO: 25691
  Synthetic sequence.

SEQ ID NO: 25693 - protein, 186 aa, Artificial Sequence
  Synthetic sequence.
DEVRKIIKELEEILEEVRKRNEKLIRENEETLERVRKINEKAIRELEDILRRVKEAVERKREDERLLRELVKTVKKVLEDVEKKSEDTLDEVRRSTERVIRESERSVEEVRRVVKKVLEMVRRLEVSEDVLRDAERRVREVREKLERINKTSRDRLKRSKEEADRINKESREVVKRVKEELEKTAT

SEQ ID NO: 25694 - protein, 186 aa, Artificial Sequence; identical to SEQ ID NO: 25693
  Synthetic sequence.

SEQ ID NO: 25695 - protein, 186 aa, Artificial Sequence
  Synthetic sequence.
DEVERVIRELERILREVEKRNRDVLRKNEETLREVRERNERAIEELRRILKKVKEEAERKREDEDALRRLVKRVEEAIKRVRELSERSVRKVEESTKEVEDDSRRSVETVRRMLEKLRREVEKLEVSEDVLRTVRKKVEEVREALDRINETVKKALDDSRRRLEKINRDVRRDVEKVREDLERTAT

SEQ ID NO: 25696 - protein, 186 aa, Artificial Sequence; identical to SEQ ID NO: 25695
  Synthetic sequence.

SEQ ID NO: 25697 - protein, 186 aa, Artificial Sequence
  Synthetic sequence.
DEVKKLIDDLRKILDRVRKENRRVIEELRKILEDVERRNREAIERLERILRRVVDLMRKKREDRKMLEDLVREVERAIERVEKLSEESLDEVRRVIEEVKRRSDKTVKDVRDALKEVLEAVERLQVSEEVLKRVREEVDRVRRELDRINEDSERVLRDVARELERINREVRKRLKEVEKRLREAAK

SEQ ID NO: 25698 - protein, 186 aa, Artificial Sequence; identical to SEQ ID NO: 25697
  Synthetic sequence.

SEQ ID NO: 25699 - protein, 186 aa, Artificial Sequence
  Synthetic sequence.
SEVEKIIKELREILERVREDNRKIIDDLRKILKEAEDTNRKVIKELKEILKDVSKLMKEKRSDEDALRRLLEEVDRVIKDVIRLSNESLKEVERVIEEVERRSRKSVEEVRRVIKRVLEMVKRLEVSEELLKEAEKDVRRVKEKLDKINRDVREELKKVAEDVKRINDRSREELRRVKEELKKDSD

SEQ ID NO: 25700 - protein, 186 aa, Artificial Sequence; identical to SEQ ID NO: 25699
  Synthetic sequence.

SEQ ID NO: 25701 - protein, 186 aa, Artificial Sequence
  Synthetic sequence.
KEVEKVIEELRKILDDARRENERLLRELEEILKRVEERNRKLLEDLRRILEEVRKKAKDIRRDKDALDKLVREVDKVIKRVKEESDRSVEEVRRVIEEVITRSEKSLRDVERAIERVKETVDRLQVSEEVVKRVEEELKKVKEDVERINKEVRDRLREVEERLEKINEDTERTLKKVKDELEETKR

SEQ ID NO: 25702 - protein, 186 aa, Artificial Sequence; identical to SEQ ID NO: 25701
  Synthetic sequence.

SEQ ID NO: 25703 - protein, 179 aa, Artificial Sequence
  Synthetic sequence.
DELRDVLRRLREVLTELEKENRKSIEELKKLNEDVARDIKRVIDELRKLLKRVKEEIEKNKDSKELIERLLEEVEKAVKRIDELVKKLLDDNKRVVDESRELARRTLETVEEVVRKILETADKDEEVRKELEDVRRKAEKILRDNDERLKESNRHMEKLLREVKEELKRVRDAVEEARK

SEQ ID NO: 25704 - protein, 179 aa, Artificial Sequence; identical to SEQ ID NO: 25703
  Synthetic sequence.

SEQ ID NO: 25705 - protein, 179 aa, Artificial Sequence
  Synthetic sequence.
DEVRDVIKKLKDLNDRLDDENKKSIEDLKRELERLERRNRDSIRRLEELLKDVADKIRRRRDDEELVERLLREVKKVVEDSRRLAEETLKEVKDIVKRSEELARTTLERNRDVVKKIIEAADKDKDVRKRLRESNEHMKELLKENKELLKRLEDEVKRILERNKKELDRVLRRAEELRK

SEQ ID NO: 25706 - protein, 179 aa, Artificial Sequence; identical to SEQ ID NO: 25705
  Synthetic sequence.

SEQ ID NO: 25707 - protein, 182 aa, Artificial Sequence
  Synthetic sequence.
RSVEEVRKVLEELKREHEKISKKTEEVLEDLKRRHEEIIKRVRDVLREIEEDLRRIRSRVDDELKRVLSEVLERVRRLVKELEDILKDSLRKIEKLVRELHEINKRSLDTLRELADRLAKDDTDEKVEKVIRELRRSVEDSKRRNDEAIRRLEESVRKSSDEVRRAIKELRDLLKKVRDTTK

SEQ ID NO: 25708 - protein, 182 aa, Artificial Sequence; identical to SEQ ID NO: 25707
  Synthetic sequence.

SEQ ID NO: 25709 - protein, 182 aa, Artificial Sequence
  Synthetic sequence.
STVERVREEADRLRKEHERISDETRKVLRKLEEDHERISRRTEELIERIEREVRKIESRVDEDLVRELREVLKEVRRLAKEVHEENKRSLDRLRELVERLHRENDKSLREIDKLADELAKDDDDEKVKRVEEEVRRSVEESKKENKKVIDDARRSVKRSEDRNREVIKEVKRLLDTVRERAK

SEQ ID NO: 25710 - protein, 182 aa, Artificial Sequence; identical to SEQ ID NO: 25709
  Synthetic sequence.

SEQ ID NO: 25711 - protein, 182 aa, Artificial Sequence
  Synthetic sequence.
STVEDVRRRADELRRRHKKISEETERVLRRIEEAVRRILEDLRRILKEIEDRVRELLSRVDEKLKRVLEEVRRRLKKLVEELERRLTEVLKRVRELIRKLHEDNKRSLERIDKLADELAKDDDDEKVKEAKRRVTESVRKSKDRNRRVIEEVDRLLKRVEEEVRRVKEEAKELLREVAERTK

SEQ ID NO: 25712 - protein, 182 aa, Artificial Sequence; identical to SEQ ID NO: 25711
  Synthetic sequence.

SEQ ID NO: 25713 - protein, 177 aa, Artificial Sequence
  Synthetic sequence.
SSVEKVIEDLRRISEKVKKRTEDVLREAEKILRRVEKDNKKVNDDARRIVEELERRGDEKAAREVVKKVEDLLKELKEIDEEVARRVRKLVKELKEIHRKVIEDVRRLVKELEDEGIEKRLVDRVREAAKDIEDENREVLRRVEEILRRIEEELKRSSDETEKAVREIKRRLDERAR

SEQ ID NO: 25714 - protein, 177 aa, Artificial Sequence; identical to SEQ ID NO: 25713
  Synthetic sequence.

SEQ ID NO: 25715 - protein, 177 aa, Artificial Sequence
  Synthetic sequence.
EEVERVLEEIKRISTDVARRSKEVLKRARESSERVKRRTEEVLEEIRKTNEDVARRADEELFKKVVEDNKRLLDRLREEHRKDDEVVRKLLKELEDIHRKSIEEVRRLLEDLERRGIDKKVVDRLRKEVKRNEDENREMVREVEEEVRRLEKENEEAVRRAADIVRRSEEHLRERTR

SEQ ID NO: 25716 - protein, 177 aa, Artificial Sequence; identical to SEQ ID NO: 25715
  Synthetic sequence.

SEQ ID NO: 25717 - protein, 184 aa, Artificial Sequence
  Synthetic sequence.
KEVEDLLREVEKSSEKVRELIERSIRELERILEKVAEEIRRSIEELEKILERVAEVAKRRDRELVKRIIEEVLERVDRVNKENEEIIRKVAKEVDDVNDRNRKIVTENKKELERVLREIRNLPVDEKIVKRVEDEIRRLMKKSDELLERSTKVVEDIKRELEKLLETSSRMAEDIKRKLEELRR

SEQ ID NO: 25718 - protein, 184 aa, Artificial Sequence; identical to SEQ ID NO: 25717
  Synthetic sequence.

SEQ ID NO: 25719 - protein, 184 aa, Artificial Sequence
  Synthetic sequence.
SEVEKLIEELERILEEVARRLKKSNEDLRKILKEVAKRIKDSIRDLRRILEEVADELRRRSEELVERIIRDVLRRVDKVNKENDEIIKRVEETVRRVLDRNRKIIKEVEDTVDKVLKEIRDLPVDERIVEEVERAAEEIKRRLEELVRRSEKSVEEIERELRKLLKDSSDVVREIKKRLEDERR

SEQ ID NO: 25720 - protein, 184 aa, Artificial Sequence; identical to SEQ ID NO: 25719
  Synthetic sequence.

SEQ ID NO: 25721 - protein, 184 aa, Artificial Sequence
  Synthetic sequence.
SEVEKLLKEVEDSSRKVEEDLRDSNRELKKILDEVADRIRKSIKRLEDILKKVAEDAKRRDKELVEKIIKEVLDDVERVNRENKRILEEVRKRVDEVLRRNREIVKENEKLLDDVLKEIRDLPVDEKIVRDVERRVRELKERSRRIVEESERSAREIKRELKRLEDDSSRVVEDIRKKLEELAK

SEQ ID NO: 25722 - protein, 184 aa, Artificial Sequence; identical to SEQ ID NO: 25721
  Synthetic sequence.

SEQ ID NO: 25723 - protein, 184 aa, Artificial Sequence
  Synthetic sequence.
REVEELIKRVEESSRDVERRLRESNEEVERSTRRVAEEIKKSIDRVREIVERVERKKERVSEDILRDIARRVSEFVRRANKRNEKIARDNRRRVREVLRRNREIVKRNKELLDKVLEEIERLPVDEKIVERVRRVIEELKRRSDEIVKESERSVRRVEKETTELLEESSRAVERVERRLRELVR

SEQ ID NO: 25724 - protein, 184 aa, Artificial Sequence; identical to SEQ ID NO: 25723
  Synthetic sequence.

SEQ ID NO: 25725 - protein, 184 aa, Artificial Sequence
  Synthetic sequence.
SEVEKLIEEVRRSSKKVEEDLDRSNRELEDILRRVAEELEKSNRELEKILKEVAERVKRREERLVKKIVEEVERKVDEVLKRNRDIIRKVEETVERVLRRNRKIVDDNRKLLDKVLEDIRRLPVEEEIVKRVEEEARRLKERSREIVKRSEDSAREITKALRKLVRDSEDSVRKIKEKLKEETR

SEQ ID NO: 25726 - protein, 184 aa, Artificial Sequence; identical to SEQ ID NO: 25725
  Synthetic sequence.

SEQ ID NO: 25727 - protein, 184 aa, Artificial Sequence
  Synthetic sequence.
REVEELDKRLKESSTEVEERLRRSNREVEDSTRRVEEEARKSNEELREILERVAEDVKRRRKEEVDKIVRDVDERVKEVLKRNEDIARENERLLDRVLKRNKEIVEENEKLLRKVLEDIRRLPVEERIVERVERSARELMRRSRDIVRRSKESIERLKKRTRDLVKESRESVEKIKRDLEELRR

SEQ ID NO: 25728 - protein, 184 aa, Artificial Sequence; identical to SEQ ID NO: 25727
  Synthetic sequence.

SEQ ID NO: 25729 - protein, 184 aa, Artificial Sequence
  Synthetic sequence.
SEVEKLLKELEDSSKKVEDDLRKSNEELRKIVEEVADLIRRLNKELEEILREVRERMRRVSEEEAERILREVAERVKRVHDESREIIERVLRDVERVLEENERIIKENKERLDKVLKEIRDLPVDEEIVRRVEKIVRDLKRRSDELVRRSRKSVEEIRKELEELVERDRRSVERIKEELDKERK

SEQ ID NO: 25730 - protein, 184 aa, Artificial Sequence; identical to SEQ ID NO: 25729
  Synthetic sequence.

SEQ ID NO: 25731 - protein, 184 aa, Artificial Sequence
  Synthetic sequence.
SEVEKLTKEVRDSSKRVEDELRKSNERLKESTDRVADEIRRLNKELKEILDKVAREVERRDKKLAEDIIRDVKKKVDEVHKESRDIAEENKKLIDEVLRRNREIIRENMERVERVLKEIRDLPVDEEIVERVERDARKVKEDSKRLVEESEESVRRLKTDTERLVEEDKKSVDTIKEELKKLTK

SEQ ID NO: 25732 - protein, 184 aa, Artificial Sequence; identical to SEQ ID NO: 25731
  Synthetic sequence.

SEQ ID NO: 25733 - protein, 184 aa, Artificial Sequence
  Synthetic sequence.
DEVEELRKELEDSSREVEELIRRLNKEVEKSTREVAKRVKDSNKRLDEILKKVAEEVKKRSKETAKRIIEEVMRRVREALRRNEEIAERNRRLLERVHDTSRKIVETNKDRLDRVLERIRNLPVDREIVERVREEVEKLKKRSEDLLERDKESIDKLDKETKELVEESRKSVRDIERELKKLSD

SEQ ID NO: 25734 - protein, 184 aa, Artificial Sequence; identical to SEQ ID NO: 25733
  Synthetic sequence.

SEQ ID NO: 25735 - protein, 184 aa, Artificial Sequence
  Synthetic sequence.
DEVEKLIKDVEDSSREVEERIRDLNRKAKKIVREVAERIRELNERLKEILDKVAEEVKRRDKELAKEIIKKVLEDVRRVHKESRDIIREVKEVLDRLHKTSEDILRKNKELLDKVLEDIRRLPVDEEIVKRAEKRIRELKKKSDELLKRDRDSMDRIKKELEKLTREDEESVRRIERELKRLAD

SEQ ID NO: 25736 - protein, 184 aa, Artificial Sequence; identical to SEQ ID NO: 25735
  Synthetic sequence.

SEQ ID NO: 25737 - protein, 184 aa, Artificial Sequence
  Synthetic sequence.
SEVEKLIEEVRRSSEEVERRIKKLNDDVRRSTEKVEEDIRRLNEELKKILDEVAKEMERRDKEEVKRIIEEVEKRVKEVHDRSREIAERNKKRIDDVHRESARIAEENKEELDKVLKRVRELPVDERIVRRVEKIIRDLKKRSDELLKEDRRSAEEAKRETDRLVEEDKRSVDEIRERLKELSR

SEQ ID NO: 25738 - protein, 184 aa, Artificial Sequence; identical to SEQ ID NO: 25737
  Synthetic sequence.

SEQ ID NO: 25739 - protein, 184 aa, Artificial Sequence
  Synthetic sequence.
DEVEELLRRVEEIVERVAKRIEELNRRLEEILEEVARRSTKSIKELEDILRKVAKEMERRRKEEAKKILDKVVKDVEEVNKRDEEIARRVEKIVKDVHRDSRRIAEEVLRFLDRVLERIRELPVEEEIVERVERRIRELKKRLEKLVRDDEESVKEIRKKLEELVKRSSDVVERIKRELDKLRK

SEQ ID NO: 25740 - protein, 184 aa, Artificial Sequence; identical to SEQ ID NO: 25739
  Synthetic sequence.

SEQ ID NO: 25741 - protein, 184 aa, Artificial Sequence
  Synthetic sequence.
SEVEKLLRELRESSREVEERIRKLNRELEKIVRDVDRESARSIEELKRIAEEVAERAKRRDKEDVKRILERAVEEVRRVNKRDRDIIREVLKLVDDVHEESRKIVEDNKRTLEKVLEEIRRLPVEERIVKEVEEEVRRLKKRSTKLLEDDRKSVEDIKERLKELVRRSSEVVKEIEERLKRLEK

SEQ ID NO: 25742 - protein, 184 aa, Artificial Sequence; identical to SEQ ID NO: 25741
  Synthetic sequence.

SEQ ID NO: 25743 - protein, 184 aa, Artificial Sequence
  Synthetic sequence.
SEVEDLLRRVRESSKEVEERIRKLNDELRKSTKEVEDRSRRSIERLDRIVEKVAREVERRDKELVSRIIKRVLEDVDRVNKEDKEIAEENKKEIDRVHEESRRIVEENKKLVDEALERIRRLPVDEKIVRDVEREVRRVKERSDRLLEEDRKSVEELKTRTDRLLEESSKRAEDIKRKLKELEK

SEQ ID NO: 25744 - protein, 184 aa, Artificial Sequence; identical to SEQ ID NO: 25743
  Synthetic sequence.

SEQ ID NO: 25745 - protein, 184 aa, Artificial Sequence
  Synthetic sequence.
SEVEKLLREAKESSREVKDRSKKSIDELRESTKTVERLIRDLNRKLKEILDRVADDMRRRDKELAERIIREVLKRVDDVHRESKKIADENKELLKRVNDRDREIVKRNDELLDEVLKRIRELPVDEKIVRRVEEIVRRLKKESKDLVEESTRVADELRRRTDRLVEEDERSVRKIKEDLDRLRK

SEQ ID NO: 25746 - protein, 184 aa, Artificial Sequence; identical to SEQ ID NO: 25745
  Synthetic sequence.

SEQ ID NO: 25747 - protein, 181 aa, Artificial Sequence
  Synthetic sequence.
SEKEEAKRRARELEKRTDELLEESTRVNEESKRHLKELLDESRRTAKRVKEEIDKLLKEKREGDRVEELVKELKKIIDEVLKRNEELIREAERIDDESNKRNEELARRDKEIIRELLRLVEEGVDVDTLLERVDRSSKEVADRMRKSNEEVKDVNRRVAKALKDSNRDVERVLEDVARKIK

SEQ ID NO: 25748 - protein, 181 aa, Artificial Sequence; identical to SEQ ID NO: 25747
  Synthetic sequence.

SEQ ID NO: 25749 - protein, 181 aa, Artificial Sequence
  Synthetic sequence.
SEKETARKVIEELRKETERLLRESTKTNEDSSRHAKELLKRSEDVAREIEERIDRLLEEKKDGDEVKRLVEELKKRVEELLRRNEELVRRLEEIDKRSNDENRKLAEEDKRRLEDAERRVEEGVPIEEVIKRLEDSSRDVERRLRKSNEDVKRVNKEVADRLKESNDRLREELKKVEDDIR

SEQ ID NO: 25750 - protein, 181 aa, Artificial Sequence; identical to SEQ ID NO: 25749
  Synthetic sequence.

SEQ ID NO: 25751 - protein, 181 aa, Artificial Sequence
  Synthetic sequence.
DEKEDAERKIRRLEERTKKLLDDSTKTNKESRDHLRKLLADSEKTARDIKRAIKKLLDDKKDGDEVRRLVEELKKIIDKVLEDNKRLIEEVEKIDKDSNDENRKLVDDDRRKLEEVRKLVEEGVDVDTLLTEVTDSSRRVEEELKRSNDEVRRVNREVAERLKKSNRELEEVLRKVAEDIK

SEQ ID NO: 25752 - protein, 181 aa, Artificial Sequence; identical to SEQ ID NO: 25751
  Synthetic sequence.

SEQ ID NO: 25753 - protein, 181 aa, Artificial Sequence
  Synthetic sequence.
SERERAEEEAKKAKKEAKRLLDESTKANEDSKRHADKLLEDSKRAAEDIKRKAEDLLRKKKDGDRARRLAEEARKIADKAVEDSERLAREAAKIDKDSNDESRRLAREAEEIADRALEAVDRGADARRAIEEVRRALKEAADASRDLNRRAKEANERAAKASEELNKRAEDALRRASEEIR

SEQ ID NO: 25754 - protein, 181 aa, Artificial Sequence; identical to SEQ ID NO: 25753
  Synthetic sequence.

SEQ ID NO: 25755 - protein, 181 aa, Artificial Sequence
  Synthetic sequence.
SEKEEVKKRVDEIKERLKRLLDDSTRTNEESRKHIEDLLEESKKEIDKVRKDLERLLRKKEEGDRVRELIKEIERILEKAVRDSKELVDRLRKIDEDSNRESKRLIEEVEEILDRALELVKAGVDVDTMTRKVEEVLRDVAEKIKELNRRVEEANKDMARESERLNREVRDVLRKVAKDIE

SEQ ID NO: 25756 - protein, 181 aa, Artificial Sequence; identical to SEQ ID NO: 25755
  Synthetic sequence.

SEQ ID NO: 25757 - protein, 181 aa, Artificial Sequence
  Synthetic sequence.
SDEDRAREDLKRIKEELKRLLRESTEVNKESEKHIRKLLRESEETIRRLKKAIDDLLRKKREGDEVERLVREAKTRLDEVLKRSKELVDTLREIDKKSNKDSRKLVRDAEEILDRALRLVEAGFDIETILRRLERVLKEVEKKSRELNRRVKEVNEKVRRDIERLNKEVKDVLKTVAERIT

SEQ ID NO: 25758 - protein, 181 aa, Artificial Sequence; identical to SEQ ID NO: 25757
  Synthetic sequence.

SEQ ID NO: 25759 - protein, 181 aa, Artificial Sequence
  Synthetic sequence.
DEKERAEERIRELKKRTEELLRESTRVNRESKEHAKELLKRSEDTIRELDERIRRLLERKKDGDRVRELVKEAKKRLKEVLEESEDLVRKLEEIDDESNRRSERLVREDERILREARKLVEDGVDVDTVLARLEESSKEVEDRSKRLNEEVKKVNEEVAKRIKELNEEVERVLRRVAEEIE

SEQ ID NO: 25760 - protein, 181 aa, Artificial Sequence; identical to SEQ ID NO: 25759
  Synthetic sequence.

SEQ ID NO: 25761 - protein, 182 aa, Artificial Sequence
  Synthetic sequence.
SLKEELREKVRKVKEDSERLLRDLERTVKKVREDSKRILDRNRETAKEIERRIRELERNGKISDEAVRRIEEVLKRVIELSERLLRRNEEVLKEVIKKVERMLRENERLLREVEREVDREKDNEELVRKLRKELDDSLKRTKELVDRLKEDLERSLRDSEELARRLDRELEDVLRRIEDEAR

SEQ ID NO: 25762 - protein, 182 aa, Artificial Sequence; identical to SEQ ID NO: 25761
  Synthetic sequence.

SEQ ID NO: 25763 - protein, 182 aa, Artificial Sequence
  Synthetic sequence.
SLLETLKEIVRRVERESARILEDNRRTVTRAKEESKKILDRNAKTVDDLRKEVERLKTEGKISEELAKEIERVLRDVLRLSKEALERNEKVLREVIETSERALRENRKLLKRVIEEVAREQDNEELVRRLVEELEKSLRTTERLARELDRKIKESLDTSEELARRLDKRLEEVLKDVKRRAE

SEQ ID NO: 25764 - protein, 182 aa, Artificial Sequence; identical to SEQ ID NO: 25763
  Synthetic sequence.

SEQ ID NO: 25765 - protein, 182 aa, Artificial Sequence
  Synthetic sequence.
RLEEELKKTVDRAREEVKRLLDRDRESVDDLRRAVEEILKTNRRTVEKLRKDLTDLRRNGKIDDELVKRIEEVLKRVERASREALRRIKEVLEEVERKSKKALDDIEKVLREVEDVVRKERDNEKLVRELIEKIKKVLDEVRRLSEKLNEDLREILERVKRLADKLDEELKRMLEKVEETAR

SEQ ID NO: 25766 - protein, 182 aa, Artificial Sequence; identical to SEQ ID NO: 25765
  Synthetic sequence.

SEQ ID NO: 25767 - protein, 187 aa, Artificial Sequence
  Synthetic sequence.
DDVERVKRDIDRLLEKVTRENEKVKEKMKELLDRAREVNRKVKEDIKRLLKEVEDVARREGGESERVVRRARKVVKDVEDLVREVHKLNEDIVRRAEELVRRLHRLNEEIVREIARLVEEVVRRRGEDTEDVRDLERRLREVEEEARKLSEDVRRVLEEVRKELERLSRDTERVLKRVREEIRKIEK

SEQ ID NO: 25768 - protein, 187 aa, Artificial Sequence; identical to SEQ ID NO: 25767
  Synthetic sequence.

SEQ ID NO: 25769 - protein, 187 aa, Artificial Sequence
  Synthetic sequence.
SEVEEVIRRVRKLLKDAKDLNEEVKRRLKELLDRVKRVSEKTKEDIKRLLEEVERVVRTKGGETEEVRRRIEDVVRKIRRLSEEIRRILEEVVRRAEELVRRLDELNRDIVRKVKKLAEDVLRSTGEDTDLAERVRDVLRRVAEAAKELSKDTKRVLDEVKKAIDELLKDNKRTVEEVEKEAKKTLK

SEQ ID NO: 25770 - protein, 187 aa, Artificial Sequence; identical to SEQ ID NO: 25769
  Synthetic sequence.

SEQ ID NO: 25771 - protein, 187 aa, Artificial Sequence
  Synthetic sequence.
DEVEKVKKTLKKLLEDARRRNEEVRKEIEDLDRELERLNRESKKRIEDLLEEVKRVVDRDGGEAEEVRRRIERVVEEIERLSREAAEMNRKVLEEIEELVDRLDRTNKKIVEEAKKLVEDVVRKEGEDTELVRELERVLDTVRREAERLSRKTREVVDESRRRNKKLLEEDERVVRKVVEDAERKLK

SEQ ID NO: 25772 - protein, 187 aa, Artificial Sequence; identical to SEQ ID NO: 25771
  Synthetic sequence.

SEQ ID NO: 25773 - protein, 187 aa, Artificial Sequence
  Synthetic sequence.
DEVKKVIDDIKDLLRRVEEVSRRVNKELERLLREVREVNKDVKRKLEELLRRVKEVVRRDGGESEEVKRIIDRIVEEAEELVRRVNRLNEEVVREAKELVDRSMKIIEKVVEDIERLVRELLRKEGEDTDLAERVRKVLEDVTRAAKELIKRDKKSLEDVKREIEKLSRDVKRVLEKVAEDAKDTLR

SEQ ID NO: 25774 - protein, 187 aa, Artificial Sequence; identical to SEQ ID NO: 25773
  Synthetic sequence.

SEQ ID NO: 25775 - protein, 176 aa, Artificial Sequence
  Synthetic sequence.
SEEEDLARVVERVERDLKRLDDDNKRVLDESRRRNEELVKRTAEIVERVRRELERLRREGRVSDEIVERVMREIEKLLRELERINRETIKRNKRLSEEASKINKEVTDRVRELLRDKSERVEEVKRTMEKLLDDVRKANEDSKREIEKSDDEVRKRNEEVVRDIERLLKEVEERAR

SEQ ID NO: 25776 - protein, 176 aa, Artificial Sequence; identical to SEQ ID NO: 25775
  Synthetic sequence.

SEQ ID NO: 25777 - protein, 176 aa, Artificial Sequence
  Synthetic sequence.
SEEEDLRRRAEEVHRRNEELLRDNERTVKKVHDRNRELLEDLRRVVERIERELRRLEEEGRVSEEEVRKVVETVRKLLKDVEKIVEDSSREVKRLSDEVREVVERSSREVKRLVEEKSSRVEEVKERIDRLHEELEKLSRTTKEKLKELHKRLEDVVREVKRRAEELLREIKERAD

SEQ ID NO: 25778 - protein, 176 aa, Artificial Sequence; identical to SEQ ID NO: 25777
  Synthetic sequence.

SEQ ID NO: 25779 - protein, 185 aa, Artificial Sequence
  Synthetic sequence.
SEVEEVRKVVEEVKRELRRLSEDSRRVVEEIVEADKRLSEKNETSVREVKKALKKLKDDGVVQEDVVTRVTEEIDRLLRESRESSRESVERIRKLLEDLERVSKEVLERLDRLLEDIERKLSDKDAEELVRDVIRRAREVLKRVEDVHRKVKKDLKKVHDDNKKISEDIDRRLEEVLRKVEEDDR

SEQ ID NO: 25780 - protein, 185 aa, Artificial Sequence; identical to SEQ ID NO: 25779
  Synthetic sequence.

SEQ ID NO: 25781 - protein, 185 aa, Artificial Sequence
  Synthetic sequence.
SEVEDVKRKVREIEKADEELSKRNEDSARESKKRLKEWSDDTKEVVERVRKRLKDLEDEGKVREEVVKRVKELLDELLDRLRKVSEEVLRRNDKLLKESRDSSRESVRRIRELLEDIRRKLEDEEAERLVREVTKEMKDVHDKNKKLSEDIDKRVEDTNRRLKEVHERVKEEAKKVVRDLEETAK

SEQ ID NO: 25782 - protein, 185 aa, Artificial Sequence; identical to SEQ ID NO: 25781
  Synthetic sequence.

SEQ ID NO: 25783 - protein, 185 aa, Artificial Sequence
  Synthetic sequence.
SLVETVEDVLREVEERLRKLLRDNEESVERIKKRDEDLSKENEESVKRVEDTLDELRERGVVDESVVKEVKRLVRELLKESRDSSKRSVEVVKELLDESRRVLKELKEEADKLVDRLRDLVDDERVEELVRKVIEDARRLLDDVRRKSERLDREAERVHRENKKLSEDLDRRVKTVVDDVRERAR

SEQ ID NO: 25784 - protein, 185 aa, Artificial Sequence; identical to SEQ ID NO: 25783
  Synthetic sequence.

SEQ ID NO: 25785 - protein, 185 aa, Artificial Sequence
  Synthetic sequence.
SLVEEVEKEARDIERRDDELSKRNEKVARDIEERDRRLSDEVREVVKRVKRELERLVESGEVDEDVVRRVLELLKEILEEVERSSKKSVDVVKKLLEESEKSSRDSVREVRRLLKEIRDKIDDKDAEKLVRRVIKDLRKLHKENEDLSREIDKRLEDAHKRNRDLVEEVKKRMERVREEVERAAR

SEQ ID NO: 25786 - protein, 185 aa, Artificial Sequence; identical to SEQ ID NO: 25785
  Synthetic sequence.

SEQ ID NO: 25787 - protein, 185 aa, Artificial Sequence
  Synthetic sequence.
KEKEDVKKVVEDIERADKKLSEDNRRVVKRIEEADRKLSKENKESVERAKKRLDDLERRGEVDRRVVTEVEKTLKEILERSERSSKRSREEVKRLLEESEDSSRRSVEEIRRLLKEIEDKLSREEAEELVRRVIKEMEEVHKRNRDLSKRLDDELKRIHKENEDRLRRLDEEIEKVVKKVEDDAR

SEQ ID NO: 25788 - protein, 185 aa, Artificial Sequence; identical to SEQ ID NO: 25787
  Synthetic sequence.

SEQ ID NO: 25789 - protein, 185 aa, Artificial Sequence
  Synthetic sequence.
SLVEELRKDVEEIKKRLKRLVEENEKVVREVTEADKKLSKELEDEARDVKRALEELRRRGEVDERVLRRVLEIVDELLERARESSRDSERVVRELLEESRRVVEEVLRRIEKLLEELERLISREEVEELVRRVREDMERVVREVEKVSRDLDREIRRVHRENRELIEDVKRKARKVLRDAEEEAR

SEQ ID NO: 25790 - protein, 185 aa, Artificial Sequence; identical to SEQ ID NO: 25789
  Synthetic sequence.

SEQ ID NO: 25791 - protein, 185 aa, Artificial Sequence
  Synthetic sequence.
KIVEDVEKVVKEVDDRLKKLVDDNERKVREIIRRDEELSEKNEKSVRDVKEELKRLAEEGTVREEVVRRVEEELRRLLEESRRSSDRSRKRVKKLLDDSRRVADRVREELERLLREVRKKADREEVEKLVREVIDRMRRVVREVEEMSKRLDEELEEVHRRNRETLTRIDEEAKKVVDDVDRRAR

SEQ ID NO: 25792 - protein, 185 aa, Artificial Sequence; identical to SEQ ID NO: 25791
  Synthetic sequence.

SEQ ID NO: 25793 - protein, 183 aa, Artificial Sequence
  Synthetic sequence.
SVRETLEEVLRRIAEAIDELIKTLEKVLEESRREIERWKKENEDSLREIKKKLEDLEKKIEDERVVRDIRRVLEEVRRLVEESKKILDEVVEDNERLVRELVKELEDVKRKVEELVRDVKRDNTEEKAKRALEEIKRLLERVKKRVEEALEEIKKSNKEAADIVRDIDRRLEELLRTVADKTR

SEQ ID NO: 25794 - protein, 183 aa, Artificial Sequence; identical to SEQ ID NO: 25793
  Synthetic sequence.

SEQ ID NO: 25795 - protein, 177 aa, Artificial Sequence
  Synthetic sequence.
DEVEEVIKTSREINDRVRRELERVLRRSEEIIEEVAKSIEEVIKESEDIIRKVEKDGDEEALRRAVEESTRLVEEVKRELEEVVERSTRLLEELVRILEEALRRSEELVRDLEARVDKEELKRKIRDVLRDDERAARKWVRDLEEVNKRTEDKIRELLRKLEEVNEKTERDIRRREK

SEQ ID NO: 25796 - protein, 177 aa, Artificial Sequence; identical to SEQ ID NO: 25795
  Synthetic sequence.

SEQ ID NO: 25797 - protein, 177 aa, Artificial Sequence
  Synthetic sequence.
EEVERVIEEIKKLLKDVAELVERVIKEIRKILDDVAKENKRLLDESRKIIKEVAERGDERMLEDAVRRSNELLKEADRINKEVLKRVRELVKEVERILRDVLRRVDELVKELEKRVDKEEVKRKIRKVLKEIKEEIEKLLKKLRDALRDVEEKIRDLTRRAREVNEKSREDLERRKD

SEQ ID NO: 25798 - protein, 177 aa, Artificial Sequence; identical to SEQ ID NO: 25797
  Synthetic sequence.

SEQ ID NO: 25799 - protein, 177 aa, Artificial Sequence
  Synthetic sequence.
DEVEDVIRRLEEIIREVEDRLRKILETSKKIIKEVEDENRRVVTEIERILREVEKRADERMLEKVLDDIRKLVEELDRINRKAVEISNRLLEKAKRILDEVLRRVTKLVEDLKDKVDKEELKRRIEEVLERLRRKIERLAKELKDVNDESEREARRLTEEVKRVLEEVARRIKEAAE

SEQ ID NO: 25800 - protein, 177 aa, Artificial Sequence; identical to SEQ ID NO: 25799
  Synthetic sequence.

SEQ ID NO: 25801 - protein, 177 aa, Artificial Sequence
  Synthetic sequence.
REVEEVRKKIEEDIDRVDKELKEVLETSRDILRRVAKENEDVLRDLERLVDEVRRDSDKDLLEEVLKRVEDLVRELDRKNKEVAERSTRLIEELAKILDDVLKRVEELLEELKRRVDKEELKKKLEKVVRDLSKRLEELLKELEKVNEEVKRRLERLTEEVRKVLEEITKKLKERAR

SEQ ID NO: 25802 - protein, 177 aa, Artificial Sequence; identical to SEQ ID NO: 25801
  Synthetic sequence.

SEQ ID NO: 25803 - protein, 177 aa, Artificial Sequence
  Synthetic sequence.
SKVEEVMRRLKEILKRVAEELEKVLTESEKILRDVADENRRVMEESRKILKDVAERGDEKALEDALRDSSRLVKDLDEKNRRVLETSTELIERLKKRLEEVLREVKELVDRLKKDVDKEEVKKKIDKVLEDVRKELDDLRRKLEEVNKRIEEEIRRLTEDVRRVNDEIRKRAEDRKR

SEQ ID NO: 25804 - protein, 177 aa, Artificial Sequence; identical to SEQ ID NO: 25803
  Synthetic sequence.

SEQ ID NO: 25805 - protein, 182 aa, Artificial Sequence
  Synthetic sequence.
SLREKADEVVKRIKERLDRLEDKSREVVKDSRRKLREWYEKSKRAVEDIETKLDELRKDLTDKKAEEILRKVKEDVKRVHEENERILRELKKITDKLHEENKKIIDDVKRKVEDVLRRVRDVDKDMVEELIRELEKIVTDVAKKVEDTIEESRKINEEVAKRVEDTIKRLEDILRDVARRVK

SEQ ID NO: 25806 - protein, 182 aa, Artificial Sequence; identical to SEQ ID NO: 25805
  Synthetic sequence.

SEQ ID NO: 25807 - protein, 182 aa, Artificial Sequence
  Synthetic sequence.
SLREKVDKVVEEIKRKLDKLLEDSERVVEKSERDLRRWLKEAEEVVREIEKTLKELEKRARDDRLRKIIDEVRKRVERVLEEVEKIIDELRKRSETVHRRNETIIRKVEEDVKRVRDRIERVDKDVVEDLIRELEEIVRRVAEEVRTTIEDLRKINDEVREKVKRLIEELKKILDDVAEEVR

SEQ ID NO: 25808 - protein, 182 aa, Artificial Sequence; identical to SEQ ID NO: 25807
  Synthetic sequence.

SEQ ID NO: 25809 - protein, 182 aa, Artificial Sequence
  Synthetic sequence.
SLEEKAREVVKEIRRRLDELLRKSHDVVREIEERLDKLEKESEDAVREIEKRLDELAKRITDERAKKILDEVKKEVRRLHEENRKILEEVKKEVRRVNDENRRIIERVKETVDDVLRKVSRVDAKVVEKLIKELRDILREVAERVERTIRRLREIVKRVERKVERSIEEMERIVREAEEETR

SEQ ID NO: 25810 - protein, 182 aa, Artificial Sequence; identical to SEQ ID NO: 25809
  Synthetic sequence.

SEQ ID NO: 25811 - protein, 182 aa, Artificial Sequence
  Synthetic sequence.
SLREKVDEVVKRIEKRLEELIRKSRKANEDIRKKLEELIKKSEDVVRKIKRELEELKRRVTEDEVKEIIERVLERVERVNEENRKIIEDVLRKSDEVDRRNKDILRRVRERVDEVLEEAKDVEREVVEDLIRELEEILRKVAEEVEDTIRRLEKILKEVAERVERTIKDLEDIVRDVAEKVK

SEQ ID NO: 25812 - protein, 182 aa, Artificial Sequence; identical to SEQ ID NO: 25811
  Synthetic sequence.

SEQ ID NO: 25813 - protein, 182 aa, Artificial Sequence
  Synthetic sequence.
SLREKVKRMVEEVKRELDELEKESNRAVERVERELEKLIRKSERVNERIRERLKELAARSTDKKVEKILRELKKLSDELDRTNKEIIDRLRKEVREVNDRNRKIIEDVEDFVRRAEDRLRDVEDKVVEKLIKEVRDIVKKVAEEVKKTIEDVERKVKEVAERVEDTIRRLDEAVKEVEERVR

SEQ ID NO: 25814 - protein, 182 aa, Artificial Sequence; identical to SEQ ID NO: 25813
  Synthetic sequence.

SEQ ID NO: 25815 - protein, 182 aa, Artificial Sequence
  Synthetic sequence.
SLREEAERVIREVREDLDRLRRESKKVNDRIRRTLDELRKRSDDAVRDIKEKLKELAKRTTDEKVKKILKDVEDEVEKVNRENREIIKELEKVSNDLDRRNKEILRTLKKLADEVLERVKDVDKDVVRELAERLKRLLEEVEKRVKDTIRELEKIVEEVRKRVEDTIRRLEEVLDKVAKEVT

SEQ ID NO: 25816 - protein, 182 aa, Artificial Sequence; identical to SEQ ID NO: 25815
  Synthetic sequence.

SEQ ID NO: 25817 - protein, 184 aa, Artificial Sequence
  Synthetic sequence.
SIEEELKKVLKEIEDRVRKSDKENKEASERIKRTVEELERRLREVLRRIEEAVRKLVREKGEETELVEEVRRLVEELRDRLRKVIEDIRDLVRRLVEHNKRVSDEVKRRVEELKRILEEVLRDSDEKKVKEVVDELRKLLRELEKLSEESNRKLKKLTDDIEKLVRDVEKELRKLLKELAEKIK

SEQ ID NO: 25818 - protein, 184 aa, Artificial Sequence; identical to SEQ ID NO: 25817
  Synthetic sequence.

SEQ ID NO: 25819 - protein, 183 aa, Artificial Sequence
  Synthetic sequence.
SVEERLKRVLERAREEIKRLLDELERVLEESRKEIKKLSEDLTRANEDTRREIEKLAREITDERLREILERVVRESTRLVEEVHRINEKVLRDNTRLVDEVRKILEEALKRVEELIEELRRVDDERIVKKVEEEIEELVRRVEKRVREVKKRMEDSNREVRKANEEVKKRSEDLLRKVRRDAE

SEQ ID NO: 25820 - protein, 183 aa, Artificial Sequence; identical to SEQ ID NO: 25819
  Synthetic sequence.

SEQ ID NO: 25821 - protein, 183 aa, Artificial Sequence
  Synthetic sequence.
RVRDELREVLRKAREDIKRLSDKMREVLRESEEKIKRLSDDLRRVNEETKKEIDRLRKEIDKEELKEILKRVVEESTRLVEEANRINREVLRRNEELIREVDRINKEALEEVERLVEELKRVDKKEIFRKVEKEIEDLLEEVRDVNRKIEEEARRSNEDVERVNREIKKRSEELLRDVEKKTE

SEQ ID NO: 25822 - protein, 183 aa, Artificial Sequence; identical to SEQ ID NO: 25821
  Synthetic sequence.

SEQ ID NO: 25823 - protein, 183 aa, Artificial Sequence
  Synthetic sequence.
SVREELKKALDRVRESIRRLSEELREVLERSEDTIRRLVEDLERVNEETRREIEDLARKIRDDRLRRILEEVLKESTRLVEEVKRILKRVLDENRRLVEEVDRINKDVLREVRRLVEELRRVDDERIMKEIEKRIEDLEREVKEVNREVIERAEESNRRVEELVREAKKRSRELLKRVREEAK

SEQ ID NO: 25824 - protein, 183 aa, Artificial Sequence; identical to SEQ ID NO: 25823
  Synthetic sequence.

SEQ ID NO: 25825 - protein, 183 aa, Artificial Sequence
  Synthetic sequence.
SVREDLERALRRAAEEIEKLSRDLKRVLEESRKNIERLRRDIERMNEETEKEIRRLAREIDKEELKRILEEVLKRSTELVKRLTEILKRVLDTNTKLVEEVDEINKRVLDEVRKLVERARRVDREEDAEEIKTRIKELIDRVRRVNEEVKERMKKSNEEVEEVVRRVKEESKRLLERVEEDVR

SEQ ID NO: 25826 - protein, 183 aa, Artificial Sequence; identical to SEQ ID NO: 25825
  Synthetic sequence.

SEQ ID NO: 25827 - protein, 183 aa, Artificial Sequence
  Synthetic sequence.
SLREDLRRVLERARDELRKLSKELKEVLKRSRDNIRKLSEDVKRANERTEEEIRRLTKEIDKDELREILERVLRTSTELVKELNKRNRDVLRENERLVREVDKINKDAAREVTKLVEELDRVDKDEIFKRVKKEIKELVDRVREVNKDVIRRMKKSNDEVKRENEKVIRESEKLLKDVEDARR

SEQ ID NO: 25828 - protein, 183 aa, Artificial Sequence; identical to SEQ ID NO: 25827
  Synthetic sequence.

SEQ ID NO: 25829 - protein, 183 aa, Artificial Sequence
  Synthetic sequence.
SVRERLEKVLKEVEDSIKELSDDLRRVNKRTEEEIRRLAEDLERVLERIEREIRKLAKEIDKDELREILKRVLEEVERLVREVKEILRDVVRRSSELVERVDKINKDVLEEVRRLVEELRRVDKEEIAERVERTIRKLEDDVRKVNEDVKRRSRELLERVARLVERVKEEAEKLLEDVKRKAD

SEQ ID NO: 25830 - protein, 183 aa, Artificial Sequence; identical to SEQ ID NO: 25829
  Synthetic sequence.

SEQ ID NO: 25831 - protein, 183 aa, Artificial Sequence
  Synthetic sequence.
SLREDLERVLEEIERELKELSDDLRRMNEETEREIRKLSDDLRRALEKIRDEIRKLAEEIDDKRLEDILRKVLREVEELVKEVNRINREVLRRSSELVKRVDEINKKVLDDVRKLVEELKRADKEEIFRKVKEEARRLVREVEEVNKEVKKRSRDLLREVRKVNEDVKREIERLLRKVAKDAE

SEQ ID NO: 25832 - protein, 183 aa, Artificial Sequence; identical to SEQ ID NO: 25831
  Synthetic sequence.

SEQ ID NO: 25833 - protein, 183 aa, Artificial Sequence
  Synthetic sequence.
SMREDLRRVLEEAEKKIRKLSKEAKDANRETEKEIRKLSEDVKRVNKESKDEIDRLAEEITDDRLRKILEKVVRESNRLVERLNRINRKVLKESSELIKEVDEINKKVLRDVEKLVEDLKRVDKKEIAEKVKREIEKLVRDVERVNREIIERSEKLLREVREENERVKRESRRLLKEVEKAAE

SEQ ID NO: 25834 - protein, 183 aa, Artificial Sequence; identical to SEQ ID NO: 25833
  Synthetic sequence.

SEQ ID NO: 25835 - protein, 183 aa, Artificial Sequence
  Synthetic sequence.
SVRETLKKVLEDVRRELKKLSDKLRKVLEDSRRNVKRASDKLREVLKRVKEEIERLRREIDKKELEEILERVLREVKKLVEDVNRINRKVLKENTDLVREVDDINKRVAEEVDELVERLKRVDKEEIAKRIIEEIKKLLDRVREVNEDVIRRMKKSNEDLDRRNEEVRKRIEDLLEKVARDAK

SEQ ID NO: 25836 - protein, 183 aa, Artificial Sequence; identical to SEQ ID NO: 25835
  Synthetic sequence.

SEQ ID NO: 25837 - protein, 185 aa, Artificial Sequence
  Synthetic sequence.
SLEETAKEVIERSEDHLRRLEETNRKVVEDSERHLDDLTRRIKKVVEDIKKRLDEIEKRGEVDERVLRTLAKKVEDLLRRVEEVVRRVKERTRDHLRDSERVLRELLELSKRILERVRRKSSDERAEELLRTVVKEIEDANRRVEEVSRKNTEDIKEWNKRLEEELRRVVERARRELKKVEDAAR

SEQ ID NO: 25838 - protein, 185 aa, Artificial Sequence; identical to SEQ ID NO: 25837
  Synthetic sequence.

SEQ ID NO: 25839 - protein, 185 aa, Artificial Sequence
  Synthetic sequence.
SLEETAKRVIEESRKHLDRLRRENERVVKEIRDALRELEKKVEDVVRRIAEELERIRKEGKVPEDVVREVRKTVEKLLRELEDVIRRLKELVDRHLEDSERVVREVKRISDRLLEEVKRKSSREEAEDLLRKVIEDIKELNRELERVSRKNIEDLRRWLEEVREMVKRVEEKAKRVLEELREAAK

SEQ ID NO: 25840 - protein, 185 aa, Artificial Sequence; identical to SEQ ID NO: 25839
  Synthetic sequence.

SEQ ID NO: 25841 - protein, 185 aa, Artificial Sequence
  Synthetic sequence.
SLEETIEKVVERSKRNLEKLRREIRKVVKESDENLKDVERRAREVVEEIKKALEDIRRKGDVDERVVEEVKRDVDRLEREVKRVLDDLRRVTEELLKRVEDMVRRVLEVSEKLLKEVKDKSSREEAEELLRKVIKESEDLNRRLREEVKKVVREIEEANKRVNDTVRKMEEALKKLLDDLREKAR

SEQ ID NO: 25842 - protein, 185 aa, Artificial Sequence; identical to SEQ ID NO: 25841
  Synthetic sequence.

SEQ ID NO: 25843 - protein, 185 aa, Artificial Sequence
  Synthetic sequence.
SLEEDMKRVVDESRRNLERVEKENRDVVKESRDNLKKVEDDIRKVVKDIRDELEKIRKRGEVDETVVKRVMDTVRELLKEVKRVIDEVRRRTDEHLKHSKEVVERVLKISEDLLREVEKKSSREEAEELVRRVKETSKRVNEELDKTAKKNVDDIKDWNRRVNEKVKKVKEDAERVLRELEETAR

SEQ ID NO: 25844 - protein, 185 aa, Artificial Sequence; identical to SEQ ID NO: 25843
  Synthetic sequence.

SEQ ID NO: 25845 - protein, 185 aa, Artificial Sequence
  Synthetic sequence.
SLEETITKVVEESKKNIDRLLEEVRKVVEDSRRDLDRVIDEARKVVEKIDRELKRIEKRGDVDKRVVEEVRKEVKELLDRVREMLERVKRVSDKLLEDLRRLAEEVKKLSTDLLEEVRRKSSREEAEELVRRVKKRSEDVNKKLDEDVEEMKRRSEKLNKDINKDVDRVRKRLEEVLKRLREAAK

SEQ ID NO: 25846 - protein, 185 aa, Artificial Sequence; identical to SEQ ID NO: 25845
  Synthetic sequence.

SEQ ID NO: 25847 - protein, 185 aa, Artificial Sequence
  Synthetic sequence.
SLKDEIKKVVDDSRRNLEEVKKEITRVVKESRERLEELERDIERLVEKVTRELDRIEEEGRVDSKVVRKVKELIKRLLEEVREVIERLRRRTEKLLEDVKRVVEEVLKVSEKLLRDVERKVSREEAKELVEEVIRRSREVNRDLNRRVREVEKESRDANERVKRRVEEVKRRAREVLERLKKAAE

SEQ ID NO: 25848 - protein, 185 aa, Artificial Sequence; identical to SEQ ID NO: 25847
  Synthetic sequence.

SEQ ID NO: 25849 - protein, 185 aa, Artificial Sequence
  Synthetic sequence.
SLEEDAKRMVDTNEDRVREWERKIDKVVKDSEKRLRELREDAERMVREIKKELEKIRTEGRVPKEEVKKVLDRVDELLERVEEVVRRVLRVTEELLKEVKRVLKENKEILDRLLKEVTDKSSDERAEELVRRLKKASEDSNEKVARLIEEVIKRSKDVNDDLERDLREVKKRLKDVLKRLKEKAK

SEQ ID NO: 25850 - protein, 185 aa, Artificial Sequence; identical to SEQ ID NO: 25849
  Synthetic sequence.

SEQ ID NO: 25851 - protein, 185 aa, Artificial Sequence
  Synthetic sequence.
SLEEDAKRAVEESKRTLRELEEENKKVVEDIRRALRRLEEDIKRVVEEIRRELDRIRREGRVDERVLRDVKRLVDELLERVREVIKELEELVKRHLDHSKTVIDRVDEITEELLKDVERKSSDERAEELVRRVKKTIEDVNRKVAKVVKENIKRLREWLKRVEERLKEVKDRLRKVLEDVERAAK

SEQ ID NO: 25852 - protein, 185 aa, Artificial Sequence; identical to SEQ ID NO: 25851
  Synthetic sequence.

SEQ ID NO: 25853 - protein, 180 aa, Artificial Sequence
  Synthetic sequence.
DVEEDVKRVADDNRRELERWRRDVKKVADEVKDRSRKLERDVERRIREIEKTLEDLRREGLDERVIETLARILKRLLDEVKKLLKDNERVVDRVLTEVDELIRRNEESVRRILEDVKKDRTKEVVKRLKEESKKSNEDVARRVEKLKEELERSTREVERAVRELKKELDEVVREVKERAK

SEQ ID NO: 25854 - protein, 180 aa, Artificial Sequence; identical to SEQ ID NO: 25853
  Synthetic sequence.

SEQ ID NO: 25855 - protein, 180 aa, Artificial Sequence
  Synthetic sequence.
SIEERLDKLLRDVKRALEELEERIRRSNKRLREAVEKLKKEVEDSNRELDKAVKEVLRRKDEEKAKKLAEAVKRSLDKTRKLVEDVARAIEESLKRVEEIVKRVLKAIEEILEEVRRKVRTEEAVRTAADLLRRVLERVKRLAEELHRHNKEVLDEARKIARDLHRLNEEVLRRVEEATK

SEQ ID NO: 25856 - protein, 180 aa, Artificial Sequence; identical to SEQ ID NO: 25855
  Synthetic sequence.

SEQ ID NO: 25857 - protein, 180 aa, Artificial Sequence
  Synthetic sequence.
SIEEDLKRLLDEVRKRSKDLKEEVKRSNDRVREDLKRLKEEIDRLLEEARRRLEEIIRRKDREEVKKLLDKIEKVLREVEETVKRLEEDIERSLKKSEELVERALKHDEDVLEDVERRVRDKELVDRARDKIRESLRRSEKIIEELHEHNKDALRRVREEIKRLKDKLKKVVEEVERATR

SEQ ID NO: 25858 - protein, 180 aa, Artificial Sequence; identical to SEQ ID NO: 25857
  Synthetic sequence.

SEQ ID NO: 25859 - protein, 178 aa, Artificial Sequence
  Synthetic sequence.
DSVERVKEESERTNREIAKLSKKVEDETRKVLKDLEDISRDTERRSREVLERARRDKDKDLLEKLLRDLTETHKEVIKTLEKLLEEVKRIHDRTVEEARRLLEESERIVRKVIKETGEEAELVRELEEVVRENEERVRRLIERNKKLVDDARKRVEELVRRNDKIVKEIEKVVRDIKT

SEQ ID NO: 25860 - protein, 178 aa, Artificial Sequence; identical to SEQ ID NO: 25859
  Synthetic sequence.

SEQ ID NO: 25861 - protein, 178 aa, Artificial Sequence
  Synthetic sequence.
KSDEEVEKLIREVLKRIEELSREAEKLTDEVRKLLKEISDRVEERSRDVLDKIRRTNDEEVIRRLITELEKEHEEVMRELDRLLKELEDIHRRTIELAKRLLKKVEEIVEKVIREEGEEAELVRKLEKLLEDAERRVRELVKRNKEVVERVKRTVDELKARNKKIVEEIKKVMEEITR

SEQ ID NO: 25862 - protein, 178 aa, Artificial Sequence; identical to SEQ ID NO: 25861
  Synthetic sequence.

SEQ ID NO: 25863 - protein, 178 aa, Artificial Sequence
  Synthetic sequence.
RELEEVEKKVRTVLEEVRRISEKAEELSRRVLEEARKISEDNEREVRRVVEDVRRENDRELLKKLLEEVRRSSEEVIKRLEDLLRKLEEEHKRVIDKLKDLLRRVREIVEEVIRRTGEEADLVERLKELVKKVEDEVRRLVKRNKDIVDDIRRRVEELVRRNKRITDEVRKEADKLRR

SEQ ID NO: 25864 - protein, 178 aa, Artificial Sequence; identical to SEQ ID NO: 25863
  Synthetic sequence.

SEQ ID NO: 25865 - protein, 188 aa, Artificial Sequence
  Synthetic sequence.
SELEKVKKEIRELLEEVRKISKESEDRSRKSNDELHKSSEEVEKRIRDLLRELEKIVRELKDGDRETVVRVLDRVVEEVRRIVEEDKRRIEEVLKRDKKLVEESVRLIEKVVRDIEEIVKELERRLREKKDVVKELREVLERAEREARKLIKRNDEILKESEKNARDLIRRTEELLRRAKKRVDELKK

SEQ ID NO: 25866 - protein, 188 aa, Artificial Sequence; identical to SEQ ID NO: 25865
  Synthetic sequence.

SEQ ID NO: 25867 - protein, 188 aa, Artificial Sequence
  Synthetic sequence.
SDVEEVKKEIARLLEELKRTTDKVKEDSDRSNEEVHRSSEKVKKDIEKLLDELRKVVEELKDGSREEVERLLEEVVRRVKKIVDEDKKKLDDVAKRDEDIVRKDVEELKRVVEEVRRIIAEVKRRLKDLREVVKELEDVLKRAEEVVERLEEKTRRILEESRKNIERLKRETEEMLKRAEDEVKKLKD

SEQ ID NO: 25868 - protein, 188 aa, Artificial Sequence; identical to SEQ ID NO: 25867
  Synthetic sequence.

SEQ ID NO: 25869 - protein, 188 aa, Artificial Sequence
  Synthetic sequence.
SLVDRVRELIERLLRRLEEIVREVEERLRRSNERLHESSADVERLIRELLERLRDIVRKLEKGDREKVKKVLKEVVEEVRDIVRRDRELLDKVVEENADIIRRVVEELRRVVEEVEKIVRDVKTKLRKDEDVVRELEELLRRAKERVDELKKRLEELLKESREDVERLKKKTDEALKRAEEEVEKLRK

SEQ ID NO: 25870 - protein, 188 aa, Artificial Sequence; identical to SEQ ID NO: 25869
  Synthetic sequence.

SEQ ID NO: 25871 - protein, 188 aa, Artificial Sequence
  Synthetic sequence.
RDLEEVKKRIDELLKRVRETTKRVEDELRRSNKELHESSRRVEEEIKKLLEELEDVFRKVKDGDRERVKELADRIVEEVKKIVDEDVERLERVVDENRKIVDTDRRDLDRVVEEVTRIVEELKRRLKDKEELVRTLEDMLRRAREEIEKLKEKTRKLLEDSERDVKRLIERTTEVLKRARERVEELKK

SEQ ID NO: 25872 - protein, 188 aa, Artificial Sequence; identical to SEQ ID NO: 25871
  Synthetic sequence.

SEQ ID NO: 25873 - protein, 188 aa, Artificial Sequence
  Synthetic sequence.
SELEEVKKRIDDLLKRLRDIVDTVRKELRKSDKELHDSSKRVEEEIKKLLEELRRIVETLKKGDREKVTRMLREVVRRVREIVKRDVEELKRVVERNAKIIEDVERELKEAVDRVREIVKELERRLKDLREVVETLRRVLKRAEDDVRRLLEELRELLERSKRNVERLIERTKELLKRAEDEVKKLED

SEQ ID NO: 25874 - protein, 188 aa, Artificial Sequence; identical to SEQ ID NO: 25873
  Synthetic sequence.

SEQ ID NO: 25875 - protein, 188 aa, Artificial Sequence
  Synthetic sequence.
SLLEKVEEEVRRLLKRLRDIVEEVRRLLEESNERAHRSSKKVKEDIDELLKELEDVVRRVKKGDEEAVRRLLDEVVKTVEEIVRRDVELLREIVEENERIIRKVEEELKRVVEEVRRIVDDVRRKLKDNKDLVKTLEDILERAEREVKKLEDRLRKLLEDSKRNAEELIKRTEDVLEEALRRVEELKK

SEQ ID NO: 25876 - protein, 188 aa, Artificial Sequence; identical to SEQ ID NO: 25875
  Synthetic sequence.

SEQ ID NO: 25877 - protein, 178 aa, Artificial Sequence
  Synthetic sequence.
SEAERVREILKDAEKKIRDILRRLREINRESARRIEDIKRKLDEILKRNEDDVRRLEKDGADKEILKRALERAEKSVRELRDILKKVLDESSRLVKELEKILRDLLDEVRRLVEEVEKRGDGVEDAERTVRELIKRVEEALERAERASRELIKTVEKVLEEVERRNRKSNEELKEATR

SEQ ID NO: 25878 - protein, 178 aa, Artificial Sequence; identical to SEQ ID NO: 25877
  Synthetic sequence.

SEQ ID NO: 25879 - protein, 187 aa, Artificial Sequence
  Synthetic sequence.
SLEEEAKELVKRVRDELRKIERTIEKIVEDSRRRLEENRKRNKELIERVEKELRELKKRVTDERIKKVVRDVLEKARKLLEESEEMVRRVERISERTLRTVREVVKEVEKIVEKLLEDVKRKSSDERARDILREAKKMLEKVLRDLRRVLEELRKENEKVLRELEEISKETEDRLREVLRELRERTR

SEQ ID NO: 25880 - protein, 187 aa, Artificial Sequence; identical to SEQ ID NO: 25879
  Synthetic sequence.

SEQ ID NO: 25881 - protein, 175 aa, Artificial Sequence
  Synthetic sequence.
SVEDEVREVAKKIRRILEKLKRELDRHSKKIEDILEEIRDKNEKAKEEIEEVLRRRLDEEIKREVKRLEERLDEVSDKTRRAVEELIRNNERVVREVERVVRELIEILKEVLRKGGKEDVERVKRELEKVLRELAEEVRESLERVSEVAERLKRENDEVNDRLKKMLEDLLRKAT

SEQ ID NO: 25882 - protein, 175 aa, Artificial Sequence; identical to SEQ ID NO: 25881
  Synthetic sequence.

SEQ ID NO: 25883 - protein, 175 aa, Artificial Sequence
  Synthetic sequence.
DEVEEVIRRVEESNKRVNEENDRVVRESKEIVRKVEEDNRRAIKESEEMLDRVAKDRDRDKLRDVLRRLKELHRRTIETTKEMADRIRKLHEETIRRTREVLERNRRLAEDVLRRVPNVEEDLRRVVDKSRKNVEEVERKNRDVLRRIDKRAKELEDRNREVLKKIEKTIRDLEK

SEQ ID NO: 25884 - protein, 175 aa, Artificial Sequence; identical to SEQ ID NO: 25883
  Synthetic sequence.

SEQ ID NO: 25885 - protein, 175 aa, Artificial Sequence
  Synthetic sequence.
SEVDEVIRRVEKSNKDVNDENKRVIDRSKELNREVNERNKEAIKRSRDLADEVRRDRDRKKAEEMVRRIEELHRETIKRTKEVNEEIERLHRETIKRTREVLDENRRLAERVVREVPNVEERLREVVKRSEDNVRKVEEDNRRVLEESTRNVKEVKERNEKVLEEIRKTLEDLER

SEQ ID NO: 25886 - protein, 175 aa, Artificial Sequence; identical to SEQ ID NO: 25885
  Synthetic sequence.

SEQ ID NO: 25887 - protein, 175 aa, Artificial Sequence
  Synthetic sequence.
SEVDKVRKELEDMAREIEKRAEDVIREIKRSNEEVNRTNEKVIRDSERMLEKAERDRDREKLRRIVRTLEKLHEDTIEFTKKVLERNKELIKKIAEELRRVLKELTERIKDVLRRVPNVEERLDRVREKLERIVREIEDRLRKVLEDSRRNVEEVRRRNEEAVKKIRRILEELER

SEQ ID NO: 25888 - protein, 175 aa, Artificial Sequence; identical to SEQ ID NO: 25887
  Synthetic sequence.

SEQ ID NO: 25889 - protein, 175 aa, Artificial Sequence
  Synthetic sequence.
DEVDDVIRDVDRTNEEVERENRRVIEEVRKSNEEVNKKNADAEKRSREMAERAAEDRDRRKIEEILERLKDLHKRTIETTREVLKRNEDLMRRTIEDTRRVLRENEEKLRDVLRRVPNVKEKLDRVLERSKKTVEELEKRNREALDRSRRNVEEVEKRNREVVKEIAERVRRLKK

SEQ ID NO: 25890 - protein, 175 aa, Artificial Sequence; identical to SEQ ID NO: 25889
  Synthetic sequence.

SEQ ID NO: 25891 - protein, 175 aa, Artificial Sequence
  Synthetic sequence.
SEVDKVVEDVKRMLKEVEDRNEKVIRDVEKMLREVEEKNKRVIEDSERVAKEAADDRDREKVRRLLERIRELHERTIKETRDVARELAKLLEDTIRFTRKVLRELEELLRDVLRRVPNVKEKLDKVLEEIREIVKRLEDRNREALRRIKEIVDRLEKRNRKVVEDVERIVREIER

SEQ ID NO: 25892 - protein, 175 aa, Artificial Sequence; identical to SEQ ID NO: 25891
  Synthetic sequence.

SEQ ID NO: 25893 - protein, 175 aa, Artificial Sequence
  Synthetic sequence.
SEVDEVIKRIEETNRRVEEMNKDAIRRVKESNKRVEERNKEVIERSKKLIDDVRRDRDRKKLREVLERIKDLHRRTIEDTRRVLKDNDELVRRTIEKTRRALERNKELIDRVLKRVPNVEERLRKVLKDSERTVKELEKRNRRVLEESDKEVKRLEKENRDVVDEIRERAKEIER

SEQ ID NO: 25894 - protein, 175 aa, Artificial Sequence; identical to SEQ ID NO: 25893
  Synthetic sequence.

SEQ ID NO: 25895 - protein, 175 aa, Artificial Sequence
  Synthetic sequence.
SEVDKVITELEKMLRRVKEENKRVIDESRRALEEVEKRNREVIERSDEMARRAAEDNDRRKIREILKTLKRLHEEAVEDTRRVLERLRRLHEKTVRDTKTVLDRLRELIEDVLRRVPNVEERLREVLERIARRVRELEERNKKVVKEIEERVRELERRNREVVKKIEEKVKRLET

SEQ ID NO: 25896 - protein, 175 aa, Artificial Sequence; identical to SEQ ID NO: 25895
  Synthetic sequence.

SEQ ID NO: 25897 - protein, 175 aa, Artificial Sequence
  Synthetic sequence.
DEVRKVIKELRDELRRVEELNKEVIDRSRKLVEDIARESKEVIERSRKLLDDVRKDRDREKLERVLDEIRRLHEDVLRKIREVVRTIEELHRDAVRKSKEVLKRLEELIRDVLRRVPNVREDLERALKEIEETIRRLEKRNRDVLKEIEDEARRLEEENRKVLKEARKIVEDIKT

SEQ ID NO: 25898 - protein, 175 aa, Artificial Sequence; identical to SEQ ID NO: 25897
  Synthetic sequence.

SEQ ID NO: 25899 - protein, 175 aa, Artificial Sequence
  Synthetic sequence.
SEVDDVTRKLERILEELTETSERVVRTSRRVAEELEKRSKEAVERSRKLAEEVARDRDREKLRRVLKEIEKLHRDTVKDLRDALKKIEDDHRRVVEKLKKALEELERLIRRVLREVPNVREKLERVLEEIRRRIEELSEKNRKVVKDIREIVRKLTERDEKVVREIKKIVDDIET

SEQ ID NO: 25900 - protein, 175 aa, Artificial Sequence; identical to SEQ ID NO: 25899
  Synthetic sequence.

SEQ ID NO: 25901 - protein, 175 aa, Artificial Sequence
  Synthetic sequence.
SEVDEVTREVEELIREVEKLSEDVIRTSKELAKRAEKLSREVIKRSEELIDEVRRDRDRRKLDEVVKRIEDLHRRVLEELERIVREIEKLHRETVKRLREVLERVRRLLEEVLERVPNVKKKLEDVLREIAKKVREIEERDRKVVEEIREILKRLEDENREVLKKIRRIAEEIRR

SEQ ID NO: 25902 - protein, 175 aa, Artificial Sequence; identical to SEQ ID NO: 25901
  Synthetic sequence.

SEQ ID NO: 25903 - protein, 175 aa, Artificial Sequence
  Synthetic sequence.
DEVRKVIKELEDRLREVEKKSKDAIDTSREMLKRVDDENKDVKRRAEEILKRVDEDRDRKKLRDVLRELERLVRETIKSSKEVLDRLRKLHEDTVRDLRRILKELKELIDDVLRRVPNVEEELRKLLEDIREKVERIVKRDEDVVREIEEEARRLADENRKVLEEIERIIRELER

SEQ ID NO: 25904 - protein, 175 aa, Artificial Sequence; identical to SEQ ID NO: 25903
  Synthetic sequence.

SEQ ID NO: 25905 - protein, 178 aa, Artificial Sequence
  Synthetic sequence.
REVDEVTRRIKELNDELERRVRRAKERIEELNKRVNREDEEIVDRVRKLNDELAKDNKRELVDEVLKETEKLIRRSEESVRRVLEETEKLIETLRREVEKVLRETERLIKEVVERRKDDEDVKRKLKEVVDESRRTVDEIRRELERVVEKSRKNIEEVKKHTREVLKRSEETARELKK

SEQ ID NO: 25906 - protein, 178 aa, Artificial Sequence; identical to SEQ ID NO: 25905
  Synthetic sequence.

SEQ ID NO: 25907 - protein, 178 aa, Artificial Sequence
  Synthetic sequence.
SEVDRVLEEIRKLNEDLNRRVDDATRKIRDLNRKLNEDVKKVTEDIKKLNEDLRKDNKKELVREVLKRTRDLIRELEKIVTDVLRTTEEVIKRLEREVEKVLRDTRELARDLLRKRKDDEEVKRKLEKLVRESERNVREVKKKLDEVRKESKTNADKVREELKRVVEESERTVRELEK

SEQ ID NO: 25908 - protein, 178 aa, Artificial Sequence; identical to SEQ ID NO: 25907
  Synthetic sequence.

SEQ ID NO: 25909 - protein, 178 aa, Artificial Sequence
  Synthetic sequence.
SEVDEVEKDIERLLEELRERVKRVTDEIRKLNKELNETDTDIVRKIRELLERLERDNKRELVREVLKRVKELADDSKRRVDKVLKDTERLIRELEKIVDEVEERVRRLVAEVLKRRKDDEEVKRRLEEVLRKVKRELDRIRDELRRVVEESETNVRDVRRHTEEVVKEVEDEVRRLEK

SEQ ID NO: 25910 - protein, 178 aa, Artificial Sequence; identical to SEQ ID NO: 25909
  Synthetic sequence.

SEQ ID NO: 25911 - protein, 178 aa, Artificial Sequence
  Synthetic sequence.
SEVEELERRIRELLRRVKRIDEEIVRRIRELNKELNRRDERIVETVRELVERVARDNKRELLDEVLKDVRRLAEESKRIVDEVLKDTERLARESKEILERVLKEVKELIEELLRRRKDLEEVKKRLEDVLRRVREEIERLKKHTDDVLRESEKNAEDVKKHTDDVVREIEERIRELKK

SEQ ID NO: 25912 - protein, 178 aa, Artificial Sequence; identical to SEQ ID NO: 25911
  Synthetic sequence.

SEQ ID NO: 25913 - protein, 178 aa, Artificial Sequence
  Synthetic sequence.
SEVEEVIKEIEKLNEDVNRIDKEIVKRIRDLNREVNERDKEIVKEIKRLVEEVRKDNKRELVDEALERVKKLAEDSKRIADDVLRRTEKLLRESKKILEDVNRTVRRLLEDLMRKRKDLEEVKDRLRKVLESSSDNVRRVTEHTDKVLEESRKNIEDVKKHTDEVVKEIEKEVRELKK

SEQ ID NO: 25914 - protein, 178 aa, Artificial Sequence; identical to SEQ ID NO: 25913
  Synthetic sequence.

SEQ ID NO: 25915 - protein, 178 aa, Artificial Sequence
  Synthetic sequence.
DEVKEVIRRAEKLNEKINDILRRVEEEIRRTLDEVRRRDEKIVKEIRDLMRELSEDNKRELVKKVLEEVERLARKSVEIIREVNKRNEDLIREVKRIADEVLKRTRDLVKDVRDKRKDDEEVKRELEEVVKESEKNIREVTDRLRKVLEESTKIVEELEEHTKRVVDEIRKRADELRR

SEQ ID NO: 25916 - protein, 178 aa, Artificial Sequence; identical to SEQ ID NO: 25915
  Synthetic sequence.

SEQ ID NO: 25917 - protein, 184 aa, Artificial Sequence
  Synthetic sequence.
SLEEEIDRVLDEIRRIIEEIKKHTTEVLEESKRNIEEVKKHTDEVNEKSRRDIEKIKREVRDKERVVELLDRVVKTSEDLARESKRILDEVLDTSRRLVEDSRRILDDVLRRVRELAEELKRVKDKEKVRKVIEEIKKIAEDVARRDKEMVDRSREINKKVNEEDKKIVEDSKRIIEDVKRKTD

SEQ ID NO: 25918 - protein, 184 aa, Artificial Sequence; identical to SEQ ID NO: 25917
  Synthetic sequence.

SEQ ID NO: 25919 - protein, 184 aa, Artificial Sequence
  Synthetic sequence.
SLEKEIKDALDRIKKDIEDSARRTKEVNDKSKEIIDRLKKHTDDVNDESRRRIKEIKDEVRDKKRVTELLEEVKERSKRLAEESKKILDEVVKKSRELAKRSKEILDEVLKRVAELAEELKRVSDKRLVKEVIDRLDEIVEDVKRRDEEIIRTSEKLLRDVARLDEEIAKRSRDLLRDVERKVK

SEQ ID NO: 25920 - protein, 184 aa, Artificial Sequence; identical to SEQ ID NO: 25919
  Synthetic sequence.

SEQ ID NO: 25921 - protein, 184 aa, Artificial Sequence
  Synthetic sequence.
SLEERLKKVLKEVDERIREIKKHTDKVNEESRDKIRKLKEELDRVNRESEEEARKIKSEVRDKERVVRTLKKAVEDSKKLIDDVKRILDEVVKRSEELVERSKRILDEVKRDVRRLIEELRRIEKDKDVRDVEEEIRKLLDEVRKLDEEMVERSKKLARTVERLVKEVIRESKEIIRKVKEETD

SEQ ID NO: 25922 - protein, 184 aa, Artificial Sequence; identical to SEQ ID NO: 25921
  Synthetic sequence.

SEQ ID NO: 25923 - protein, 184 aa, Artificial Sequence
  Synthetic sequence.
SLEEEIERVLRKVEKEIRKIKERLDEMLKEIRERIERSKRRTDKVNEDSRRRIEEIKRRVKDKKEVLERLDEVVRKSEELARRSKEILDRVLETVERLIRRVKEILDRVLDEVRKLAEELKRVDSKEDVKKVKKDIDKLLKEVREEVKEAEDRIRRIAEEVDKEDKRMIETSRRIIRKVDEDVR

SEQ ID NO: 25924 - protein, 184 aa, Artificial Sequence; identical to SEQ ID NO: 25923
  Synthetic sequence.

SEQ ID NO: 25925 - protein, 184 aa, Artificial Sequence
  Synthetic sequence.
RIEDKLRKVLEEVERIIREIRKRLEDANDDSRREIEESKEDTDRVLEEIRRRIEEIKREVRELEEVVRELDEVEKTVTKLAEDSKKRLDKVVEDSKDLVRRVEEILKEVLERVKKLIEEVKRISMDEDVERVLRKIKELLRRVEEEVERVIRESKKLLDEVRKEDEEIKKTLRDIVREVARKVK

SEQ ID NO: 25926 - protein, 184 aa, Artificial Sequence; identical to SEQ ID NO: 25925
  Synthetic sequence.

SEQ ID NO: 25927 - protein, 179 aa, Artificial Sequence
  Synthetic sequence.
SLEETVEKALKDSKDNIKRLKERVDRVLEESRRTIEELRDRARRVREEVKKRLDELRRRGLDEDELKKVEDRVDKVVRDVEKILEELIRRSEEVVREIRKLLKDVEEFSKEVVSRLRRVDKDAVKKLIDDVRKINKELNDTVEKLARDVEEINKEVARRVEKLVRELEKIDEDVTRREK

SEQ ID NO: 25928 - protein, 179 aa, Artificial Sequence; identical to SEQ ID NO: 25927
  Synthetic sequence.

SEQ ID NO: 25929 - protein, 179 aa, Artificial Sequence
  Synthetic sequence.
SLEEKVREVLKRSEDNIRKLEDESRKVLEDSERNLRKLKKEVDDAADRVRRKIKELRERGLDERELRKVERRVEDVVRRARELLDRVRKVSKEVHDRNKKLLDDLRRTSKEVADRLRRVDARIVDKLIREVEKINRDVNEKVRTSIEDLKRINEELNERVERLIREVERILKEVEDRAR

SEQ ID NO: 25930 - protein, 179 aa, Artificial Sequence; identical to SEQ ID NO: 25929
  Synthetic sequence.

SEQ ID NO: 25931 - protein, 179 aa, Artificial Sequence
  Synthetic sequence.
SLDERVERALEKSEENLRRLKKRSEEVLEEVKEAIKELKRRSREALEDVRRVLDELRKDGLDERVLEKLREDVERVHKRNEEILEEVERRVRRVHEDNKRLLDEVRDDSDKVVKRLRRVDAKVVEELIKRVEEINTRLNEKVKKSIDDVRRIIEEVRRRVEKTIRDVERIKEEVERRRR

SEQ ID NO: 25932 - protein, 179 aa, Artificial Sequence; identical to SEQ ID NO: 25931
  Synthetic sequence.

SEQ ID NO: 25933 - protein, 179 aa, Artificial Sequence
  Synthetic sequence.
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 25934 - protein, 179 aa, Artificial Sequence; identical to SEQ ID NO: 25933
  Synthetic sequence.

SEQ ID NO: 25935 - protein, 179 aa, Artificial Sequence
  Synthetic sequence.
SLEDEVRDMDRKVDEALKRLRDESKKVHDDNKREIDKLRKESEDVHRENKETLDRLRERGLDERLLEEVRRRSEDLHRRNEKILREVIKVSKEIHDRNKELLDRLKERVRDVKSKLRRVDKDAVRELKRDVERIIKEVDELVKRSIEESRRITEEVARRVKETIDRSRKITKELRDRAD

SEQ ID NO: 25936 - protein, 179 aa, Artificial Sequence; identical to SEQ ID NO: 25935
  Synthetic sequence.

SEQ ID NO: 25937 - protein, 185 aa, Artificial Sequence
  Synthetic sequence.
SEIEELEERLERSTRDVEKKVRDTIRESERSTEEVARRVDESIKRLERVVEEVEERVRRIKDREEIKRLLDELRREAEEVHKTNKRLVEENNRVSEEVHRDNERLVDENDRVLEKALDDVRKRITDEEIRKRVEDVAKKVKEDTDKLRDDSRKVHERNEEESRRLEEKSERVLRRVEEILKEIER

SEQ ID NO: 25938 - protein, 185 aa, Artificial Sequence; identical to SEQ ID NO: 25937
  Synthetic sequence.

SEQ ID NO: 25939 - protein, 185 aa, Artificial Sequence
  Synthetic sequence.
SEVDRLITELRRSTKRVEEEVRRLIEDSKRSTREVAERVKESIRRVEKVVEEVKRRVDRIKDEEKIRELLRRLEEILKRAHDENEKLLEENDRVSDEVLERIEKLLKENEEVVRRVLKEVEDRITDEDIRRKIEEVVKEVKEETDRLREEAEKVVRENRKASEKLRRESEEVVERVKKKVDDTET

SEQ ID NO: 25940 - protein, 185 aa, Artificial Sequence; identical to SEQ ID NO: 25939
  Synthetic sequence.

SEQ ID NO: 25941 - protein, 185 aa, Artificial Sequence
  Synthetic sequence.
REVEEIIKELRKSTTDVAETVERLIKRSRESTKEVADRVKRLIDEVRRVVEDVERKVRRIKDREKIEKLLRELRKILREVLEEVEKLLRENEKVSRTVLKEIRRLLRENEKVVKEALDEVRKRVEDERIEKEIEDVVREMEERTKRLEKRAEEVNEENKRRSDELRKRIKKAVDEVEKRLDEIRN

SEQ ID NO: 25942 - protein, 185 aa, Artificial Sequence; identical to SEQ ID NO: 25941
  Synthetic sequence.

SEQ ID NO: 25943 - protein, 185 aa, Artificial Sequence
  Synthetic sequence.
SEVEDLIKKLEESTEEVDRRVKKLIEDSRRSTEDVDRKVKELIKDVRRVIREVEERVARIKDREKIEKLIRDLEEILRRALTEVERLLRENNRISEKVLEDVERLLRENERVVEEVLRRVEKLIKDDRIRETVERVFRKVERKTRELREEIREVDERNRRDSKRLRDEVERVARELEKKLKEIDE

SEQ ID NO: 25944 - protein, 185 aa, Artificial Sequence; identical to SEQ ID NO: 25943
  Synthetic sequence.

SEQ ID NO: 25945 - protein, 185 aa, Artificial Sequence
  Synthetic sequence.
EEVERLIRELEESTDRVAREVERLIRESRKSTEDVRRKVDKLLREVREAIKEVEERVRRTDDEREIEKLLKDLRKILEDVRREVKRLVEENNKVSEDVLREVERLLRENRRVVEEVLKRVAERVEDEEIKRKIDKVVEEVRRRTEELRERIERVNEENKEASERLERKLREMAKELDKKLKDIRR

SEQ ID NO: 25946 - protein, 185 aa, Artificial Sequence; identical to SEQ ID NO: 25945
  Synthetic sequence.

SEQ ID NO: 25947 - protein, 185 aa, Artificial Sequence
  Synthetic sequence.
KDVDELITRLEESTKRVAEEVKRLIEESRRSTERVAREVRRSIEEVKRVIREVEEKVRRIRERERIEELIRRLRKELKKVHDRNKKLLDENNKVSEDVLREIRKLLRENDEVVKEVLDRVRKRITDKDIERKIREVVEKVERDTRRLEEEAKKVNEENEKASRDLEKESKDAADTLEKKLRDIER

SEQ ID NO: 25948 - protein, 185 aa, Artificial Sequence; identical to SEQ ID NO: 25947
  Synthetic sequence.

SEQ ID NO: 25949 - protein, 185 aa, Artificial Sequence
  Synthetic sequence.
DEVEDLIRRLEESTKDVAKKVDDTIDESRKSTKDVAEAVKRSIDEVRRVVREVEERVRRIEDRKTIEELLDRLRKILEDAHRTNKRLVEENNKVSREVHETNKRLVTENEKVVRTVLREVEKKITDDRIRDEIRKVVERAKERTKELEDKSKEVNDRNRETSERLKKESEDVVREVKKELDRIRK

SEQ ID NO: 25950 - protein, 185 aa, Artificial Sequence; identical to SEQ ID NO: 25949
  Synthetic sequence.

SEQ ID NO: 25951 - protein, 185 aa, Artificial Sequence
  Synthetic sequence.
SEIDKVETEVKKLDKELEELVKRSSEKTEKLDRELEKLLRDVVREVEKLLKEIEDLVRRRKESEEVVRTAKELAERLIERLEDVLRRMKKLSEDLEDHNRRVAERIRRLSKELIDILREVLKRLDKKELAERIKKVARESEETVRRLEERLERDSERSRETLRRLAEAVRRVIEKVKEILERLRT

SEQ ID NO: 25952 - protein, 185 aa, Artificial Sequence; identical to SEQ ID NO: 25951
  Synthetic sequence.

SEQ ID NO: 25953 - protein, 179 aa, Artificial Sequence
  Synthetic sequence.
DKMEEVRRTVEKLLEDLNRLSEEVIRTSEKLLEELRRLSEEVERDTERLLKELEKMKRDGESEEKVERVLEEIERLHRETVERIRKVLKDIERLHRRVVTEAKKVVDELRKLAEEVRREGKASDEDIKRVLDEVKKILDDNREKNKRALDRVREEVKRLEDRNREVVRKVRKIVEDLRR

SEQ ID NO: 25954 - protein, 179 aa, Artificial Sequence; identical to SEQ ID NO: 25953
  Synthetic sequence.

SEQ ID NO: 25955 - protein, 183 aa, Artificial Sequence
  Synthetic sequence.
RVDERLDTVLKRVEETVRENKKKNDELLERSKENIDRLKKRLDDLLDKVRREAEKLKREVTKEEVKKIIDEVLKEIEDLLRTVKEELDRALERNREVVEETKRRIDRVLKEIEKLIRDVKRDRKEEVVKEVEERIKKLLKEVNDTSKDAERRLRETNERLNEIVKEVEKRIRELSEEVRKRVK

SEQ ID NO: 25956 - protein, 183 aa, Artificial Sequence; identical to SEQ ID NO: 25955
  Synthetic sequence.

SEQ ID NO: 25957 - protein, 183 aa, Artificial Sequence
  Synthetic sequence.
SVDERLDEVLERVKEDMDRNRRKNDESLREDEENVRRNKKETDESVKRVEERVRELKKRVKDERVKEFLDRVLEEIRKSAEEVKTIIDEVHKESEETVRRTKKIIEEVLRRIEELIRRVKKDRKEEVVKTVEEDIKRLLKEVNKVSDEAHKRNKELNERVNRVNKEAHKRNEDLLREAERKVR

SEQ ID NO: 25958 - protein, 183 aa, Artificial Sequence; identical to SEQ ID NO: 25957
  Synthetic sequence.

SEQ ID NO: 25959 - protein, 183 aa, Artificial Sequence
  Synthetic sequence.
DVKERLDKVLEEVKRDIERNKRRNDKLLKESKRIVEENKKKNEKSLEEVKRKADDLRTKVKDEEVKKIIKKVLDEIRESVERTKELADRILEENERLVRETKKILDEVLKEIRKLIEDVKKDRKKEVVEKVEREIERLREEVNRVSKKAEEDVERTNRELNRVSDEAHKTNERLLEKVERDVK

SEQ ID NO: 25960 - protein, 183 aa, Artificial Sequence; identical to SEQ ID NO: 25959
  Synthetic sequence.

SEQ ID NO: 25961 - protein, 169 aa, Artificial Sequence
  Synthetic sequence.
SSEDKARELVRTLEEALRELEREMRKVVEDSKKTLKELEERNRRLEEELEKVLERVRDEDAKRLVRKVLKESKEVLERSRELSKRADDELKRVLEEIKKRVEEVLKKVRDKPGDDRVIEELKELLERLRERVERVIKKVKDLNEELRRRNDKVAKDLKRLLKELEDRTR

SEQ ID NO: 25962 - protein, 169 aa, Artificial Sequence; identical to SEQ ID NO: 25961
  Synthetic sequence.

SEQ ID NO: 25963 - protein, 183 aa, Artificial Sequence
  Synthetic sequence.
SIEDEIRKVLTRLRRVLEEIKRSSKEVADELKRVLEEIKRSSEENNKEVEEVLKEIEKLPTDEELVRRVRKVAKEVKDHNERSTREVKKLVERLERILERSSREVEKTVRELEKELEKVLRDGGDREVREVIERLERMLEELERHNRDVERDLRRVLEEAKRHNEESLRRSKELLKKVRDEIE

SEQ ID NO: 25964 - protein, 183 aa, Artificial Sequence; identical to SEQ ID NO: 25963
  Synthetic sequence.

SEQ ID NO: 25965 - protein, 183 aa, Artificial Sequence
  Synthetic sequence.
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRGGEERVREVIEKLKETLERLKREDKEVADRAEKLLREAEEHNKRSLDESRRVLEELDEEIR

SEQ ID NO: 25966 - protein, 183 aa, Artificial Sequence; identical to SEQ ID NO: 25965
  Synthetic sequence.

SEQ ID NO: 25967 - protein, 183 aa, Artificial Sequence
  Synthetic sequence.
SIEDRVRRVLEELEEVLERIKDSSRRVVEEAEDVLRKLEEENRKLERDLERVLKEIEEEPVDETLVKEVRDLVERLKEISDESVKRSARLVEELKRRLEESSERVDRMAKELKRRLEEVLRRGGERELEEVEKRLREVLRRLEKHNEDVIRDLRRLLEEAADEDRRVIKTLRDVLRELKKRIK

SEQ ID NO: 25968 - protein, 183 aa, Artificial Sequence; identical to SEQ ID NO: 25967
  Synthetic sequence.

SEQ ID NO: 25969 - protein, 183 aa, Artificial Sequence
  Synthetic sequence.
KIEEKIRRLEEDLDRVLDEIRRNSERVTKEAEEVLERLKRENEKLKKRLEEVLEEIRRRPVDERLVEEVERAVRELKKKSDESVDRSARLVEELKKRLEESSRTVETLVRKLKEDLERVLREGGERRVDKVIEDLKRVLDEARRHNEDVVRKLKEALDKLREDDDRVRRDLEKKLRDLERRIE

SEQ ID NO: 25970 - protein, 183 aa, Artificial Sequence; identical to SEQ ID NO: 25969
  Synthetic sequence.

SEQ ID NO: 25971 - protein, 183 aa, Artificial Sequence
  Synthetic sequence.
SIREKIRELEERLEEVLRRIEENSERVLREAERVLKEIKDNSKRNNEKLERALEEIRKLPVEDELVRRVKELVERLKRHNKKSSEDVERVVRELKEELKRSSEEVKKAVDRLKEELEKVLRDGGEREVDRVIRKLEDVLRKLEEHNRRVVERLKRLLEELKKHNEDSLRKSEEVLRKLEEDAR

SEQ ID NO: 25972 - protein, 183 aa, Artificial Sequence; identical to SEQ ID NO: 25971
  Synthetic sequence.

SEQ ID NO: 25973 - protein, 183 aa, Artificial Sequence
  Synthetic sequence.
SIEERVRELMRDLERVLKEIREHSKRVIEEAKRVLEEIERNSERNNKELEEVLDEIRKRPVDETLVREVEEAVKKLKEHNKRSSDTVRDAVRKLVERLKESSDRATELVKDLKRKLEEVLRRGGEKELEEVERRLRKVLEDLRRNNKEVVDRLKEVLERLKEHNRRSLDESRKVLRELKERIR

SEQ ID NO: 25974 - protein, 183 aa, Artificial Sequence; identical to SEQ ID NO: 25973
  Synthetic sequence.

SEQ ID NO: 25975 - protein, 183 aa, Artificial Sequence
  Synthetic sequence.
SIEDRIRELEKRLEKVLREIEEHSKKVVREAEKVLREIEENSRRNNKRLEEVLDEIRKRPVDETLVREVEEAVRRLKKHNKDSSDTARKLVEELKKELKESSDRVRKVVEELKDRLRKVLEKGGEEDVRKVIRDLEDALRRLKEDNEDVVRRLKEVLKELRKHNKRSLDESEKVLRELRERIR

SEQ ID NO: 25976 - protein, 183 aa, Artificial Sequence; identical to SEQ ID NO: 25975
  Synthetic sequence.

SEQ ID NO: 25977 - protein, 183 aa, Artificial Sequence
  Synthetic sequence.
SIEDEVRKLAKDLDDVLREIEENSKRVLEKLDEMLERIREHSERVVERAKRVLDEIRKQPIDESLVRRVETVVRELKKRLRESTERVRTEVEKLKRLLEESSKEVKRVVEELKEELKDVLRRGGERELRTVIRKLKEVLDRLREHNKRVVEELEEALKELEKDNRKVVEDLERMLEELKREVN

SEQ ID NO: 25978 - protein, 183 aa, Artificial Sequence; identical to SEQ ID NO: 25977
  Synthetic sequence.

SEQ ID NO: 25979 - protein, 183 aa, Artificial Sequence
  Synthetic sequence.
SIEEEIEKVKKRLEDVLREIKKHSEEVKKKAEDVLRKIEKHSRDNNRKAEEVLKDIARLPVDERDLKRVAEVVDRLKKHNKKSTDDARKLVKELLERLDRSSETAERVVRRLKEKLDKVLKDGGEEEVRKVIEELEELLERLRRNNEEVVRDLERVLEELKRDNEKSVEDSERLLTELKREIE

SEQ ID NO: 25980 - protein, 183 aa, Artificial Sequence; identical to SEQ ID NO: 25979
  Synthetic sequence.

SEQ ID NO: 25981 - protein, 184 aa, Artificial Sequence
  Synthetic sequence.
SVKEELDDLERKVDEDVRRIRRELDEVLKESRENVKRSKDHLDEVLRRVEEAVKRLIRERGETSELAELVREVLKRVKELLRRVVEITKDVLRRSEELIRELKKELDDVRRRIKELVDRVAEDPDKEKVDRAKKEIEDLLREVRKRVEDVAREIKRLNEDVNRINDKVTREIEKLLEDVDRKVK

SEQ ID NO: 25982 - protein, 184 aa, Artificial Sequence; identical to SEQ ID NO: 25981
  Synthetic sequence.

SEQ ID NO: 25983 - protein, 184 aa, Artificial Sequence
  Synthetic sequence.
SVEDKLRELEKRVRDVHRKNEEDLDRLLRKSHEMHKRNEDELRKVLEEVRDAVRKLLKEKGETSELAEELRRVLEEVERVIREALKISEEVNRRNEELLKRLKEESRRVLEEVKRMLEKVRDKPDDEEVERVIKRIDDLLKEVHKILREVIRRIEKSLEEVHKRVRDLVREIKELLKEVDRKAK

SEQ ID NO: 25984 - protein, 184 aa, Artificial Sequence; identical to SEQ ID NO: 25983
  Synthetic sequence.

SEQ ID NO: 25985 - protein, 182 aa, Artificial Sequence
  Synthetic sequence.
SLEDKVRELERKSRENIKRNEEELRRAKRESEENIKRNEEELKRNKERSDRMIEKIRRETDDERVKKILKDLARRSEELLRRSKEILEELRELSERIVKESTDILRELLELVKEVAKRLRRVDKDVVERLREALEDANRRVNERNRELIKRLKEANKKVNEENEDLLRESEEILRRVEEEVR

SEQ ID NO: 25986 - protein, 182 aa, Artificial Sequence; identical to SEQ ID NO: 25985
  Synthetic sequence.

SEQ ID NO: 25987 - protein, 182 aa, Artificial Sequence
  Synthetic sequence.
SIEELVKDAKRRSKENADRNREKLRKVEDDSRRNIEENERRLEENEKRSREVIKELADRTDEERVRELLRRLLELSKRIADESRKILEDLLRRVKEVIRESERIIREVEEVVKEVLTRLSRVSEDVVEKLIRELEEINREVNKRNDDLIRELREINKKVNEENKRLMKESDDILKEVRERVR

SEQ ID NO: 25988 - protein, 182 aa, Artificial Sequence; identical to SEQ ID NO: 25987
  Synthetic sequence.

SEQ ID NO: 25989 - protein, 182 aa, Artificial Sequence
  Synthetic sequence.
SIEDLVRELKKKVDEVAEDLRRKVREALERSRENIDRLKKHSEENLRRSEEVVDKLRKETREEEVKDILRRVLELSKRIVEESKEILDRVLELSKKVVDDIEEIIRRVEETVKEVLTRLSRVDDKVVKKLIKEVDDILREVTKLVEKLIRELEDINRKVNERNRRLAEESRKILDEVEKRVR

SEQ ID NO: 25990 - protein, 182 aa, Artificial Sequence; identical to SEQ ID NO: 25989
  Synthetic sequence.

SEQ ID NO: 25991 - protein, 182 aa, Artificial Sequence
  Synthetic sequence.
SLDEKVEELRREVDEAIKDIKEKVKRANEESERNIRELEERVKRNLEKSKKAIEELARRVDDERVEKILREVLKRSKEIVDTIRKILEDVKRFSDKVVEEIDEILRELKRRVEEVLRRLRRVDEKVVEKLRKEVKEVLKEVEDRVRKLIREVERINEEVNRRVKELLEESEKILDDVDKRVK

SEQ ID NO: 25992 - protein, 182 aa, Artificial Sequence; identical to SEQ ID NO: 25991
  Synthetic sequence.

SEQ ID NO: 25993 - protein, 188 aa, Artificial Sequence
  Synthetic sequence.
EVEERVKELEKEVEEVLKESEDHVRKSEEDLRRALEESRKHIEDLERKLKKVLEELERKVKEEDMKREVRRALEEIDRVIKKVKRDSERLVKRVEKSIEDTRKVVEDANREVKRIVDEVKEVVRRNDKSKDLLKKLEEEIRKIITENRKLNRDLHRENERIIRDVRRENKRLADELEEIIKEVRERLK

SEQ ID NO: 25994 - protein, 188 aa, Artificial Sequence; identical to SEQ ID NO: 25993
  Synthetic sequence.

SEQ ID NO: 25995 - protein, 188 aa, Artificial Sequence
  Synthetic sequence.
SVEEKVEELEKEVRKALEDSKRHVDESEKRARDLARRSRELVRRWEEEVEKIVRELETRVKEDEMREKVKRIIKRIRDVVKKLRDLSEEVIKELERSVEESRKAVKDLNDRLREVIKEVKKVVRDKRDMEDLLRKLADEIRRILEDNRDLNRRLNEKNKEVLDRLEELNKTLADELRDIIRKLEKELE

SEQ ID NO: 25996 - protein, 188 aa, Artificial Sequence; identical to SEQ ID NO: 25995
  Synthetic sequence.

SEQ ID NO: 25997 - protein, 182 aa, Artificial Sequence
  Synthetic sequence.
KELEDVVRKIEEDLRRLEESNEKVHRENEEIIRRVDETNKKVMKEIKEMEKKVRDLVRERKEKEEVVREIEKLAREVLEKLDKVNKENEELARESVKELRRVLKENEDRVRELAKELRRVAREKNRGGEVERVIERLEKVVRDSAANVERSIRELERVVEESSKHVEDVKRELKKVVDEIRT

SEQ ID NO: 25998 - protein, 182 aa, Artificial Sequence; identical to SEQ ID NO: 25997
  Synthetic sequence.

SEQ ID NO: 25999 - protein, 182 aa, Artificial Sequence
  Synthetic sequence.
SDLDRVREEAERVVETVRRSNKEVKKKLDRELKRLRDSNKDVVDKIKRVLEKLRELIKRRKEKEEVVDTVRKLVEEVRRKLDEVLKRNRELIRRLLEELDKVNKRNKELAEEVVRKLEKVARERNVGGEIEEVRDKLRKVVEESSKHAEEVKRDLERVVEESTRNVDRVREDLKRVLDEIET

SEQ ID NO: 26000 - protein, 182 aa, Artificial Sequence; identical to SEQ ID NO: 25999
  Synthetic sequence.

SEQ ID NO: 26001 - protein, 182 aa, Artificial Sequence
  Synthetic sequence.
SLRERIEELKEELRRVLEELERRHRETEKKLEEVLKELKRRHEELVRRLRKALKEIKDKLKDKDVVRKVEKLAKELEEENKRVVETVAELIERLKDLNRRVVEEVRKLIKEIEDKLEEVKELDEEAIKDVERKVKKLLKELRDLSEKVRKESDDLLRRLRRESERVERETRKLEKELRDEVR

SEQ ID NO: 26002 - protein, 182 aa, Artificial Sequence; identical to SEQ ID NO: 26001
  Synthetic sequence.

SEQ ID NO: 26003 - protein, 179 aa, Artificial Sequence
  Synthetic sequence.
SKADEVRKKVDDINKRLRETTDRVAEETKKLIEELKKSAEEVKREVDKINKDLRKLAEDGRSEEEVKRLSERTEKLLEENNKRSEEVVRRIRELHERDLTTVRRLSEETKRLLKEVADEGKISEKDVERLTRKSEKVVREIEKKNEELKRELTEVLKDDERRNKELVEDSRRVLEEIRT

SEQ ID NO: 26004 - protein, 179 aa, Artificial Sequence; identical to SEQ ID NO: 26003
  Synthetic sequence.

SEQ ID NO: 26005 - protein, 179 aa, Artificial Sequence
  Synthetic sequence.
DKARDVARKVEELLERLRELSERVSRTSEDLNRKLKKISEDVSRTSKKLLDELRRAKEKGEDRKRVEEVVRRIDELNKRAVEIVRKLSRDTEKLNEDAVRDVRRVVEEIKKLLEDVARDGKIREEDVRRLKERVKKVMEELERRHERDKEKSRRVVEKLERDHREDLKRVKKVLEEITK

SEQ ID NO: 26006 - protein, 179 aa, Artificial Sequence; identical to SEQ ID NO: 26005
  Synthetic sequence.

SEQ ID NO: 26007 - protein, 179 aa, Artificial Sequence
  Synthetic sequence.
SKADKVEEEVKELLKRAKALSDRVSEESRRLLKELRDSARRVEEEVKRLEEELRKLKEDGKSEEEVRKVVEEIRELLTRNNKTSEEVVRRIRKLNDDAVKEVTEVVKEIEKLLREVAREGKISEEKVRRVLREVREMLKDLEKKHRDDIKRVTEVLKEDEEKNRDLMRKVDKFLEDIRK

SEQ ID NO: 26008 - protein, 179 aa, Artificial Sequence; identical to SEQ ID NO: 26007
  Synthetic sequence.

SEQ ID NO: 26009 - protein, 179 aa, Artificial Sequence
  Synthetic sequence.
SKAEEVEELVKKLLAEVKKSLDDVRRTVEKLLREVRKSLREVEETVKRLLKRLKDLKDDGQDERAVRRVVEEIKELLDRNNEDSKRVVKEIRKLLDENDKTSKRVVEEIKRLLDEVRKEGKISEEKVEKLERDVRRALERDTRENKKLEDRVETALREDKKRNDDLREDVKRVLEEIRT

SEQ ID NO: 26010 - protein, 179 aa, Artificial Sequence; identical to SEQ ID NO: 26009
  Synthetic sequence.

SEQ ID NO: 26011 - protein, 183 aa, Artificial Sequence
  Synthetic sequence.
DELEELIRRIEKLIRDSRKITDDVRKEIEKTIRESREINKEVHERNRKLLEEITEVVKRDGGEAEEVVKIVRDVLRRIKESNEEVLRLTEEVHKTNERLLREVLRVTREVLKEIKKRVERVKDRGAREEDLRRVDDRVRRVVEESEERLRRVYEESRKVVEESRKHLKEDLDRVKRTVEEIER

SEQ ID NO: 26012 - protein, 183 aa, Artificial Sequence; identical to SEQ ID NO: 26011
  Synthetic sequence.

SEQ ID NO: 26013 - protein, 183 aa, Artificial Sequence
  Synthetic sequence.
SELERVEEEIKKLIRTSREINKEVAKRIEETIKESRDINKEVVDRIRELIERLREVVKRDGGETRRVVEIADEVLKTIRDLLRRVKEITDKLHEDNERLLRRVEEVSKKVLDDIKRLIEDLRRRGVDEKELKRVEDEVRKVVEESKDHLRKVYEKSKKVVEESKEHLDRVLREVEKEIEEIRR

SEQ ID NO: 26014 - protein, 183 aa, Artificial Sequence; identical to SEQ ID NO: 26013
  Synthetic sequence.

SEQ ID NO: 26015 - protein, 183 aa, Artificial Sequence
  Synthetic sequence.
SELERVEEEIKRLIDESERINRKVVKEIEDTIRTSEEINREAHRRNRELIKRVEDVVRTKGGEDEEVVRIVRKVLEEVKKSNTDVKRVTKTVHDDNRRLLEEVKRVSEEVLKTIKRLVEDLRRKGVDEKELRRVEEEVRKVVRDSERHLDEVYKRSKEAVDRSKKHLDKDVEEIDRVVKEIER

SEQ ID NO: 26016 - protein, 183 aa, Artificial Sequence; identical to SEQ ID NO: 26015
  Synthetic sequence.

SEQ ID NO: 26017 - protein, 183 aa, Artificial Sequence
  Synthetic sequence.
RELEEVKKEIDRLIREVEEVNKDVVRKIKETIRRSREINKRVVDEIRRLIKELDDVVKTKGGESEEVVRIADEILERIKKLIEEVKEVTRRIHETNKRLLEEVKELTDEVLKTIRELVEDARRRGVDERELRKVLEKVERVVKKSRDHLDRVYEDSERVVRESEKHLDEVLERVREEIERIRK

SEQ ID NO: 26018 - protein, 183 aa, Artificial Sequence; identical to SEQ ID NO: 26017
  Synthetic sequence.

SEQ ID NO: 26019 - protein, 183 aa, Artificial Sequence
  Synthetic sequence.
RELEEAEKTIEKLIKESRDINEKVARDIDKTIREIREEMKRVEEEIRDLIRRIREVVKRDGGESERVVREVRRILEEIKKLLEELEKRVEEIHERNKRLLDTVLRVSEKVVEDIRRLVEEVRRRGADERKLREVTKRVDKVLEESRRHLEEVYRKSKEVVDEIRKRLREVLKRVREDVERIER

SEQ ID NO: 26020 - protein, 183 aa, Artificial Sequence; identical to SEQ ID NO: 26019
  Synthetic sequence.

SEQ ID NO: 26021 - protein, 183 aa, Artificial Sequence
  Synthetic sequence.
SELDEVAKRIKELIKESRRINEEVERRIKKTIDEVRKINKEAAKTVDDLIKTIRDVVRRKGGETKEVREIVDEILERIRELVKEVKRFTDEVHERNRELLRRVVEVSEEILRRIEKLLREARERGVDEKKLRDLEEEVRRVVEESKDHLRKVYERSRKVVEESRKHLDEVLTRVDKVVKDIRT

SEQ ID NO: 26022 - protein, 183 aa, Artificial Sequence; identical to SEQ ID NO: 26021
  Synthetic sequence.

SEQ ID NO: 26023 - protein, 185 aa, Artificial Sequence
  Synthetic sequence.
SELEEAEKKIERLIEEVRKMNKTVHEENERLIEDLRRVVKEAHERNKRLIEELEDVVRKISDKETVTRIVEEVVRRVRKTVEDVRRIVDEVLKKVKDTVDRVKRITDEMLRKVKELVDDVRRKVDDKDVEKKLKDVLDKVRKVVEESRRHLEESLDKVRRVAEEIRKRLKESKDRVDEAAKEIRR

SEQ ID NO: 26024 - protein, 185 aa, Artificial Sequence; identical to SEQ ID NO: 26023
  Synthetic sequence.

SEQ ID NO: 26025 - protein, 185 aa, Artificial Sequence
  Synthetic sequence.
DELEEAEKRIKELIDRLEEFNEEVHRRNEKLIRELREVLKRVEEEIRRLIKELRDEVRKISDKDTVEDIVRKVLETVKELIKEVKKIVDDVLREVRKTVRKVKEITDDMLRRVRKLIEEVRKRTRDKRVEERLERVLREVEEVVKRSRKHLEDSLREVEKAVKEIRDRLDEVLRRVEKAVEEIRT

SEQ ID NO: 26026 - protein, 185 aa, Artificial Sequence; identical to SEQ ID NO: 26025
  Synthetic sequence.

SEQ ID NO: 26027 - protein, 185 aa, Artificial Sequence
  Synthetic sequence.
SELEDAERKVKELIDRLREVNRKVHEDNKRLIDELRDVNRKVAEEVRRLIEELKEVARRVDDKETVVRIVDEVLKRVEELIEKVKRISDRVLEEVKRTVDEVKRITDKVLEDVKRLIDDVKRKTRDKRVRDRLKEVEDRVRKVVEDSRRHLEKSLREVEEVIRESREHLEEVLRRVKEEADKIRK

SEQ ID NO: 26028 - protein, 185 aa, Artificial Sequence; identical to SEQ ID NO: 26027
  Synthetic sequence.

SEQ ID NO: 26029 - protein, 185 aa, Artificial Sequence
  Synthetic sequence.
SELEKVREDIKRLIEDLRRANDRVRRESERLNRELREVNKRVHDDNRRLIEELRRLVKDIKDKETVRRIVDEVLKEVRKTVETVKRISKEVLERSRKLIEEVKEITKRALEEVEELVRDVERKTRDERVRDELRKLLRTVEKVVEESKKHLKEVLDRSREVVEESKTHLEKSLTDVEKVVREIRT

SEQ ID NO: 26030 - protein, 185 aa, Artificial Sequence; identical to SEQ ID NO: 26029
  Synthetic sequence.

SEQ ID NO: 26031 - protein, 185 aa, Artificial Sequence
  Synthetic sequence.
STLDEAVKRIDELIKRLREVNEEVARRSKRLNDELKKVNEDVARKIEELIRRLRDVVRKISDKETVDRIVDKALEDVKKLIEDVKRISDKVLEDSKRLIEEVKRITDRVLEEVERLIREVKKETRDKRVEEELERVLRKVEKVVKESRDHLEEVLRRSEDMARRSREHLEELLKRVEKVVREIRT

SEQ ID NO: 26032 - protein, 185 aa, Artificial Sequence; identical to SEQ ID NO: 26031
  Synthetic sequence.

SEQ ID NO: 26033 - protein, 185 aa, Artificial Sequence
  Synthetic sequence.
SELEEAIRRIEKLIRELREVNKRVAEEVKKSNEESKEVNKRVKDDVKELIERLRDIVKKVKDKDTVEEIVKEVLKRVKELIDEVRRISDEDLKTSKRLIDEVKRITDEMLERVRRLVEDVRRKTRDKDVEDKLREVLRRVEKVAEESRRHLEKVARESEEVVKRSRKHLEEVEREVKKVIDEIRK

SEQ ID NO: 26034 - protein, 185 aa, Artificial Sequence; identical to SEQ ID NO: 26033
  Synthetic sequence.

SEQ ID NO: 26035 - protein, 185 aa, Artificial Sequence
  Synthetic sequence.
RTLEEVEKEVEKLIEDLRRVNREVAERIKKSNEDSKRVVERVEDEIRRLIEELKDMVRKVSDKETVVRIVDEALERVEELIRRVKKIVDDDLRRSKELIDRVKEITDRMLETVKRLIDEVRAETRDERVDKRLRDVLRKVKKVAEESRKHLEELAERSKEVVERIRRRLEEVLKRVREEAEKIRK

SEQ ID NO: 26036 - protein, 185 aa, Artificial Sequence; identical to SEQ ID NO: 26035
  Synthetic sequence.

SEQ ID NO: 26037 - protein, 185 aa, Artificial Sequence
  Synthetic sequence.
SELEDAERRIERLIRELRKANEEVARRIEKSNEDSRRVNKKVAEEIERLIKELRDVTKDVDDKETVKRIVDEMLERVKKLITEVKEISDRDLEESRKLIREVEKISEDVLDTVRKLVEDVRRKTRDKRVEEELKRVLDEVKRVIEESKERLKKWLRDSERVVEESRRHLEELRKRVEKAVREIRT

SEQ ID NO: 26038 - protein, 185 aa, Artificial Sequence; identical to SEQ ID NO: 26037
  Synthetic sequence.

SEQ ID NO: 26039 - protein, 184 aa, Artificial Sequence
  Synthetic sequence.
RVEDEVRKMREKSEKVDREIREAVRRSLTRIKEVVDEIRDEVRRSEDKVKKEIDRLRKEGADEKALKELLDRVKRSVEEVERVVEEVLRRVEESARDVERVVTENHRISKELVEDVRRKVSREEVDKLLDEVRREADESNTRLRERVKEVNKRNEEVIEELRKRVEEVHRTNEDLIRELRKKTT

SEQ ID NO: 26040 - protein, 184 aa, Artificial Sequence; identical to SEQ ID NO: 26039
  Synthetic sequence.

SEQ ID NO: 26041 - protein, 178 aa, Artificial Sequence
  Synthetic sequence.
REEEELERVKRRSEKVDEEIKKRLREVAEEVKRSNEEVKKRLEEVLRDSKRKLDELREEGADEKAVEENERTVRTVARRVEKVVRENEKTLREAERAVEEVLDRNRKTVEDVERLLKRREKDVRELIRELEESNKRVKDVLRKLIEEVKKSDDELREIVKRLVEEVERSNKELEDRVR

SEQ ID NO: 26042 - protein, 178 aa, Artificial Sequence; identical to SEQ ID NO: 26041
  Synthetic sequence.

SEQ ID NO: 26043 - protein, 178 aa, Artificial Sequence
  Synthetic sequence.
REEERLKKLKEDSDRVDREIERKAEKVLEESEEVDRDIERKLREVERKSREVLEELKKRGADKDAVKRNEETVRRVVEEVRKVLDENTRSVEKVLEEAKRVVEENKKTVDRVDKVVRRRDKDLEELRKEVEKSNTDLEKIIEDLIRRLKKSNEDVRRTVTELVKEVDRSNKKLEDEVR

SEQ ID NO: 26044 - protein, 178 aa, Artificial Sequence; identical to SEQ ID NO: 26043
  Synthetic sequence.

SEQ ID NO: 26045 - protein, 178 aa, Artificial Sequence
  Synthetic sequence.
REEEELEKLRERSERVDDEIRKRLREALERSREVDEELRRRAEESKKESDEVIKDLARRGADRKALEENRETVRESLERMRRVVDENTKSVEDVFKAVEDVLRRNKRTVDEVRKVVERREKDLDELRREVEKSNEDVRRFLEKLVRDLEESNRRVRERIKRLHEENKKSNDELRKRTK

SEQ ID NO: 26046 - protein, 178 aa, Artificial Sequence; identical to SEQ ID NO: 26045
  Synthetic sequence.

SEQ ID NO: 26047 - protein, 181 aa, Artificial Sequence
  Synthetic sequence.
SELEELKKKSKKLNDDIERVVEEVLKRSEDINERVKKEVKDVIDRNTDVLRRVKRDVEREDKSRELIRRLIEEIKKTTKELEDRVRELVKESEESVRRIEKLIRELIKESEKVVEEVKRTVSKGKEEAVRKVEKENRESVEKLKKAVKEVRDRNRKVIEELKDLVRRSRDKSKKVVDELRK

SEQ ID NO: 26048 - protein, 181 aa, Artificial Sequence; identical to SEQ ID NO: 26047
  Synthetic sequence.

SEQ ID NO: 26049 - protein, 181 aa, Artificial Sequence
  Synthetic sequence.
REVDKARKDVDDILKRVTEAVDRMDRDNERVLREVEETIRKLEEDSRRINKDIEDAVRKEDKSRELIKKLIEESKRSVDELRKVITRLERRIERTTKELKKLVEKLIRELKKVVEDAIRKVSKGSRKDVEDVRRKVEEVVRRMEKRLRESEKKSRDVVRKLRKVIEDVERDNDRVVKELEK

SEQ ID NO: 26050 - protein, 181 aa, Artificial Sequence; identical to SEQ ID NO: 26049
  Synthetic sequence.

SEQ ID NO: 26051 - protein, 181 aa, Artificial Sequence
  Synthetic sequence.
SELEEMRRRIERLAEEVRTTVEEVVRRSEELNKEVEKAVRKVVDENRRVLEEVKEEVRKEKDSRELIERLIRRIEETTKKLEDLVRKLVKELRDSVEEIRKLIEDLIRRLKKVVREAKETVSKGKKEEVKRVEERVERVVEELRRLVEEVRKRNEDSIEKLKDLVRRSKEESERVVKELED

SEQ ID NO: 26052 - protein, 181 aa, Artificial Sequence; identical to SEQ ID NO: 26051
  Synthetic sequence.

SEQ ID NO: 26053 - protein, 181 aa, Artificial Sequence
  Synthetic sequence.
SDLERVRKESEDLNRRIKTEVRRVLEELKELLKRIKEEVEELVRRNEEVLKRVREEVTKRREARELIRDLIKKIRDTTEELRRVVERLVEEIKKVLRDLKKLIEDLIRESKKVVREILERVSKGKEEAVRKVKEDNDRSVEELKELVKDVERKLREAIKELEDLIRRSEEKSREVVERLRR

SEQ ID NO: 26054 - protein, 181 aa, Artificial Sequence; identical to SEQ ID NO: 26053
  Synthetic sequence.

SEQ ID NO: 26055 - protein, 183 aa, Artificial Sequence
  Synthetic sequence.
SLEEEVRRVKKELRRVLEKSTKLIEEVTRELETVLRESRDRVRRAKEELKEAVREVRRDVGEGEKLRDAERVVEDLLRELDDSLRKTEEMVKELKKKLDKSNKTTADLVRELLKRLDKVLKDGGEEEVRKVVEDVERVLRELEKHDRDVAEEVRRVLDELRKHDEDVRRKLRKVLEELKEKIK

SEQ ID NO: 26056 - protein, 183 aa, Artificial Sequence; identical to SEQ ID NO: 26055
  Synthetic sequence.

SEQ ID NO: 26057 - protein, 183 aa, Artificial Sequence
  Synthetic sequence.
SIEDRVRRVEKELREVERKSTETVKRVEEELEEVVRRSRELVERVKERLKKMVEEVKRDTGEGEKLKRAEEMVRRLLRELEESNKKTKTLVDRLLEELRDSNKKTRDLVRELLKKARDVLRRGGEKELEDVERDVRRVLKEAEDNDRRVVERVRRVLKEAEKHDRDVVRRVDEVLKRLKEEIR

SEQ ID NO: 26058 - protein, 183 aa, Artificial Sequence; identical to SEQ ID NO: 26057
  Synthetic sequence.

SEQ ID NO: 26059 - protein, 183 aa, Artificial Sequence
  Synthetic sequence.
SIEEAVERVAKRLEEALRRSTEEVKRVKEETRESVERSRREVEKVEKELREVVERVRRERGEGEDLKRAEDVVRELLKLLRESLKRSEELARDSVRKLDKSNTDTERLVRELLKRARDVLREGGDDRLRKVVEELETVLDELRKNDRRVIEEVRRINDELRRRDEEVIKRVRDMLKKLTEEIK

SEQ ID NO: 26060 - protein, 183 aa, Artificial Sequence; identical to SEQ ID NO: 26059
  Synthetic sequence.

SEQ ID NO: 26061 - protein, 179 aa, Artificial Sequence
  Synthetic sequence.
SLEDKLRENKRRSEAVVEEAERRLRKNEEDSRKVVRELEDKLRRLREESKEMADRLRRKGADERVVRKVNKDSEDIIRELERLVREVERVSEELIRRIEEIVTRVLRVSEEILRRLKRVDDKVVEKLLKESKEILDRARETVKRILDDSERILRELRRRVEKLIKESRDILRKVDEDER

SEQ ID NO: 26062 - protein, 179 aa, Artificial Sequence; identical to SEQ ID NO: 26061
  Synthetic sequence.

SEQ ID NO: 26063 - protein, 181 aa, Artificial Sequence
  Synthetic sequence.
KAEEILEDIKRAVEEALRKLEESVRRNKERIREAVERLRETVKEAKERVDEVKRELEEKGVDRSLIRRVEEVVKRVLDINRRLIEEVEDVVKKSEEINADLIREVRTVVTDVERIIRENGELEEVLRKVREDLERIIRRVEEESKKSHKDSEDVLRRVEERSKKSLEELEDIIKKVKEEAD

SEQ ID NO: 26064 - protein, 181 aa, Artificial Sequence; identical to SEQ ID NO: 26063
  Synthetic sequence.

SEQ ID NO: 26065 - protein, 181 aa, Artificial Sequence
  Synthetic sequence.
DMEKIVRDVEDRVREVEDRLRRIAERNKREIERVVEELKKTVKEIEDKVREVVKRLEEKGIDESLRERVEKVVRDVVRENEELIKEVEDAVRESLKIVKDLIDEVRRVVAEVERIIRENGELEEVLRKVVTDLERILRRVLEDAKRVHEESKRRLDDVRRRSEDSVRRLEEELKRVEEEVD

SEQ ID NO: 26066 - protein, 181 aa, Artificial Sequence; identical to SEQ ID NO: 26065
  Synthetic sequence.

SEQ ID NO: 26067 - protein, 181 aa, Artificial Sequence
  Synthetic sequence.
DAEKILEDIKREVDEVLKRLRDIIRRNEEEIRRAVEDLKRIADEDREAIKRVIDELRKKGVPEELLKEVKDVVDESLRRIEKLIEDVKRAVAESVRRAEKLIRDVERVVKRVEDIIRKNGEAEEALRKVVEELRKILRDVTEVAKKVHRDSEEVLKKVREDVRKVHEDSKRVLDKVDKDAN

SEQ ID NO: 26068 - protein, 181 aa, Artificial Sequence; identical to SEQ ID NO: 26067
  Synthetic sequence.

SEQ ID NO: 26069 - protein, 176 aa, Artificial Sequence
  Synthetic sequence.
SRLEEVLRRHEELNERVERTVKKVHDDSKELIDRIRKDVEKVVRELEKVIDEVEKNSRDKDLVREMIKRIEDVLRRLEDRVRKLAEKIDRVLEESRRLVEELAKRSRESLKRLVDTIGKESEKVEEIERHARKVERRLEEIVDRNRKSVDKAKKELEKIVRDVRRRVEEVVDRLRK

SEQ ID NO: 26070 - protein, 176 aa, Artificial Sequence; identical to SEQ ID NO: 26069
  Synthetic sequence.

SEQ ID NO: 26071 - protein, 176 aa, Artificial Sequence
  Synthetic sequence.
DEVRRVLEELRRLLDEVRERVRRVVEEHKRLNDRIRREVERAHEENKRVDDDLRRKVRTRELVKEVIERSKEVLERTEKLVRDLARDSDRSVEEARKRVEELMREIDDVLEKLVRTIGKDSKDVKEVKKEVERVKEELRRLVEELRKHAEKVKEELKRIVDRDRETNERTVEELKK

SEQ ID NO: 26072 - protein, 176 aa, Artificial Sequence; identical to SEQ ID NO: 26071
  Synthetic sequence.

SEQ ID NO: 26073 - protein, 176 aa, Artificial Sequence
  Synthetic sequence.
SEAEDVLRKLERLLEEVRERVADAHRRSKELLDRVDKEVKRVNEENRKLDDDIRKKVRDKDLVRKAIEDSKTVLEKTKRLVEDLMRKIDRVLEESAKVVEKLREEIEKVLRELLETVGEDNDEARKVREKVKKVEEELRRIVEEDRKEVEKVKRKLEKDVREDEKENRKTVRELEQ

SEQ ID NO: 26074 - protein, 176 aa, Artificial Sequence; identical to SEQ ID NO: 26073
  Synthetic sequence.

SEQ ID NO: 26075 - protein, 185 aa, Artificial Sequence
  Synthetic sequence.
TLEELLEEIRRKVEEVLKKLEDLLRRDHEEVKKVEEELEEINKRSEDRVRKAVRRLERDAKDDKETVKRVKKKLEEVVRKDHDVVRDIKRRLKESNDKSERVMREIKKRLKEVLDEVKKVVDDGVGEEAIRKVLRKLEEEAKRLEKRIEEVLKESKDRIDELRKRIEESHKDLERIIEELERRIK

SEQ ID NO: 26076 - protein, 185 aa, Artificial Sequence; identical to SEQ ID NO: 26075
  Synthetic sequence.

SEQ ID NO: 26077 - protein, 185 aa, Artificial Sequence
  Synthetic sequence.
RLEELLERIRKRVEEVKRESERLLKEDHDRVEEAKKRSEDINRRSKEEVDRMLRELETKAKDDEKVVREVKELLKRVVEKDHDLSRRSVELLDTSNKKSKDLSEESKKELDEAVKEVETIVRNNVGEEAIRRVLKKLEEIAKRLLDENRRVLEESKKIIDKLEEDNRRSHRELKRILDELRKRIK

SEQ ID NO: 26078 - protein, 185 aa, Artificial Sequence; identical to SEQ ID NO: 26077
  Synthetic sequence.

SEQ ID NO: 26079 - protein, 181 aa, Artificial Sequence
  Synthetic sequence.
KEAEDLEKKVEDILRRVRELLEELHRRSEKILKDVKDRSRDLLRRVREILKRVEEKKERVREDELDKILKEVTERVKRVLEESEELLRRVEKVVKDINKRAEEILERVRKVVEDVLDDMRKKGVDERLVREVEKKLRTVEEEVRRIVKENKERLDEAREDVKRSNKTIRDELERARERIET

SEQ ID NO: 26080 - protein, 181 aa, Artificial Sequence; identical to SEQ ID NO: 26079
  Synthetic sequence.

SEQ ID NO: 26081 - protein, 181 aa, Artificial Sequence
  Synthetic sequence.
SEAEDLTRRVREILKRVEDLSKKLNDDTKKILDELRELSKRLMEEVKKILRRVEEKKERVSEDELRRILEDVRRRVEEVVKTSERLLRRVEKASKDSVETSRRLLERLREFVRRVLEEARRRGVDKRLVDTVREELERVRKKVEDSDRRNEEELRKVKEEARRSNERIRELLKTVEDRIRT

SEQ ID NO: 26082 - protein, 181 aa, Artificial Sequence; identical to SEQ ID NO: 26081
  Synthetic sequence.

SEQ ID NO: 26083 - protein, 181 aa, Artificial Sequence
  Synthetic sequence.
DEVRKLVREVEDILRRVREKSERLVRLVEEILRRVLEESRRLLEETREILERVEEKKERVSEKELKEILEEVARVSEKTVRDSERLLDDVRRKVEEVLERSRRLLDEVRKTVEKVLEDARRRGVDERLVREVKELLDRVADEVRKSDEDIRRLLEDAARKVEESNKRNRDLLETVRRRIEK

SEQ ID NO: 26084 - protein, 181 aa, Artificial Sequence; identical to SEQ ID NO: 26083
  Synthetic sequence.

SEQ ID NO: 26085 - protein, 178 aa, Artificial Sequence
  Synthetic sequence.
SEVEKLKKEVKESSKEVIKEVEKLHRESEKSSEDVKREVEKLHRRSKEVADEVRERVRRRKDKEVIDKLADDLRRIAEETIDRVKKLVDEDREVVKDTIRRLRELADEDRRRVEDVIRKIRDERVVEEIERDVRESLRRIEEIIRRNEKRVRESLEDLKRILRENKETVRKVVDELRK

SEQ ID NO: 26086 - protein, 178 aa, Artificial Sequence; identical to SEQ ID NO: 26085
  Synthetic sequence.

SEQ ID NO: 26087 - protein, 178 aa, Artificial Sequence
  Synthetic sequence.
SEVDDLTRRVRDVLRRVEEKVRDLHRRSEKVARDVEREVEELHERSKDVARKVEEKVRRIERREDIKKLAEDLKRIVDESIKRIEELAKRLEKIVRETIKKVRELVEEVKRIVDDVIRKIRDKDVVDRIRREVEEMLRRLEDILRRNEDTVRRVKEKLKRIVKRDEEEVRKVLDRLRK

SEQ ID NO: 26088 - protein, 178 aa, Artificial Sequence; identical to SEQ ID NO: 26087
  Synthetic sequence.

SEQ ID NO: 26089 - protein, 178 aa, Artificial Sequence
  Synthetic sequence.
SEVEELKKRVEDVAEEVKDRVRKLHEKSERSSREVEKEVRKLHEESRRVAREVTERVRRIDDRDTIRELVERLKDIFRKSIEDIKRLVEEDKRRVDETIKEIKRLVDELRERVTRVIEKIRDEEVVKEIRDTVEKVLEEARKIIEDNRKRVAESVETLKDIIRRDEKTMRDVVDELRT

SEQ ID NO: 26090 - protein, 178 aa, Artificial Sequence; identical to SEQ ID NO: 26089
  Synthetic sequence.

SEQ ID NO: 26091 - protein, 178 aa, Artificial Sequence
  Synthetic sequence.
DEVEELRREVEESSRRVEKEARRLHKRSEESSREVEERLKRLHDDSRRVAREVEEIVARSEDRRVIEDVVRRLEEEVKRSIETMEELVKRDRDVVRKTIEDMERLAREDRKIIERVIKEIQDEDKVRDIKRRIDESKRKIEEIIKRDKEEAEKSEEKIKEIIERDRETVERVVRKLRE

SEQ ID NO: 26092 - protein, 178 aa, Artificial Sequence; identical to SEQ ID NO: 26091
  Synthetic sequence.

SEQ ID NO: 26093 - protein, 182 aa, Artificial Sequence
  Synthetic sequence.
EIEEIEEELKDRVRRSEEKLRRIEKELRELVEKSRKELEDLLDKDRRDMKRVADELRRDDGPDVEEALRRITEVTRKSEEEVTRLVEENKRVVEDIRRLLRELAKENKDVVREIRDLLKKVDDRRVVEELTRKLEESIKKSEDEVKKVKERLEESIRRSKERLEDARRESERVLTEIRERLR

SEQ ID NO: 26094 - protein, 182 aa, Artificial Sequence; identical to SEQ ID NO: 26093
  Synthetic sequence.

SEQ ID NO: 26095 - protein, 182 aa, Artificial Sequence
  Synthetic sequence.
EVERILDELRRRVEEVVKENEKALDTLRKESERTEEENKRLLDEAREKVDRVVKELKRDDGPDVEELLREIRTVLEDVKRRVEKSTREDKEVVKDVERLVRESSKDIRRVLKEVEEELRKTRDEKVLRDLAKKLEDVIRKSEELTKELAKRLRESSKRSIDLTRELLKRLEEVLKKVRDALR

SEQ ID NO: 26096 - protein, 182 aa, Artificial Sequence; identical to SEQ ID NO: 26095
  Synthetic sequence.

SEQ ID NO: 26097 - protein, 182 aa, Artificial Sequence
  Synthetic sequence.
SVEEIVEEIRRRSKETEDRNRRVVEELEERVRRVLEELKKIVEDARRKVEKVARELKRDDGPDVDELLKEIRDVLERVVTEVEKLLERIKKVLREIAERIKRSSERDREVVERVEKRLREVRDEKVVEELLRRLKETSDDSLRRTDELRKELERVLKEVRERLKELDRELKRVLDDVREKIR

SEQ ID NO: 26098 - protein, 182 aa, Artificial Sequence; identical to SEQ ID NO: 26097
  Synthetic sequence.

SEQ ID NO: 26099 - protein, 183 aa, Artificial Sequence
  Synthetic sequence.
KLEDILRKIEKELKEVKEKSERIVREIEKRHEDDKRRVEDIVRRIKEEVERVVKEIKEAPVPEEVIRDLIRLLEEVLREVDEVLKRVRDLNRRVVEEVRKVSEENEKLLRELLRRVREVLRANRDEVMKKVEKEVRDVIKELEDTAREVEKKSEKVLKETNDLAKEVMDKVRKVAEDLRKKLE

SEQ ID NO: 26100 - protein, 183 aa, Artificial Sequence; identical to SEQ ID NO: 26099
  Synthetic sequence.

SEQ ID NO: 26101 - protein, 183 aa, Artificial Sequence
  Synthetic sequence.
ELEEIVRRIEEEVRRADKEVKEILTEIEKEHRRDVERSDRSLEKIKRDVDRALEEVERVPVDEKVIRRIEKLLRDVLEKVKRVSERVKELNTRAVDLVRRVVEEISELLKRVLDRVRDILKANRREVMKKVTEEVREVLDRLRELLKEVAKRSEEVIKRTNELNETVMRDVERVLRELREELR

SEQ ID NO: 26102 - protein, 183 aa, Artificial Sequence; identical to SEQ ID NO: 26101
  Synthetic sequence.

SEQ ID NO: 26103 - protein, 174 aa, Artificial Sequence
  Synthetic sequence.
SEVEKLEEDFREMIERSERTLEKLKKENEDASKKSKEKLEKLLREMKEIIDRIRDLIRKGRDITELLRRLEELLERIEEELKESIRESRKLLEDIERISRDSIRRLRELLEKAERDGADEEVIKKLRELLERLEREHRKVIEELKKSNKKNEEDIRRVLEELRRLVKKLADDAR

SEQ ID NO: 26104 - protein, 174 aa, Artificial Sequence; identical to SEQ ID NO: 26103
  Synthetic sequence.

SEQ ID NO: 26105 - protein, 174 aa, Artificial Sequence
  Synthetic sequence.
REAEELLKEMKRASEKSEKIIEDLRRENEKLSKESEDIIRKLKEDNERMIRTIEELIRAGRDIDKLKKESEKLLKEIADELERSIRESRRLLEEIEKILRKSIKELRDLLEEIERRGLEEEVIKELRELLERNEREIKKVLDELRRSNEKNERDIERALEELKRTNDELAKRAK

SEQ ID NO: 26106 - protein, 174 aa, Artificial Sequence; identical to SEQ ID NO: 26105
  Synthetic sequence.

SEQ ID NO: 26107 - protein, 174 aa, Artificial Sequence
  Synthetic sequence.
DEVEKLRREIEEIIKEWEKRTRDLKREMKKISDDSRRRIEELLRDFKRIIDELRKAIEDGRDVTDLLRELRRLLEEIERRLEESIRRLKELLDRIHEEDKRLRKELEDLLKRVEDDGLSKEVIERLRELVKRVTDKVRKVNEELRKLLEDNADEIRRAIERLRELLRRLEEEAR

SEQ ID NO: 26108 - protein, 174 aa, Artificial Sequence; identical to SEQ ID NO: 26107
  Synthetic sequence.

SEQ ID NO: 26109 - protein, 174 aa, Artificial Sequence
  Synthetic sequence.
SEVEKLVREAEKIIEDIRRVIEELLRRARKINKEWDDVSRKLKEDAKRIIDTVLKLIREGRDITELAKRLDELLREIKKINDEMLKRDRDLVDEIRRRLERLLEELRRLLEKIRADGLDKDVIERLRDLVRRVKEDIERVLDEWRKSSEEAEERSRRVIEELRRLLEELKERVR

SEQ ID NO: 26110 - protein, 174 aa, Artificial Sequence; identical to SEQ ID NO: 26109
  Synthetic sequence.

SEQ ID NO: 26111 - protein, 182 aa, Artificial Sequence
  Synthetic sequence.
SELEELKKTMDEVNKETKKENDRLLDEARKVNEESRRRLEKLRKELDDVVREVEDARRRNTDKDELLRKLREILDRVRRDVERIVKRNKEILKRVEEDLRRLNEENRRILKELEDRARKNNVRSDKVERVLRELRKSSRKVHEDSKKVVEDLERSSRTVEKELRDALKELEDKVREVEKKLK

SEQ ID NO: 26112 - protein, 182 aa, Artificial Sequence; identical to SEQ ID NO: 26111
  Synthetic sequence.

SEQ ID NO: 26113 - protein, 182 aa, Artificial Sequence
  Synthetic sequence.
DELEKLLEEARKVNEETKEANERLLREMEKVNKESEDANRKLLEELKEVVDRVDDLARRNSDRDDLLRRLEEILEDLRRKAEELNRRNKRILEEVEKRLEDLNRENERILREVEERLKKANLSSEDVKRVVDELRESSREVHRRSREVVERLRRSSEEVHKKSRDVLRELTRLVREVKERLR

SEQ ID NO: 26114 - protein, 182 aa, Artificial Sequence; identical to SEQ ID NO: 26113
  Synthetic sequence.

SEQ ID NO: 26115 - protein, 182 aa, Artificial Sequence
  Synthetic sequence.
DELETLLRELERVNKETERELERLKREAEEVNKATRKDLDELRKEIDKVVKEVEEARRRNKDKDDLLRRLRDILRRVTEKLRKLIEDNERITEKIVRELKRLVRENEEILREVKKRLDEANLESERVKKVVDELRDSSRRVKEKLEDVVRRLRDLSRRTKEEVEKVEEDLRRKVREVEERLR

SEQ ID NO: 26116 - protein, 182 aa, Artificial Sequence; identical to SEQ ID NO: 26115
  Synthetic sequence.

SEQ ID NO: 26117 - protein, 182 aa, Artificial Sequence
  Synthetic sequence.
DELETLLDEAKKVNEETRRANRELRERVREVNKRTEEELKKLRDRLEKVVDDVDKLRKRNTDTEELLRRLREILKRIEEELEELKERNRRITTRVEEELERLNRENEEITRRLTERLRRANLESRRVREVEERLKKLSEDTHRDSRRLVEEMRRLSKETEKKVEDVVRDLRRLVKEVEERVK

SEQ ID NO: 26118 - protein, 182 aa, Artificial Sequence; identical to SEQ ID NO: 26117
  Synthetic sequence.

SEQ ID NO: 26119 - protein, 182 aa, Artificial Sequence
  Synthetic sequence.
DELEKLRRELEEANRRTKKANEEILREAERVDERSEEELRKILETLKKVVKDVDDMARRNSDKDELLKRLREILKELEDRLRDIVRRNREITKDLVERLKELNRRNEEITRRLTEDLRRANLEDRRVRTVVEELKKLSRETHEDSKRVVEELERLSRESERKLREVVKEMRKLVKDVEDKVK

SEQ ID NO: 26120 - protein, 182 aa, Artificial Sequence; identical to SEQ ID NO: 26119
  Synthetic sequence.

SEQ ID NO: 26121 - protein, 182 aa, Artificial Sequence
  Synthetic sequence.
DELEELLRRVEEVDKESKRRLDEIKRRMKEVNDRTREALRDLLRRLAEVVKRVLDLIRRGSDKDRLLEDLRRILREVKEAAKELLKRNREITEKMVRDLKRIVKDNKKILDDVEKTLREANLESERVKKVVDDARDSSRKTVERLETVVRDLKRSSDDVEREVRELLKELERLVKKVEDDAK

SEQ ID NO: 26122 - protein, 182 aa, Artificial Sequence; identical to SEQ ID NO: 26121
  Synthetic sequence.

SEQ ID NO: 26123 - protein, 183 aa, Artificial Sequence
  Synthetic sequence.
RELEELLRKVRKLVEEIERELKKLLEEDRRLSEESREELRKLLEDARRMIREIEELLKRRRTEEVSTTIDKILKEVEKKVKDLERRSKKISEDSRRKAERVLREIKRILEEIEKDVERVLRERDSEDAKRVLKEIRRLAEELKKSVKRVIEEVEDSNRRNEEEVRRVLEEIRRLLEDLDRKVK

SEQ ID NO: 26124 - protein, 183 aa, Artificial Sequence; identical to SEQ ID NO: 26123
  Synthetic sequence.

SEQ ID NO: 26125 - protein, 183 aa, Artificial Sequence
  Synthetic sequence.
SELEELLKDAKRVIDTSRRLITELEKRDEEIIRRIKDLLRRVTEEAKRMLDEIREELKRRRDEEVKKRIKELMDKIREDLKRVLEEIDKLSRDSEEDVRRVLDENRKLVEEVERKVREVLRRRDSEKAKRVLEEIRKLLEDSKKESEDVARKLKKSNDELRRDVERVLREIEKRLEDLKREVE

SEQ ID NO: 26126 - protein, 183 aa, Artificial Sequence; identical to SEQ ID NO: 26125
  Synthetic sequence.

SEQ ID NO: 26127 - protein, 183 aa, Artificial Sequence
  Synthetic sequence.
SELEKLLREVEKIIRDSDDLLRRLEKRNRDLIRTSEKLLKEVKDDVDRVIRELERLLEEERSEEVARRIEELMREVEEKAKRLLKENEDISRRSREDVRRVLETNKRLLDEIRRRVKDVLDRRKSEKAEDVLRRIEKLLDDSRRRSEKVAKELEESNERSKRKTEKVLKEIKEALDRVREKVK

SEQ ID NO: 26128 - protein, 183 aa, Artificial Sequence; identical to SEQ ID NO: 26127
  Synthetic sequence.

SEQ ID NO: 26129 - protein, 179 aa, Artificial Sequence
  Synthetic sequence.
SEIEKVARDVEELLKKVEKKNRDMVERVRRLLEKVKRENEELVRRVEESNERLKERVDRSNRDERIRRDVERIVKESEDLLKESHDIVKKIIEEVDELLKESHKRVREIIERIKEMVKDGGERVEELEKTVRKLARDAEKISEDVERRVRELARRLRKISEEVLRRNKELVRRVDEEIR

SEQ ID NO: 26130 - protein, 179 aa, Artificial Sequence; identical to SEQ ID NO: 26129
  Synthetic sequence.

SEQ ID NO: 26131 - protein, 179 aa, Artificial Sequence
  Synthetic sequence.
SEVEEAVERVKKLLEKVRKDNEEFRERVRKSNEEAEERNRRVVEEVRRSNEELKEKVERSNRDERIKEKVKRIVETSEKLLRESHKTAKDIIRETEELLERSHEIVREIIERVKKLLDEGGEDVEDLKRRVKELADEARRISEKVLRDNKRLLTELDKISERVLRENEKLVREVEETIR

SEQ ID NO: 26132 - protein, 179 aa, Artificial Sequence; identical to SEQ ID NO: 26131
  Synthetic sequence.

SEQ ID NO: 26133 - protein, 179 aa, Artificial Sequence
  Synthetic sequence.
SEIEKVAREIEELLRKVAEDNRRMVERVRRLLEEVKTRNKKMVDEVKESNERLKDKVRRRNASEEIKKRVDEIVETSKELLKRSSEEVERIREEVEELLRRSHETVREVERRLKDLVRKGGERVEELKRRAERLIEELRKISEEVERRVKRLVEELEEITRRIKEENDKLVREVEKELK

SEQ ID NO: 26134 - protein, 179 aa, Artificial Sequence; identical to SEQ ID NO: 26133
  Synthetic sequence.

SEQ ID NO: 26135 - protein, 179 aa, Artificial Sequence
  Synthetic sequence.
SEVEKVVEELKDLVRKSSEKNRKVAEEVKKSNDDLRRKVEEAVREVRESNERLKREVDESNRDERIREKVERIVRESEKLLKEIEDRAREIVKTTEDLLRESHKRNKEIEEEIRDLARKGGERVEELKDRVRKLIEESERISREILKTNRKLLKELEELLKRLLKRNRELVREVKEEIK

SEQ ID NO: 26136 - protein, 179 aa, Artificial Sequence; identical to SEQ ID NO: 26135
  Synthetic sequence.

SEQ ID NO: 26137 - protein, 179 aa, Artificial Sequence
  Synthetic sequence.
SDIERVVKEVKDLLEEVRKDNERVMDEVRKLLEELKRKLRKVVEEVRRSNEELKKEVDRRNVSEEIRRKVEEIVRRSEELLKRLEDTVKDIERKVRKLLEDSHREVKKAEDRIRELLKRGGEDVETLRKEVEELADDLRRISEEVRDRVRKLVTKAEEILRRVLETNKKLLKEVKETLK

SEQ ID NO: 26138 - protein, 179 aa, Artificial Sequence; identical to SEQ ID NO: 26137
  Synthetic sequence.

SEQ ID NO: 26139 - protein, 179 aa, Artificial Sequence
  Synthetic sequence.
SEIEKVAEEIKKLLRKVEEDNKTVVEEVRRSNEKLKRDNDKVVRDVERSNRELKEELDRSNVDEEIRKKLKEIVDTSRELLRESSERLEKIVRETEKLLEDSTREVKRVVTEIKDLVRKGGERVEELKKRVEELARRAKEISDKVRDDNEKLLRELREITKRVKEENDRLLKEAKDAIK

SEQ ID NO: 26140 - protein, 179 aa, Artificial Sequence; identical to SEQ ID NO: 26139
  Synthetic sequence.

SEQ ID NO: 26141 - protein, 179 aa, Artificial Sequence
  Synthetic sequence.
KEIEDVAKRVEELLRESSREVEEVLREVEELVRRSTRRNEEAVRRVRKSNKELEDEVRRSNRSEDIKRRVKEIVEESKRLLEESSKRNRDIAEEIRKLLETIKRLNDEMVRRLKELVKKGGEDVKTLLDEAKRLVDRSRELLERLLRDVRRLIKESDKITRELERKNEKLLKEVKEEID

SEQ ID NO: 26142 - protein, 179 aa, Artificial Sequence; identical to SEQ ID NO: 26141
  Synthetic sequence.

SEQ ID NO: 26143 - protein, 179 aa, Artificial Sequence
  Synthetic sequence.
SEIEDAEREVRRLLRESSERVKTVIEEVRELLRRVKRENDEAVKEVEKSNRDLEDKVRRGNLSEEIKKKVEDIVRESEDLLRRSSERVRELVEEIKRLLEELKKRNDELVRRIEELVKKGGERVEELKERVKRLVADSERLLKELRDRVKELADEARRTTEEVLRRNRELVRRIEEDIR

SEQ ID NO: 26144 - protein, 179 aa, Artificial Sequence; identical to SEQ ID NO: 26143
  Synthetic sequence.

SEQ ID NO: 26145 - protein, 184 aa, Artificial Sequence
  Synthetic sequence.
SELDEVLKTVRKIIEENEKIVKEVLDTSRRSVEEVRKHTKEVLDRVRELAKELEDATRKTSRKEDLERLLREVADRIRKLIEENRELVDRVNKENRRLIRELEERNKRSAEDLKRLIDELRKSSQTEEVDKVAEEIEKLVRESNRKVREVVKEIEKLNRDMRKESEDAVKEIEELLRTLEEKVR

SEQ ID NO: 26146 - protein, 184 aa, Artificial Sequence; identical to SEQ ID NO: 26145
  Synthetic sequence.

SEQ ID NO: 26147 - protein, 184 aa, Artificial Sequence
  Synthetic sequence.
SELDEVLKTVEKIIRDNEEIVKEVLRRSERSIKELKKHTDDILRKARKLAEELKRVVERTEDKRELERLVRRVEKEVRDLIRENRELVKEVNDRNKKLIDELKKINDDSRKTLEELIRDLERREDDKRVKDVAERIRELVEESNRKVREVVERIKDLNRKVNKTSEDAAREIEKLLEELREEVR

SEQ ID NO: 26148 - protein, 184 aa, Artificial Sequence; identical to SEQ ID NO: 26147
  Synthetic sequence.

SEQ ID NO: 26149 - protein, 184 aa, Artificial Sequence
  Synthetic sequence.
DELEEVLKRVREIIKRNEDHSDRVREKSRESVKELEEHTERVLRDVERLARELEEMIDKTDDKRDLKRLVEEVRRRIKKLIEENRRLIEEVNRRNEELIKENEKLNRESEERIRELIEDLRRRRQDKKVDDVAREIEKLLKESNDKSRELVKEIKDLNKRLNEKSEEAVKRIEDLLRRIEERVR

SEQ ID NO: 26150 - protein, 184 aa, Artificial Sequence; identical to SEQ ID NO: 26149
  Synthetic sequence.

SEQ ID NO: 26151 - protein, 184 aa, Artificial Sequence
  Synthetic sequence.
KELEDVLERVKEIIKRNEEILDKVRREVEESVRRAEEILKEVLERVRDLVRKLDDIKDKMDDKKDLKKIVDDVKKEIEDLIKELEEIITELNKENRDLIRRLREINKRSREELEELIRDLDRRRRDEEVKRVADEIKRLADESNEKVRRVVRRIDELNKEVDRKLKEVMKEIKKELEDAERRVR

SEQ ID NO: 26152 - protein, 184 aa, Artificial Sequence; identical to SEQ ID NO: 26151
  Synthetic sequence.

SEQ ID NO: 26153 - protein, 184 aa, Artificial Sequence
  Synthetic sequence.
DELEEVLRRVRKIIEENKEIVRRVLEDVKRSVEELERHTERVLREAKRLADELEDARRKIERKEDLARLVEEVKREVTRLIKENKDKIRKVNEDNRKLIEELKKINDDSKRTIDELIRDLDRRRRDEEVKRVAKELRELLERSNREVRRVVEEIKKLNDEVRKKSEEMRRRIEKLLEELERKVK

SEQ ID NO: 26154 - protein, 184 aa, Artificial Sequence; identical to SEQ ID NO: 26153
  Synthetic sequence.

SEQ ID NO: 26155 - protein, 184 aa, Artificial Sequence
  Synthetic sequence.
SDLEEVLRRAEKLIEDLERIVRKVLEDSDRSIDEVRRHTEKVLRDVRKLAEELKDIARKTSRKEDLRRIVEEVKREVKELIKDNRRLLERVNRENEKILRELRKIVEKVKRDVERLLDALDKRSRTEEVKRVIDEIRDRLRKAEERVRKVIEDIKRKNKKLREDSEKAEREIDELLRKVEEDVK

SEQ ID NO: 26156 - protein, 184 aa, Artificial Sequence; identical to SEQ ID NO: 26155
  Synthetic sequence.

SEQ ID NO: 26157 - protein, 184 aa, Artificial Sequence
  Synthetic sequence.
SELEEVLERVKDLLKKLKEHSDRVLEESKESIDRVRKHTEEVLRTARELIERLDEMRKRTSDKKDLKDLVEKVRKTVEDLLRENEELLRRVNDRNRKLIERNRDLLRKVATTVDRLIKELDKRSRTEEVKDVAREIRRRLDELRKDSERVAEEIRRLNKKLRDESRKAIKEIEELLRRVTKKVE

SEQ ID NO: 26158 - protein, 184 aa, Artificial Sequence; identical to SEQ ID NO: 26157
  Synthetic sequence.

SEQ ID NO: 26159 - protein, 184 aa, Artificial Sequence
  Synthetic sequence.
DELEEVLERVRKLIDELRKHSKEVLDTVRDLLRRHKKKNEDSLRTVRKLLTDLEDAVRKIERKEDLRRLIEDVKRKVEKIIRDNERHLREIEEEIRKLIEENRKLIEEVIRRIEELIKELDKRERDERVKRVAEEIKKLLEDLRKESEDVVKELEDLLDELRRRTEKVVREIEELLKRLEERVK

SEQ ID NO: 26160 - protein, 184 aa, Artificial Sequence; identical to SEQ ID NO: 26159
  Synthetic sequence.

SEQ ID NO: 26161 - protein, 177 aa, Artificial Sequence
  Synthetic sequence.
SEVERVERRLEKVIEEDKERTKRVEREVEDSNKKDDDLTREVLDRVRKSARDVERKLEEGKDEELLRRVLARHEEKNKKLEDDLRESTRRNAEEIKRLKKEIKESTDRTRRELEDLERKLDSREALRRLRELVKKLEDDNRRVLRRLDKLLDDVRKKNEEAMRESRDLSRKVAEKIR

SEQ ID NO: 26162 - protein, 177 aa, Artificial Sequence; identical to SEQ ID NO: 26161
  Synthetic sequence.

SEQ ID NO: 26163 - protein, 177 aa, Artificial Sequence
  Synthetic sequence.
DEVREVEKRVRESNERDKKLLREVLEEVRRSDKDDDDRTRKVLKRVEKAAEEVKRLLEKGEDRELLERVLDKLRRFIEKLKKELKESDKENEDRIRDLKRRLEESNKRNDDTIKDLERKLRSEDVIRKLRKSLKEVKDDSRRVLKELDDSLRETHKRNRDAMRRLDELLEEVARRIK

SEQ ID NO: 26164 - protein, 177 aa, Artificial Sequence; identical to SEQ ID NO: 26163
  Synthetic sequence.

SEQ ID NO: 26165 - protein, 178 aa, Artificial Sequence
  Synthetic sequence.
DEIEEIKRRIEKSSEDDKRVLRELEARAREIRKELDERVKRLEKRIKELLERLRKLKEDNRDLTEALRDLERVLEEIKRRLEEVARELKERLDEIADESRRTVEEDRRRLEELKRRVGDDRDVRRVLEEWKRLSRKNEEENKAVIEKLRALLEDLKRRLKEVLKRIAELVKKIADELK

SEQ ID NO: 26166 - protein, 178 aa, Artificial Sequence; identical to SEQ ID NO: 26165
  Synthetic sequence.

SEQ ID NO: 26167 - protein, 179 aa, Artificial Sequence
  Synthetic sequence.
RESEELRREIEKISRENKELVRRLEEAIKRLSDEDKELVERLRRETKKIADKVEDLLEKLKDVKEVVEKLLRDLKRLNDRVERESRESIKKLRDLVKKIKEASERSEREFEKLLEEIRRRRKEAEEVLREIKKIIDDNRRENREALERIKDIVRRNEEENEKALRESRKRTRELEERLR

SEQ ID NO: 26168 - protein, 179 aa, Artificial Sequence; identical to SEQ ID NO: 26167
  Synthetic sequence.

SEQ ID NO: 26169 - protein, 177 aa, Artificial Sequence
  Synthetic sequence.
SRVETIRKRVEDLIRRSEDLIRRLEEDVKRVVDEIRKLLEKLKEDDERVIRRIEDLLRKERSEEVEREIEELSKKSLDDARRVLEEIEKLARTITKEVERVLEENDRLIRKIEDEVRKINVDERVVEEIKERLDRSRRRTEEALERIRKRLEEVKKEVEDVLREVEKTNREIKKEVR

SEQ ID NO: 26170 - protein, 177 aa, Artificial Sequence; identical to SEQ ID NO: 26169
  Synthetic sequence.

SEQ ID NO: 26171 - protein, 177 aa, Artificial Sequence
  Synthetic sequence.
SRVDELRRRVEELLKRSKELLEEIKRRDEEVLRRIKELLDRLRERVDDALRKISELLTRERSEEVARRIRELLKEIEDDVRRVKKEIEDLSEDSKRKAEELLRRNEELVKRIDEEVKRINVDEEVVREIKKKLTESREDTKRLLEELKKTNDDIRKDVERLRREVEKKVRDIERRVK

SEQ ID NO: 26172 - protein, 177 aa, Artificial Sequence; identical to SEQ ID NO: 26171
  Synthetic sequence.

SEQ ID NO: 26173 - protein, 178 aa, Artificial Sequence
  Synthetic sequence.
SEVEKLLEEVRELTKRHKEELRRLNKEMEKATRDHLRKSKKLNDEAREMVRRVEELVKNNGDKDTILKTIEDVLRELEKRHKELLDTNRELLDRLRKEHDRLLKHNREVIEDVKRRLDETERAARVKEELDKLHKDLEREVRESKRTLKELHDRLRKAVEESKEHLKRLLDELRKKVK

SEQ ID NO: 26174 - protein, 178 aa, Artificial Sequence; identical to SEQ ID NO: 26173
  Synthetic sequence.

SEQ ID NO: 26175 - protein, 178 aa, Artificial Sequence
  Synthetic sequence.
DEVERLLEEVRRVVKEIEDRSRKLNEDARRVTEDHLRKSEELNRRVEDAVRRIRELTKNNGDKDKILEDLERLVREVLKAHDELLRTNRELLEEIKRRHDELLRTAEEIIRRVEERLDETEEARKIRETLKRLLDELRKKLEESKKHLDELHDRLRRELEKSKRHLEELLKRLEDELR

SEQ ID NO: 26176 - protein, 178 aa, Artificial Sequence; identical to SEQ ID NO: 26175
  Synthetic sequence.

SEQ ID NO: 26177 - protein, 178 aa, Artificial Sequence
  Synthetic sequence.
SELERLLEKARRDTERHLRESERLNRELKKATDDHLRKSRELNKRLEEVVRRVEEESRNNGDKDELLKRLEELVRRLKEEHERLLRTNRELLRRLTEEHERLLKHNRDLLKDIRDKLEKTREAKKVEDDLRDLHRRLKEAVDRSKKHLEDLHKELEDELKRSIDHLRKLLEEVKRKLD

SEQ ID NO: 26178 - protein, 178 aa, Artificial Sequence; identical to SEQ ID NO: 26177
  Synthetic sequence.

SEQ ID NO: 26179 - protein, 178 aa, Artificial Sequence
  Synthetic sequence.
SRVEDLLRRVREVVKRVKKDLTKLLEEVKRMTDEHLKRSKELNDRAEEIVRRLKELLDRRGDKDEILRRIEEVAKRLTEEHKRLLKTNKEVLDEVRKELERLLDELREIIERVKRELDDTERAREVVERLDELLKEVADRVEEVKDRLRKLHRKLEESVKKSLEHIKRLIDDLRRKAK

SEQ ID NO: 26180 - protein, 178 aa, Artificial Sequence; identical to SEQ ID NO: 26179
  Synthetic sequence.

SEQ ID NO: 26181 - protein, 178 aa, Artificial Sequence
  Synthetic sequence.
RELEKLLEDARRVVTTLTRASEKLNEDVKKVTEEHKDRIRRLLDTVRRIVEEVDKRTKGKGDKEKLLRELEKAIRDVERKLEELLKTNEELLREVKKKHDELLRTITEVMKEIAERLKKTEEARKVKEELDRLLEDLRKKLEDSKRHLDELHRELEETVREVSERLKELLDAVRRRAK

SEQ ID NO: 26182 - protein, 178 aa, Artificial Sequence; identical to SEQ ID NO: 26181
  Synthetic sequence.

SEQ ID NO: 26183 - protein, 178 aa, Artificial Sequence
  Synthetic sequence.
SELEKLLKDVADMVREITERSKKLNDELKKLTEDHDRKIKRLNERLEEIIREVEKLVDDNGDKDRILARVEKLVEEAKRAHDDLLRTNKEMVDDLKRRHDELLRRIDEIIKDARRKLSETDEARKVAERLKELLDRLRRKLEESKRHADELHERLRKSVEDSKKHIKDLVDELKRRVD

SEQ ID NO: 26184 - protein, 178 aa, Artificial Sequence; identical to SEQ ID NO: 26183
  Synthetic sequence.

SEQ ID NO: 26185 - protein, 178 aa, Artificial Sequence
  Synthetic sequence.
SRVEELLKRLEDATRRHLEVSKRLNDDLRRATKDHLDKLRELNERVKKVVDDVVEKIKSNGDKDKLLRDAEELVRRVKKRHDELLKTNEDLLRRLEELHKRLLDHNRELLREIKERLDDTEEAREVRERLDRLHEELEKEVRRSEKTLKELHDRLRKEVERSKRHLDELLKDLEDKVR

SEQ ID NO: 26186 - protein, 178 aa, Artificial Sequence; identical to SEQ ID NO: 26185
  Synthetic sequence.

SEQ ID NO: 26187 - protein, 178 aa, Artificial Sequence
  Synthetic sequence.
SRVEKLVREVEKVVEEVERTIRKLLEDVKEMTDRHLKMIEDLNRELEEIVRRVTELIKNNGDKDRILEEVEKAVEEVDRRHKRLLETNKEIIDEVKKRLDDLLRRLRKIADEVRKRLDDTDEARKVKKRITELVERVEREVDRVKKELEKLHERLKREVEKSSEHIKRLLDELRKRAE

SEQ ID NO: 26188 - protein, 178 aa, Artificial Sequence; identical to SEQ ID NO: 26187
  Synthetic sequence.

SEQ ID NO: 26189 - protein, 178 aa, Artificial Sequence
  Synthetic sequence.
RELEEILRRVKEVTKDHLDKIDELNKRLDKATKEHLERLRDLNRRLKEVVERIEEEIRNNGDKKKILERLERVIRELRKRHKDLLDTNRKLLEELRKRHKELLDHNREVVERVEEELKETREADKVRKDIRRLHEELAREVKKSEDHLRKLHEELRDEVRRSEEHLDALLEDLKRKVD

SEQ ID NO: 26190 - protein, 178 aa, Artificial Sequence; identical to SEQ ID NO: 26189
  Synthetic sequence.

SEQ ID NO: 26191 - protein, 178 aa, Artificial Sequence
  Synthetic sequence.
SELEKLLRDMEEATKRHDEMLKKLNDEIRKVVERILKELEDLNRRLEEIVRRLKEESKNNGDKDRILEEIRRVVRELEERHDRIEEEIRRVLERLEREHERLLEHNRELLEDIKRRLSKTEEADDVRRRLERLHRELRKSVETSKKHLKELLDRLAKSIEDSKKHARELLKRLEEDIK

SEQ ID NO: 26192 - protein, 178 aa, Artificial Sequence; identical to SEQ ID NO: 26191
  Synthetic sequence.

SEQ ID NO: 26193 - protein, 178 aa, Artificial Sequence
  Synthetic sequence.
SEVEELLDRVRKVVEDLMRESKRLNDELKKIVDDILRRLRELNKEIKDVVDEIKKLLDNNGDKDEILKTIKKVLEDLKRKHDELLKRITEVVEDLKRKHDRLLEEAEKVIEDVERKLDKTEEADKARKDLKRLLDRLRREVERSKEEMDKLLEDLERAVRESEKHLEKLLRDLERRAR

SEQ ID NO: 26194 - protein, 178 aa, Artificial Sequence; identical to SEQ ID NO: 26193
  Synthetic sequence.

SEQ ID NO: 26195 - protein, 178 aa, Artificial Sequence
  Synthetic sequence.
SRLEELLKRLDDIVKRVLTKIRELNERLKKIVEELLRRSEELNREVRRVAEEIRRLEEGNGDKDKILDEIRRILKRLKEEHERLLKEAKEVVDKLRRDHEELLRELKEAADDAERKADDTDKARDVRRTIRKLVRDVAEAVRRSTEHIDKLLEDLEREVRRSERDIERILRELEEEAR

SEQ ID NO: 26196 - protein, 178 aa, Artificial Sequence; identical to SEQ ID NO: 26195
  Synthetic sequence.

SEQ ID NO: 26197 - protein, 178 aa, Artificial Sequence
  Synthetic sequence.
SDVEKLLEDVRRMTEEHKELIKELNERVERIVRKVVEDSKKLNDELREIVKRVEDESRNNGDKDKLLKELRDVVRELKKRHDDLLRDAERVIEEAKRRHDELLKHNKELIDDVKRRLQETEEAARVREDLDRLHEELERFVRESKKHLDEMLKELRRRLERSKEEIDRLVKEAEEKLR

SEQ ID NO: 26198 - protein, 178 aa, Artificial Sequence; identical to SEQ ID NO: 26197
  Synthetic sequence.

SEQ ID NO: 26199 - protein, 175 aa, Artificial Sequence
  Synthetic sequence.
REVEEVLKEVKKIVDRNREELKRVLDEIRELVKRIEDDLRRVNEESEKLVRTLLELMRRGELREEEIRKIIEDIERKYRELERKVEEIIKEIEERITRLEEKNRRNLEDIRRLLDEINAPEEVRERIERLIEKSERDVREVKKKVEELARRLREEVEKLKKHVKRLLEELKKAAD

SEQ ID NO: 26200 - protein, 175 aa, Artificial Sequence; identical to SEQ ID NO: 26199
  Synthetic sequence.

SEQ ID NO: 26201 - protein, 179 aa, Artificial Sequence
  Synthetic sequence.
SEAEDALRKIKKLVDEVVERIKKVDDDSRKLVEEVERTIEKLDKESEDLVKKVKDMKRRGDVREKDIKRVIDTSRELVKKLKEDVDRVVEEIKDLNRKLNEDVKRVMDEIRELLKELEKRGVLREEVKKEVKRLLEELKRRLDESNKRNKRLIDELRKKLEDSRRRNEELLRDLKETAT

SEQ ID NO: 26202 - protein, 179 aa, Artificial Sequence; identical to SEQ ID NO: 26201
  Synthetic sequence.

SEQ ID NO: 26203 - protein, 179 aa, Artificial Sequence
  Synthetic sequence.
DEAEEVERRSRELVERAKTEIEKLDRESKRLVDTVARKIEEVDKRSEELVRTVEELRRRGDAREEKIKKVIEDSKELVRKLKEIVKKVIREIEKLNDELNKEVERLSKESEDLLKKLREDGILREEVEKENRELNRRLKEALDESNKRNRTLLEDLRRKLRESEERNRRLLRKLEEDAR

SEQ ID NO: 26204 - protein, 179 aa, Artificial Sequence; identical to SEQ ID NO: 26203
  Synthetic sequence.

SEQ ID NO: 26205 - protein, 179 aa, Artificial Sequence
  Synthetic sequence.
SEAEEALKKVEELVRRVEEEIKRVDERSKDLVRRVERKLEELVERSKELVKRLLDMRRRGDIREEEIERVSRESKRLLDEAEKDVRRVVREIEKLNEDLNRRVDKVAKEIRDLVRDLKRRGVLREDVERRVRELIERLKRKLEESNRRNKKLIDELRKRLEEVKRENEKLNEDLERETK

SEQ ID NO: 26206 - protein, 179 aa, Artificial Sequence; identical to SEQ ID NO: 26205
  Synthetic sequence.

SEQ ID NO: 26207 - protein, 179 aa, Artificial Sequence
  Synthetic sequence.
DELERVLKRVKELIDKSRREDEELDERSKELVKKVLDELKDALRKIEKLVRDLKEMTDRGDIREEEIKRVAKEIEELLEELERRVRKVTEEIDRLNKESHERNRRVAEEIKRLLDELKRRGVIREEVRKDAERLIRENEEDNRRSNERNKKILKELKDALDRVKEEVRKLIRRLEEEAR

SEQ ID NO: 26208 - protein, 179 aa, Artificial Sequence; identical to SEQ ID NO: 26207
  Synthetic sequence.

SEQ ID NO: 26209 - protein, 179 aa, Artificial Sequence
  Synthetic sequence.
SEAETVLEEVKKLVERSREEDKEVDDESRELVERVEEKLRRVLKKSKEDVDRVMRLIEEGKVREKVIEEVSRTSEKLLRDLEETVRRVVKRIEELNRESHERNRRLEEDIRRLADELRKRGVLTEEVEDTIRRLIEENKKRNEESNRRNRELIKKLERKLEEVKRRNEDLNRKLEETAR

SEQ ID NO: 26210 - protein, 179 aa, Artificial Sequence; identical to SEQ ID NO: 26209
  Synthetic sequence.

SEQ ID NO: 26211 - protein, 176 aa, Artificial Sequence
  Synthetic sequence.
STLEEAEEEVRRLIKRTEDETRRVADEVKKLLDKHRRATEDVEKKVRELLDRLKKDEKDEDVRRVEERVRELLEELKRTSERIAEEVTRLLEELERSSRRVVEENERLLEELKRLTDDREIEKIVRRAKETNEENREIIERILKEIKELIDDANRKLKEILDRIRELVETVKRKAK

SEQ ID NO: 26212 - protein, 176 aa, Artificial Sequence; identical to SEQ ID NO: 26211
  Synthetic sequence.

SEQ ID NO: 26213 - protein, 176 aa, Artificial Sequence
  Synthetic sequence.
STLEEVERRIRELLDRHRRATEEVEKEVDRLNKETRDELDRVRKEIEKLLKDLDRKERDEEVKDVERRVRELLKEAEKIVRDLERENKRLLDELRKTSKEIAKRVTDLLEDLRRLTDDEELRRILKRVEKLVKDLNDKLRKILDDARRSNEEIKRRLEEILKEVKRLVDTVTERAR

SEQ ID NO: 26214 - protein, 176 aa, Artificial Sequence; identical to SEQ ID NO: 26213
  Synthetic sequence.

SEQ ID NO: 26215 - protein, 175 aa, Artificial Sequence
  Synthetic sequence.
SRIERAEEELKRSLKELREDLERVVRTIRKILREHEEKSKDVKRRIEELLREVKKRMVKDREILRELEERVRKIEEDLERISDELRKVAERVIEEAKRLVDEDADRIRKIIELLRAGKDVDKVLRDVEDLNRTTLKLLEDLLRTVEEVVRRADKLLEDLLREIKRLVDEVMERDR

SEQ ID NO: 26216 - protein, 175 aa, Artificial Sequence; identical to SEQ ID NO: 26215
  Synthetic sequence.

SEQ ID NO: 26217 - protein, 175 aa, Artificial Sequence
  Synthetic sequence.
SEIEEIEKEIRKSVEEVKKTLDKVVTEIRKSTREHEKKSEEVRKRSKELNKDLRDRLVRDEKILKEVEDRSREMNDRLRKLSERNRKLNEDLIRRLEELVKRDKERVEDVERKLRAGKDVKTVLDDVRRVNEETKKRIRDLLEESKRSDEEADRRAEELLERNERLVRKVAEEAR

SEQ ID NO: 26218 - protein, 175 aa, Artificial Sequence; identical to SEQ ID NO: 26217
  Synthetic sequence.

SEQ ID NO: 26219 - protein, 175 aa, Artificial Sequence
  Synthetic sequence.
SRIEEVIRRAREILEDHRRKSTEVRERLKKLLKEHEDKSRRVKEESEKINRDVKRELVRDRKILEELKRRSDRLNEELDRLSKDVADKIRELIKELKRISDDLKRRIEEIIEMLRRGKDVDKVLKEIEDLVRKADELLRELLKRVEDLVRRADEVLEELLRRNRKLAEDVMRKDK

SEQ ID NO: 26220 - protein, 175 aa, Artificial Sequence; identical to SEQ ID NO: 26219
  Synthetic sequence.

SEQ ID NO: 26221 - protein, 175 aa, Artificial Sequence
  Synthetic sequence.
REIEEVEKEIKKLLDEHRKKSDDVVRKLEKILRDHERRTEDVKRESEKINREVEKRKVRDREILTDLKRRSKELNDRLDKLSRELAERIKELIKRLRDLSRRVAEVVREVRKLLRAGKDVDEVLERVRELLERADRKLEELLERVRKLVEDANRVIEEVLERNKRLADEAMKKDK

SEQ ID NO: 26222 - protein, 175 aa, Artificial Sequence; identical to SEQ ID NO: 26221
  Synthetic sequence.

SEQ ID NO: 26223 - protein, 175 aa, Artificial Sequence
  Synthetic sequence.
SRIEEIVKRIRDILKEHEDKSRRVVEDIKRSTEELKRALREVVERIKTILDDVRRRLVRDEKILRELEKRVREVIRKLEKLVEEDEDRDRELIERLKEISRTLRDVVRTVEKLLRDGKDVDKVLEDVRRVAKEADDRLEELLERSKKLNKETLDELERLLREVEELVKEVAERDR

SEQ ID NO: 26224 - protein, 175 aa, Artificial Sequence; identical to SEQ ID NO: 26223
  Synthetic sequence.

SEQ ID NO: 26225 - protein, 175 aa, Artificial Sequence
  Synthetic sequence.
SRIEEVSERVREILRRHEEKSREVVERIKKSTKELRDEVRKVRATSKEINDDVRRRLVRDDKILKELEKRSKELNDRLDELVRRDEELDRRLIEELKRLSDELRKELEDVDRKLKAGKDVDRVLERVEKMVRDADKRIDEVRKESERLNEETRRRIERLLRENKKLADEVAERAR

SEQ ID NO: 26226 - protein, 175 aa, Artificial Sequence; identical to SEQ ID NO: 26225
  Synthetic sequence.

SEQ ID NO: 26227 - protein, 175 aa, Artificial Sequence
  Synthetic sequence.
SRIERVEERMRELLDRHRETSKRVVEEIRKSTEEHKEKSERVVRESERLNREVERELVKDKDILRELKKRSKELNDELRKLSKDNEERNRELIRRLEELSKRVEDTIREVIKLLRAGKDVDRVLEEVERLVTEVNREIKELLERSKRSDKEADRRLEEVVKTNRELAERVARRAT

SEQ ID NO: 26228 - protein, 175 aa, Artificial Sequence; identical to SEQ ID NO: 26227
  Synthetic sequence.

SEQ ID NO: 26229 - protein, 175 aa, Artificial Sequence
  Synthetic sequence.
SEIEEVVRRLEELVKRVAEELKRVVDRIEDLLREHKDKSRRVEERSKEINEDVARRLVSDKDILRELEKESRRLNKELRELSERVEREIKKVIKEMEEMLKELEDRVREIIKLLRAGKDVKEVLERVKKLVDDLIRRLKKLLEDLKKLVDDADEEIKRVLEENEELARRAAERDT

SEQ ID NO: 26230 - protein, 175 aa, Artificial Sequence; identical to SEQ ID NO: 26229
  Synthetic sequence.

SEQ ID NO: 26231 - protein, 175 aa, Artificial Sequence
  Synthetic sequence.
SEIEDVVRRARELLERLRKRVREVVEDIRRSTEEHKEKSERVVKTSEELNKRLEDELVRDKDLLKKVKDESKKLNDELRRLSEENSKRNEELIKRIEKLVDDVAERIKEIEKMLRDGVDVDKVLEDVRRLVKEAVDRIDKILRDSRESDRRADEEIKKVLDRNRELVKKVADEDT

SEQ ID NO: 26232 - protein, 175 aa, Artificial Sequence; identical to SEQ ID NO: 26231
  Synthetic sequence.

SEQ ID NO: 26233 - protein, 175 aa, Artificial Sequence
  Synthetic sequence.
DEIERVEEEIRRLLEEHKKRSDEVVRRLEKLLKDHKEVTRKVVEESERINRDVERRLVRDERILKDLKDKSKELNDELRKLSEDVERMIKRLIEELRKLSKDVEDTIRELEKALKAGKDVKEVLERIRKLVKDVNKRLEEILEEVERLVRRANRRIEELLERNRRLVEEVARRDE

SEQ ID NO: 26234 - protein, 175 aa, Artificial Sequence; identical to SEQ ID NO: 26233
  Synthetic sequence.

SEQ ID NO: 26235 - protein, 175 aa, Artificial Sequence
  Synthetic sequence.
SEIEKVEEEIRRILEEHKRISDEVKRRVRKSTEEHEKRTEDVERRSREINEEVEARLVRDKDILRDLKRRSKELNDEARKLSKRNRETNTRLLEELDDISRELKERIERIEKMLKDGKDVEEVLRRIRKLAEEVNKELKRLLDESKESDDRLNKRLTEILRENEELARDVARRVK

SEQ ID NO: 26236 - protein, 175 aa, Artificial Sequence; identical to SEQ ID NO: 26235
  Synthetic sequence.

SEQ ID NO: 26237 - protein, 175 aa, Artificial Sequence
  Synthetic sequence.
SKEERIEEALRDLVRRHKEVSRRVVETIKDLAKKLEEKLRRVETDSKRINDEVRDKLVRDKDILRDLERRSRKLNEDLRRLLREIKERLRKIIEELKRLSKDVEDKVRELIKLLRDGVDVERVLEEIKKLVEEVNRELRELLKRIEELLKRAEEMLERLLRENRRLVEEVARRDK

SEQ ID NO: 26238 - protein, 175 aa, Artificial Sequence; identical to SEQ ID NO: 26237
  Synthetic sequence.

SEQ ID NO: 26239 - protein, 179 aa, Artificial Sequence
  Synthetic sequence.
SESEELDKEIDDIVREDEELNKELRKRNDDAVRRVEKVIEDLLRRNEDAAEKVKKLLEELKDVKEVLEKLIRDLERLHRETRELLERLIRELEELHERSKRESEKSIRKVKELLERIKERSKEVRELLRKLREILEDLRRKNERTEEESEEILRRLTKLAEEVLRRSRKILEDLREALR

SEQ ID NO: 26240 - protein, 179 aa, Artificial Sequence; identical to SEQ ID NO: 26239
  Synthetic sequence.

SEQ ID NO: 26241 - protein, 179 aa, Artificial Sequence
  Synthetic sequence.
SEKDELRKRMRDISKENKELLEKLEREIRELSKENEKLNEKLRRELEELRKTIKDLLDRLKDVKEVVEELLRRAERLLERIKELLDRSNKKLEELLRKVEEDLRRSNEKLETLLREIKERSKEARELLKEAKELLEENRKRNEEILRRAEKVLRDNAEKDKRTLEKVEEILDRLRRELT

SEQ ID NO: 26242 - protein, 179 aa, Artificial Sequence; identical to SEQ ID NO: 26241
  Synthetic sequence.

SEQ ID NO: 26243 - protein, 179 aa, Artificial Sequence
  Synthetic sequence.
KEAEDLEREMREISDRNRKLNKKLRRDIKEISDDNRRLLEELRRRLKKMEEDVRRLLEELKDDKDVVEELRKELEELVRRIEKDLRKSNEKLEKLLRDVEEALRDSNEKLERLLRKIKERSKEVRELLTEARKLLERNREEDKKSLDDARKALKENKEENDKIKEEIDKILRELEEELR

SEQ ID NO: 26244 - protein, 179 aa, Artificial Sequence; identical to SEQ ID NO: 26243
  Synthetic sequence.

SEQ ID NO: 26245 - protein, 179 aa, Artificial Sequence
  Synthetic sequence.
EESERLAKRVDDLSRENEELNKRLRDEMEKISRENKELLKDLRRKADKIVKDVERLLEELKDVDEVVRELKKRLEDLMDEIRKALKRSNEKLKKLLEDIKEALERSNRKLKELADDIRRRSKEARELTRRIEKLLKDNTDRDKKSEDDLRELLKENKKRNDEILEEIRRILEELRKKLT

SEQ ID NO: 26246 - protein, 179 aa, Artificial Sequence; identical to SEQ ID NO: 26245
  Synthetic sequence.

SEQ ID NO: 26247 - protein, 180 aa, Artificial Sequence
  Synthetic sequence.
SLDKEIERKVEEIERRLKESNDRLREKVDEIRRRSERLNTELNERVDRIAERIRRMKRDGTKDVEELVRKLAKELRELLKEVVERDEKLLRDLEKTAEEVIRENKRLLDELRKLVEDLKRAGSLEERLEEKIDRIIRELERRNDKSREELEKIIRELRERTKESEKRLEDIIRELEERTR

SEQ ID NO: 26248 - protein, 180 aa, Artificial Sequence; identical to SEQ ID NO: 26247
  Synthetic sequence.

SEQ ID NO: 26249 - protein, 180 aa, Artificial Sequence
  Synthetic sequence.
DADKRLRTDVRRIVEDLKRSNEELRRRSEEIAKRSDKLNKELNKKSKEIEERVKRMRDEGRKDVEELVKRLIEESRRLTEEVLKKDEELVRESRRLTEEVKKRNDKLLRELEKRLDELKKEGVITKDLEKELRDIIRELRERNRESEEEDERIIRELEKRTKDSEKRDDEILRELEREIR

SEQ ID NO: 26250 - protein, 180 aa, Artificial Sequence; identical to SEQ ID NO: 26249
  Synthetic sequence.

SEQ ID NO: 26251 - protein, 180 aa, Artificial Sequence
  Synthetic sequence.
SLVEKIAREVRKIKEDSKRLNDELNEKVRKAVEDLERSNRELEKRVREIEERVRRAETEGRKDVEELVKRLVDELRDVLEKVKRTNERLLRELERTAKEVSDRDRELVRRLRELVKDLKRKGSATKELEDDIERIIKELEELTRRSEEKLRETIERLEERNKETAERLERIIKELEERSK

SEQ ID NO: 26252 - protein, 180 aa, Artificial Sequence; identical to SEQ ID NO: 26251
  Synthetic sequence.

SEQ ID NO: 26253 - protein, 180 aa, Artificial Sequence
  Synthetic sequence.
KEAEELEERVKRIEEESRRLNRELNEKVKDIAKKLEDSNDKLRKDSEEIAERVKRARTEGRKDVEKLVDKLIKESEKLTEEVKRENKRLMDELRELLKKVKDDDRELLERLRKLVKDLRREGSIKDEVVKKLEDIIREIEKTTRESEKRLEDIIRKLKKKNDDTEREDREIVKRLREETK

SEQ ID NO: 26254 - protein, 180 aa, Artificial Sequence; identical to SEQ ID NO: 26253
  Synthetic sequence.

SEQ ID NO: 26255 - protein, 182 aa, Artificial Sequence
  Synthetic sequence.
SLLEKLERDVERLSEEDEKLNEDVRRVDREIVERDKKLNREVNERVKRLAEEVKDIRRRVKDDETAKRLLDKVAEEIKELAKRLEEESRKLVRESEELVKRLERMSEELVKEIERLVKKLKDEGKLRERAEERLRRIIKRNKEENERTAKESRDSIEELKERNERSKRRLEKILEDLERETR

SEQ ID NO: 26256 - protein, 182 aa, Artificial Sequence; identical to SEQ ID NO: 26255
  Synthetic sequence.

SEQ ID NO: 26257 - protein, 182 aa, Artificial Sequence
  Synthetic sequence.
REAEELEKRVRKIEREDDKLNEELNRRAKDVSREDKELNDRVREVVRRLVEEVDRIRRDVKDKRDAREKVREIMDRIRRLLEELKRRSDELAKELRELLEELERRSKKLVDEIKEVVRKLKEDGKLREELEKKLEDIIRELKKRNDESAERIRRLIKTNEDENRRTAEEIKKILDDIRRKVK

SEQ ID NO: 26258 - protein, 182 aa, Artificial Sequence; identical to SEQ ID NO: 26257
  Synthetic sequence.

SEQ ID NO: 26259 - protein, 186 aa, Artificial Sequence
  Synthetic sequence.
SELEEIRKKIDDLRRRVEEINERITREDKRLVDELKEINKRITDRVRKIARDVEELLRKGEPKSRVKKMLDDAERELRRLLKELREMHERIVETSKELNERLREVHKRIAEEAKKLVDELRREGGRDEERLRTVDEEVKKILDELREKLDRNRRRSEETNRRLDELLKENARRVEEIIRRLREEVK

SEQ ID NO: 26260 - protein, 186 aa, Artificial Sequence; identical to SEQ ID NO: 26259
  Synthetic sequence.

SEQ ID NO: 26261 - protein, 186 aa, Artificial Sequence
  Synthetic sequence.
SELEEIKKRVEEIARTLEKLNRDITKLDEDLAREVEDINRRITETVEEIAKRVERLREKGEPKEDVRRVLDEVEKELKKLLDELEKFHRDIMETSKDLLRRLREAHDRVIKELKDLVRELEREGGRDKERLDKLRTEVKKIMDDLRRILEKNAKDSKRSLDRLRKILEDNKEKVKRIADRLREAVR

SEQ ID NO: 26262 - protein, 186 aa, Artificial Sequence; identical to SEQ ID NO: 26261
  Synthetic sequence.

SEQ ID NO: 26263 - protein, 178 aa, Artificial Sequence
  Synthetic sequence.
KDEKRIKDVLKKLEDDNKKLNDEIKKLNEEIARKNEELNKRIEDMIRKAEREVDELKRNGADKEVLERILRRVKELIDRLTRALEDSLRESKRLSEELARALEESLRRIKEVIDRLREENKEAKEVDDEARRILEKLRRENERTKEESKEINEELEKRNRESVERIKEILRRLEEKLR

SEQ ID NO: 26264 - protein, 178 aa, Artificial Sequence; identical to SEQ ID NO: 26263
  Synthetic sequence.

SEQ ID NO: 26265 - protein, 181 aa, Artificial Sequence
  Synthetic sequence.
SEVERLLREVEKVLRRVVKRSRDLNEELKKRSKEHKETSERLNREMKRVLREVEKKIDETRDKETLDRLLREVEEVLKELKKRHDELLRHNKKVVDELKEEHKKLLKEAEDALREVKKELDKRGGVREVKKRLDELLKRLEREVRESEKRMDRSHEDVRREAERSKKELEELLKKLEDKVR

SEQ ID NO: 26266 - protein, 181 aa, Artificial Sequence; identical to SEQ ID NO: 26265
  Synthetic sequence.

SEQ ID NO: 26267 - protein, 181 aa, Artificial Sequence
  Synthetic sequence.
SEVEKILRDVEDATRRHKRTSEELNRRLEEVVRRVKEESKELNERLREVVKRVKEEIRKTTDKETLDRLAEELKRVVEDLKRRHEELLRRAEEVVKDLKRRHDELLRHNRRLLKEVKERLDDRGGVREVKKRIDELHDDLRRVMEASKERIDRILEDLRRVVERSKEELRKLLEDLKRTVD

SEQ ID NO: 26268 - protein, 181 aa, Artificial Sequence; identical to SEQ ID NO: 26267
  Synthetic sequence.

SEQ ID NO: 26269 - protein, 181 aa, Artificial Sequence
  Synthetic sequence.
SEVEELLKRVEEATERHKREIERLEDEIRKVLEDVDKRSKELNDHNRDVIEKIRERIERTRDKDTLKKLVDDLRELSERHKREHDRLLEEVKRVAEDIKRRIDELLRHNEELLRDVKRRLEERGGVREVKTELDKLHEDLKRTAEEVKKRLDDLLKELEKKVEESKTEIDRSLEELEKTAR

SEQ ID NO: 26270 - protein, 181 aa, Artificial Sequence; identical to SEQ ID NO: 26269
  Synthetic sequence.

SEQ ID NO: 26271 - protein, 177 aa, Artificial Sequence
  Synthetic sequence.
DEERRVKEELEKLLEDLRRTIKKVEEDSDRINKDLERVIRRSEREADKILEDLERAGVSEELLKRLEDLVKRIKETHEELLRRLKKSSDELREELERLLREIEKMVRDAEDVLRRNVSEEKLRELLERAKKLVEDIKRRLKELLDRHRDLVRRIKERSKELNKRLKDLIDEIKERAR

SEQ ID NO: 26272 - protein, 177 aa, Artificial Sequence; identical to SEQ ID NO: 26271
  Synthetic sequence.

SEQ ID NO: 26273 - protein, 177 aa, Artificial Sequence
  Synthetic sequence.
SSKDDLRRKIEKLLRDLERVIRESEKRSEEINRDLERTLKRIKEEADKILDKVRRGGVSEDLLRELEELVKKIERRLEELRKELEDSSRRLRETHERLRRDLERIVDELEKALRNNIDDRLLEKLLRELEKLIRRIEEESRKLNEEHEKLLKRIKDELKKLLDDLRRLAREIEERRR

SEQ ID NO: 26274 - protein, 177 aa, Artificial Sequence; identical to SEQ ID NO: 26273
  Synthetic sequence.

SEQ ID NO: 26275 - protein, 177 aa, Artificial Sequence
  Synthetic sequence.
KSTEDAKREIDKLLEELEETIRRAEDRSRRLNEDLARTLKRIEEELKRINEEVEKRGVSEKLLEDLRRSTEELKRSLRELLRRLEESSRRLKERAKRLLAELERIVEELKRALDDNISDELLKKLLDELRELIDRIRRDLERLLREHEELIERIKRTLEELLRRHRELVKRIEETAR

SEQ ID NO: 26276 - protein, 177 aa, Artificial Sequence; identical to SEQ ID NO: 26275
  Synthetic sequence.

SEQ ID NO: 26277 - protein, 177 aa, Artificial Sequence
  Synthetic sequence.
SEEDRLEEEIKRILDDVARVVKRIKEELKRINDELKKVIDESRDHARRVNDDVRRRGVSEELLRELKESTERNDELLKKLLKEAKESTETITRELDRLLEELKKIVDELRELLKKNISEELLKELLKRLEELARRIKKKLEELLREHEKLLEEIEKALRRSNEEHRKLVEKIKRDAT

SEQ ID NO: 26278 - protein, 177 aa, Artificial Sequence; identical to SEQ ID NO: 26277
  Synthetic sequence.

SEQ ID NO: 26279 - protein, 177 aa, Artificial Sequence
  Synthetic sequence.
DEEERVKEAVERLLRDLERAIKESEDHLRRLNEDLDRVIRESKEHLKKVNDDVRRAGVDKRLLDELKKSTEDNKKTADDLKRKLKRSTDENKKRLKRLEEELRRLVERLKEALRDNISEELLKKLLEELKRLIERIKRDLKRTNDEHEKLIREIKKRLEDSNRDHERLVKDIKETAR

SEQ ID NO: 26280 - protein, 177 aa, Artificial Sequence; identical to SEQ ID NO: 26279
  Synthetic sequence.

SEQ ID NO: 26281 - protein, 177 aa, Artificial Sequence
  Synthetic sequence.
SKEDRLREELKKLLKRLREEIERLKRALEESNKDLKRTIDRSEKHLRDVNEDVKRAGVSEELLRELERSTRENKERAKELLKRHEDLVRKVEKELRDLLRRLEEIVRRVDEMLKRNIREEELDKLLKEARDLIREIEKRLEELLKRVEKLTEDAKRDLERSNREHKELADRIKETAR

SEQ ID NO: 26282 - protein, 177 aa, Artificial Sequence; identical to SEQ ID NO: 26281
  Synthetic sequence.

SEQ ID NO: 26283 - protein, 177 aa, Artificial Sequence
  Synthetic sequence.
SEAERIEEEARRLLEELRRAIERVKEEADRLLEELRDAIRKSKEHLKRLNEDVERAGVEERLLDALRKSTEDNERLLRDLLRKLEEAVRRLEEEARRLLKEAEEIVREIKKVLDNNVSEEALKRLLEKLKRLIEEIKRELKRLLDDLKRLIDEIAEALKRSNDRHEELVRRIKEKAR

SEQ ID NO: 26284 - protein, 177 aa, Artificial Sequence; identical to SEQ ID NO: 26283
  Synthetic sequence.

SEQ ID NO: 26285 - protein, 177 aa, Artificial Sequence
  Synthetic sequence.
DSKEEIRRKIDELLKRLEETIRRSEEHFRRSLDDARKELKRSRDHVRKVNKELRDRGVSEELLKEAERSTRENEKLLKELEERLKRHLEENKKIADKLLEELERLVRRLREVLKKNVDDEELERLLRDLERLIREIEKTLEDTNRSNEELVRRLKRRLEESNKRHEDLADEIRRRTD

SEQ ID NO: 26286 - protein, 177 aa, Artificial Sequence; identical to SEQ ID NO: 26285
  Synthetic sequence.

SEQ ID NO: 26287 - protein, 177 aa, Artificial Sequence
  Synthetic sequence.
SEEDRIREEMEEILRRVERTVEEIKKELKKINDDVDRTARESEKHVREVLERVEREGVDKDLLDELRKIVEENKRLAKRLKDELRKSTKKIEDDLKRLLDELKRLVEEVDEALKRNISEELLEKLLEDLKRVVEKIRRDAEDLLERHKDLVRRIKEELRRSNRKLEDLVKKISERAT

SEQ ID NO: 26288 - protein, 177 aa, Artificial Sequence; identical to SEQ ID NO: 26287
  Synthetic sequence.

SEQ ID NO: 26289 - protein, 177 aa, Artificial Sequence
  Synthetic sequence.
DEDREVRRTLEELLDDLRRVIEESERHLEKLNEDVREAIRRSEEHVRRVLDRVRRGGVNEKLLEELDKIVKENRKLLEELLRRLEESTKRNRDEAKRLLEELADIVRRIEELLRDNISEDLLRKLLEEAKRVLDEIRKTLKKTNEDHERLVERIKRELEKSNKDLERLAKEIIDRDK

SEQ ID NO: 26290 - protein, 177 aa, Artificial Sequence; identical to SEQ ID NO: 26289
  Synthetic sequence.

SEQ ID NO: 26291 - protein, 177 aa, Artificial Sequence
  Synthetic sequence.
SSKEDITKKIEELLRELEEELKKSEKHLRELNEEAKRTAEESRRHLEESLRKVEKDGVDEDLLRKLEEHVRDNERRARKLLKDLKDSTDTNRRTAKRLLERLKELVERIKEMLKRNIDDEELKKLLKELEDLVKEIKERLRKTNEEHRKLVEEIKERLKRSNESNERLVRRIEEEAR

SEQ ID NO: 26292 - protein, 177 aa, Artificial Sequence; identical to SEQ ID NO: 26291
  Synthetic sequence.

SEQ ID NO: 26293 - protein, 179 aa, Artificial Sequence
  Synthetic sequence.
SELERAEEEIEKLNRDLKRTLDEIRDRIRKINDDLRKTLRKSDEDSKRLLKELRDEVPDLREVDDRIRKIIKENKDLARELKREAEDSSRDLERILREIEETVRDSSRKLKELLERDKESGEKLKDMLDKHRKLIDDLKRRLERRLREHKRLLDEIEKRLRDSLKRIEEIVREILERAR

SEQ ID NO: 26294 - protein, 179 aa, Artificial Sequence; identical to SEQ ID NO: 26293
  Synthetic sequence.

SEQ ID NO: 26295 - protein, 179 aa, Artificial Sequence
  Synthetic sequence.
DELERIRRELERINTTLDELLKRSKEETDRILKKVEDSIREVEKKVKELLEELKRRVPDLRKVEEDVKRVLDELRRRLRKLLEKLKRLADDNRRKLKELKDEAERSSREVERLLREKKESGELLKKILDEHRDLLRRIEEELRRSLEDIKRVAKEVEERIKKVLDELRRLIEELLRRAK

SEQ ID NO: 26296 - protein, 179 aa, Artificial Sequence; identical to SEQ ID NO: 26295
  Synthetic sequence.

SEQ ID NO: 26297 - protein, 185 aa, Artificial Sequence
  Synthetic sequence.
SVLEEAEKELRKIVEDNRRTLREVKERNKKLNKENRDTIKKIEDDVRRIIRELKEDLKRSEKDELRKELKEVEEEIRKLIKDAREHSDRVIRESKKLVEELERRTRELEERIKKLIKDIADRFGGGEEDLRRLEEEIRRRSEENKKRIRDLLRRSEELSRRDKKKLKEILERIKRLADEVREKIR

SEQ ID NO: 26298 - protein, 185 aa, Artificial Sequence; identical to SEQ ID NO: 26297
  Synthetic sequence.

SEQ ID NO: 26299 - protein, 186 aa, Artificial Sequence
  Synthetic sequence.
SDLEDILRKIEDLSRKNEEELKRVLEENKKLSDDDKRRLEKILREVEKKIRKIKKDIKDEKDKEKLRKKVEDLEREAKELVDDLRRHSEELSKRSEKSLRDVKKHSDDVAKRARELVKELVDRRGKETEEVRKLEEDVRRIIERNKKLTEDLARELKKLNDDNERTLRKVEEDIRRIIADLRRTLK

SEQ ID NO: 26300 - protein, 186 aa, Artificial Sequence; identical to SEQ ID NO: 26299
  Synthetic sequence.

SEQ ID NO: 26301 - protein, 186 aa, Artificial Sequence
  Synthetic sequence.
SELDEILERLRRLSEENKRRIEEALRRNKKLSEDDERLSREIRRRVRELVEEAKEVLRREKDKDKLRDKLERIVDELRKLLEDNTRHSRKVSEDSKESLKDLRRHSKEVIETLEKLLEELIRKDGEETEEVKRVAEELDKLVKENRRVTEKVARELKKLNDKNREVNERLERELDKIIKDLRRTDK

SEQ ID NO: 26302 - protein, 186 aa, Artificial Sequence; identical to SEQ ID NO: 26301
  Synthetic sequence.

SEQ ID NO: 26303 - protein, 186 aa, Artificial Sequence
  Synthetic sequence.
SEIEKILEDVKKLADDLRRTLKRALEENKELSDRDKEELRRILEEIKKLAEEIDKLIKEEKDKDTLRKKVKDLEERVRELIKRLERHSREVSKESERSIRELERLIDEIVKRMEELLEKAIRDKGKDTERVREVARRIEKIIEDLRRDLERVRRELKKLNDDNRRVLEEVKRTVEEIIKRLRESAK

SEQ ID NO: 26304 - protein, 186 aa, Artificial Sequence; identical to SEQ ID NO: 26303
  Synthetic sequence.

SEQ ID NO: 26305 - protein, 185 aa, Artificial Sequence
  Synthetic sequence.
DEVDELLKEAEEVIREVTREHKRLLDEARKISEENKKRSEESNREVRELVRRIKEEIKKGLPEEDLKRLLDELRDMIRKVRETNERSDKEVEKVVRDILRRLRELNKRVEEIIRRILKEIRRDVRDSEKAKRVEEELKKLLDKLSRITEEVERRLEELLKDNERVSRESDEELKRILEDVERDTR

SEQ ID NO: 26306 - protein, 185 aa, Artificial Sequence; identical to SEQ ID NO: 26305
  Synthetic sequence.

SEQ ID NO: 26307 - protein, 185 aa, Artificial Sequence
  Synthetic sequence.
SEVEELLDRLRKLIEDVVREHKRLLDEVRRISRENEELIRRLLEKVEEVIRRIKERIKSGQPEEVIKRILDEARRRLRKVLEEIKRSDEEVEKMLRDVLKTLKELNDRVREIIKDILKKIRDKVKDEKTAREAEEELRRLLERLSEVTRKVEKAIEDILRRNRETSERVAREIRRLLKELEDTAR

SEQ ID NO: 26308 - protein, 185 aa, Artificial Sequence; identical to SEQ ID NO: 26307
  Synthetic sequence.

SEQ ID NO: 26309 - protein, 185 aa, Artificial Sequence
  Synthetic sequence.
SSVEELLERLRRISEENKRRIEKLLREVEKVLRELKDRHRKLLKRVEEIIRKVKEEIKSGLPEEVVKRVLERVRERVKEVLEEADRLNDEMRRIVTEVEKELDKSDKEVEDMVRDILKKIEEEVRDRETAERARETLKRLLDENRDRSKKVKEEIRRILEDLTRTTERVKREIKKLLKELEDTAR

SEQ ID NO: 26310 - protein, 185 aa, Artificial Sequence; identical to SEQ ID NO: 26309
  Synthetic sequence.

SEQ ID NO: 26311 - protein, 178 aa, Artificial Sequence
  Synthetic sequence.
DLLRKLLEEAKKILKEIKDAHEKLLRELEESNKELEKAHRKLLEDAKRMLDDLKRTDPREDLLRKLEELVRRIKEESKRLNREHAELVRRIEEISRRLNEELRRLVKKIEEELRRKVDDEDRVRDLRRALEELIKESDEVSRRLKEEIDRSLESSKKVSRDLEEELKKLIKDLEDTRR

SEQ ID NO: 26312 - protein, 178 aa, Artificial Sequence; identical to SEQ ID NO: 26311
  Synthetic sequence.

SEQ ID NO: 26313 - protein, 178 aa, Artificial Sequence
  Synthetic sequence.
SELEKLLRDDRELLKELKKAHKKLLDELKESNDRVRKRHEELLRRIREIAKRLRDTDPREDLLRRLEELVRRIEEDSKRLNEEHKKLIEEIERRSRKLNEDHERLSREIRERLERRVDDKDKVRRVERESKKTHDESREVSEKLRRDAEDSLRSSEKLSEDLERELRKLIKEVRDEAK

SEQ ID NO: 26314 - protein, 178 aa, Artificial Sequence; identical to SEQ ID NO: 26313
  Synthetic sequence.

SEQ ID NO: 26315 - protein, 178 aa, Artificial Sequence
  Synthetic sequence.
KDIERLLEELKRILEDLKRKHKRLLERLEDSNRRIRRTLEELLKRLEKLVKDLSDTDPREDLLKELKRLIDEIRRRLEELIRRHEELLREIKERSDELNKRLEKLVREAIDRMRKRVDDKDKVDDAKRRLEELLKESREVSKKLRDDIERSIRSLREEVKKLDEDAKRLLDKVREEIR

SEQ ID NO: 26316 - protein, 178 aa, Artificial Sequence; identical to SEQ ID NO: 26315
  Synthetic sequence.

SEQ ID NO: 26317 - protein, 178 aa, Artificial Sequence
  Synthetic sequence.
SVLEDLIRRDREMLKRAKEEHDRLRKEIERSNREIDEEVKRLLAEIKKIVEEVSKTDPREDLLREAKRLLDKIKEDLKRLLDEHRKLLRRILEESRKLNEEHRRLSREVDELLRRRVSDKKAVDEVRKESDDTHKESEAVSRDLKRELERSIKSLEKRIREAEEELKRILKELEDEKR

SEQ ID NO: 26318 - protein, 178 aa, Artificial Sequence; identical to SEQ ID NO: 26317
  Synthetic sequence.

SEQ ID NO: 26319 - protein, 178 aa, Artificial Sequence
  Synthetic sequence.
EELERLLEEDKELVRRVERELERLLRELKRSNDEIKKTLEDLLRRIEEILKEIRRTDPREDLLRTLEDLIKKIKDELDRLIKEHRDLVEEIEREARRLLDEHRRLSKEIKDRLEKRVDDKEKVKRAEDRSRETHRRLEEVVKKLKEDAERSIKSLEELVDKLRKELRRLLEEVREEVR

SEQ ID NO: 26320 - protein, 178 aa, Artificial Sequence; identical to SEQ ID NO: 26319
  Synthetic sequence.

SEQ ID NO: 26321 - protein, 178 aa, Artificial Sequence
  Synthetic sequence.
RELEELIKEDEDLLRRLAETLKKLLEDVRRSNEELRKFHEDLLRDLERLLEELRNTEPREELLRKLEKMIRDIERIARELNDRHERLVEKIRETLRKLLEEHKELSDRIREKMEREVDDKEKVRRVEERSRRTHKELEDLAREVDKELKKSIKSSRDVTRKVKEDADRLLKKVADDTK

SEQ ID NO: 26322 - protein, 178 aa, Artificial Sequence; identical to SEQ ID NO: 26321
  Synthetic sequence.

SEQ ID NO: 26323 - protein, 178 aa, Artificial Sequence
  Synthetic sequence.
SILETLADRDRDMVRRVKEALKKLLERDKRALERLKRVHKELLDRLRKILEDLKRTEPREELLKRLEDLIREIEETARRLNKEHEDLSREVRKILKELLDRHRELSKEIKEIMDREVDDEEKVKRVEEESRRTHKELKDVADRVETESDKSHEESKKVTDEVRKELERLLRELEETVR

SEQ ID NO: 26324 - protein, 178 aa, Artificial Sequence; identical to SEQ ID NO: 26323
  Synthetic sequence.

SEQ ID NO: 26325 - protein, 178 aa, Artificial Sequence
  Synthetic sequence.
SEAEKLLRELEDILKKLKDALKRLIEEDERLLKRLKREHEKLLKRLEEVLRELKKTEPSEELLRELKKLIEDIEREAERLNAEHERLSREVEKTLRKLLTDLERLIREIKKKLDDRVDDREKVKRVKDEADRLLKELEDVVREVKKRSDESHKRSRDVTREMKKELKRLLEELEKTVR

SEQ ID NO: 26326 - protein, 178 aa, Artificial Sequence; identical to SEQ ID NO: 26325
  Synthetic sequence.

SEQ ID NO: 26327 - protein, 178 aa, Artificial Sequence
  Synthetic sequence.
SELERLLREDEEMVERVERVLKELEEEVRKALKRAKEMHRRLLERLKTILDELERKEPREDLLRELETLAEEIKRILEELNKELRKLLREIEEELKRLLKEHKELSDRIKKILEEKVDDKEKVKELERRSRKTHKELADKADTLRKRLEEVIKESEDVTEELERRLKKLIDDLRRSVT

SEQ ID NO: 26328 - protein, 178 aa, Artificial Sequence; identical to SEQ ID NO: 26327
  Synthetic sequence.

SEQ ID NO: 26329 - protein, 178 aa, Artificial Sequence
  Synthetic sequence.
SELEKLLRELEELLKELKRVLEELIERDKRLLDRLKEVHERLLRRLEKLLKELKDKEPREDLLRRLKELIDKIREDAERLNEEHRRLVEEVKKELDRLLRELEDLLRRIEDILRKRVDDEDKVREAKRELERLIEELRRAVRRVEDESRRSHEESKKVTDDLDKRARELLEELRETIR

SEQ ID NO: 26330 - protein, 178 aa, Artificial Sequence; identical to SEQ ID NO: 26329
  Synthetic sequence.

SEQ ID NO: 26331 - protein, 179 aa, Artificial Sequence
  Synthetic sequence.
REVEELEKDVRRTLDELRKRHRDNNERIKKILRELEDLHRRNNERTKTLLARIRELRERGGEDKERMVKTVEDILRESTRHSERVIRESERLLEEAKRHSEEVARRSKEVLKELEDKVRESRVPRELERKLKELVKDVEKVIEDDDRSADKLLTKVKRDADEDRKSNEKLVREVREELR

SEQ ID NO: 26332 - protein, 179 aa, Artificial Sequence; identical to SEQ ID NO: 26331
  Synthetic sequence.

SEQ ID NO: 26333 - protein, 179 aa, Artificial Sequence
  Synthetic sequence.
SEAEEVLKRVEEVVERLKKLHDDNNKKLRDAVRRLKRLHTEHNKETKEIKKEIEDLIRKGGEEKEKLVERVERLVKRSTDTLREVVRRTEKLLKEVEDHSRRVIEESKELVKEMEKRLRETDVSREVEKRLKEVVKRIDEVAEEDERSIREILRELRKVIEDDERSNRKVAKEIRESAK

SEQ ID NO: 26334 - protein, 179 aa, Artificial Sequence; identical to SEQ ID NO: 26333
  Synthetic sequence.

SEQ ID NO: 26335 - protein, 179 aa, Artificial Sequence
  Synthetic sequence.
DKVREVLERLKKLVEDLKRLHKRNNEEVRRVIEEIKDRSRRNNKRTEDILRDIEREIRRGGERKEELVKRVKELLEDSTRHSEEVVREVEEILREVKRHSEEVVKESERILREAKKRLDESDVDERIKEELKKLVEDVRRTAEDDRRTIEDLVRKVEEVLERDRKSNEEAARDVDRKLK

SEQ ID NO: 26336 - protein, 179 aa, Artificial Sequence; identical to SEQ ID NO: 26335
  Synthetic sequence.

SEQ ID NO: 26337 - protein, 181 aa, Artificial Sequence
  Synthetic sequence.
RSVEEVKKELDDSDRRDREVVKEARRRLEESKDRLRKIIERAKEELDKSDERIKKNGVSEELLRRLKEVSEEHRRELERLLRRLKEVTDEHTKAIKKIHEETKKVSDDHRRAVEELRKRGGVDEELKKLLKHNREVLEDSRRKIEELLRTNEKALEDVKRAIEELLKHNEEVLKEVDDRTR

SEQ ID NO: 26338 - protein, 181 aa, Artificial Sequence; identical to SEQ ID NO: 26337
  Synthetic sequence.

SEQ ID NO: 26339 - protein, 181 aa, Artificial Sequence
  Synthetic sequence.
KEVEDAEKRLRDLLKEDRELIERLRRALEESLKEDRKVIKELREELDKSDRKVEEDGVDERLLTELRKASEEHRRKLDEIHERTREETERHKERLDKIHEDTERVARELKKRIDELKKRGGRREDIKRLLEELEEVLRRSEKKLRELLDTNRKILEESKERLRRLLEHNKRVLRRVVEETR

SEQ ID NO: 26340 - protein, 181 aa, Artificial Sequence; identical to SEQ ID NO: 26339
  Synthetic sequence.

SEQ ID NO: 26341 - protein, 181 aa, Artificial Sequence
  Synthetic sequence.
SDEERVEKELKKSDDEDKKLIDELTRRLRESLKRLEEEVRRAREELDKSDEEVRKAGVSEELLTRLEKMSREHKKRIDDLLRRAKEVTERHERKLEEIHKRTKDMSDDHRRKIEDLRAKGGVREDIERLLDHNRKVLEKSADDLRKLLKTNEEILRRVAKAIRDLLEHNRRVVEEVKERAR

SEQ ID NO: 26342 - protein, 181 aa, Artificial Sequence; identical to SEQ ID NO: 26341
  Synthetic sequence.

SEQ ID NO: 26343 - protein, 181 aa, Artificial Sequence
  Synthetic sequence.
SEVEEAKRRLDESDKDDRRVIDKLRKELEKSREEAKRLIDRLREELKDSNREAEEAGIDEDLLRKLRKATDEHRRKIEDLLRELDRVTKEHKERIDKIHEETKEMSKRHKDELEKLRARGGSREDLRRLLEHNKEVLERSKKRLEELSETNKKFLEEVKDALRELLKTNREVLREVKERTK

SEQ ID NO: 26344 - protein, 181 aa, Artificial Sequence; identical to SEQ ID NO: 26343
  Synthetic sequence.

SEQ ID NO: 26345 - protein, 181 aa, Artificial Sequence
  Synthetic sequence.
SSVERAKRELDKSLKEDRDTIRDLKRRLEESRKRDREVIEELKKILKKLLDEVKDSGISKDLLKRIEDAVRTIEEELKRIHDDTERMTREHKERIERIHDRTKKVSDEHKKTIEDLKRKGGDDDKIKKLLDHNRKVLEDSKEELRRLLETNKRILEESKKRLDRLAEEIEKVARTVKEEAR

SEQ ID NO: 26346 - protein, 181 aa, Artificial Sequence; identical to SEQ ID NO: 26345
  Synthetic sequence.

SEQ ID NO: 26347 - protein, 181 aa, Artificial Sequence
  Synthetic sequence.
DEVERAEEELRKSDEEDRRVVKRATETLKKSKDELEREIKRLEDELERSNREVEERGVDKSLLEELEKVTRDHKKRLRDLLETVRRLTEDHLEKIKKIHEDTKRASEEHLKAIRELERRGGVREEIKKLLDHNRRVLEESERRIRELLRTNREVLERVKKELDELLEHNRRVLEEVEKRVR

SEQ ID NO: 26348 - protein, 181 aa, Artificial Sequence; identical to SEQ ID NO: 26347
  Synthetic sequence.

SEQ ID NO: 26349 - protein, 181 aa, Artificial Sequence
  Synthetic sequence.
SSVEKAKKRLDESDKTDRDVIKRLREELKKSEDTDRELVKKVKEEIEKVEEELRRRGIDESLLTELKRVAEEVKETIDDIHRKTKRVTEEHTKAADKIHEETKRASKEHKERIEELRKRGGDDDKIRRLLEHNEEVMKRSKERLDDLVRTNRKILEESKRKIEKLLKELREVVEEVDRRAR

SEQ ID NO: 26350 - protein, 181 aa, Artificial Sequence; identical to SEQ ID NO: 26349
  Synthetic sequence.

SEQ ID NO: 26351 - protein, 178 aa, Artificial Sequence
  Synthetic sequence.
DKAERVREEIEKLERELRRVLKESREHTKKLEEDLERVLRRSREATKKLKEDLERNNLPDEARKRADEILKRNEDLLRRIKKTMRDVLEENERLLDKIERDLREAIKRLEEVLRDKKDDGELIKRMLEELKRLLEELEKRIRDSNAELEKLLRDLIRKLERSLREIKRVLEELKEEAR

SEQ ID NO: 26352 - protein, 178 aa, Artificial Sequence; identical to SEQ ID NO: 26351
  Synthetic sequence.

SEQ ID NO: 26353 - protein, 184 aa, Artificial Sequence
  Synthetic sequence.
SEVETLMREIKKLIDDIKRKNEDSNREIREVSRKTEEDLRDLLRKAREVAEKLKDELRRRKDKDVVERVRRLVDELRRRMEDLVRKVKEINDRLRRLVEELVKDSERLARDLERRVRSLARKIDDEEKVKRLEDSLERLKRDLRKIIKENEDELRKINRRNEELIKKAEEDLRRLSEDLKRAEK

SEQ ID NO: 26354 - protein, 184 aa, Artificial Sequence; identical to SEQ ID NO: 26353
  Synthetic sequence.

SEQ ID NO: 26355 - protein, 180 aa, Artificial Sequence
  Synthetic sequence.
SELEEVLRRIEKLVRKAHKENEDVLREIERLVRTAHRLNKKVDDDSAKIAEDLKREKREDKDKVEEMLRRLRELYRRLEEENRRILREIEELVKELEKRNREILKELEDLVKDAERKDKDGTERVRRLKEILERLKEEVRRSLEELRKEVERLKKEVEDSLRELKKSLEEWVKDLEEATR

SEQ ID NO: 26356 - protein, 180 aa, Artificial Sequence; identical to SEQ ID NO: 26355
  Synthetic sequence.

SEQ ID NO: 26357 - protein, 180 aa, Artificial Sequence
  Synthetic sequence.
SDLEAVLDEIKKLAEEAHKRNEEVDKESAKLVKEAHKVNEDVDKESAEIVKRIDEEKKEDRDKVRTMIRELKKKYEDVARRNKKILDELEEKYDRLRKDNDRILDEIRRKVEDVERKDKDGTERVKRLKDELRRLLKEVKDSLEELDRMLEEWKERVRRSLEELRKRAKEWEDKLRESLR

SEQ ID NO: 26358 - protein, 180 aa, Artificial Sequence; identical to SEQ ID NO: 26357
  Synthetic sequence.

SEQ ID NO: 26359 - protein, 180 aa, Artificial Sequence
  Synthetic sequence.
SELEDVLKKIRKLVRDAHEENKRVLEEIRKTVDEIRKELEDVDTKSAEIAERAKERKKDDKDKVRRLLEELEKLYRRLIEKVEDILRRIEEKVRDVERRNREILERLRELVERLAKEDKDGKERVERLRRELEKLVREVEESLKRLKEELDKIKEELRRILEELEEKLRRWSRELKETAR

SEQ ID NO: 26360 - protein, 180 aa, Artificial Sequence; identical to SEQ ID NO: 26359
  Synthetic sequence.

SEQ ID NO: 26361 - protein, 180 aa, Artificial Sequence
  Synthetic sequence.
SELEKVVEDLRRIVEEIERRLREVIKEIRELVRRAHERNKDVDRKSAEIVKDIEEKKKEDKDKVREMVRRLEELYRKLVEENEDILRRIEKKVRDAVETVERLIKEMRKIVEKVARDDKDGTERVERLKRALDELERRLKELVRELEDSLKKLADEVKRSLEELDKSLKDWKKKLDDELK

SEQ ID NO: 26362 - protein, 180 aa, Artificial Sequence; identical to SEQ ID NO: 26361
  Synthetic sequence.

SEQ ID NO: 26363 - protein, 180 aa, Artificial Sequence
  Synthetic sequence.
SEIERVLEEIKERVERADRKNEKVDRESAEKVKELHRRNEEVDRESAETVKRAERDKKDDRDKLRDVLRRLEERYKRLEDENKRLLKELRERYERLKKENKDILKKIRDDLRELARRDKDGTDKVREIRERVERLVKAVDESLERLERSLEEWARRLDKSLEDLKRSLKRWKEELDRKAQ

SEQ ID NO: 26364 - protein, 180 aa, Artificial Sequence; identical to SEQ ID NO: 26363
  Synthetic sequence.

SEQ ID NO: 26365 - protein, 180 aa, Artificial Sequence
  Synthetic sequence.
SELETLIKEATDLAEEVKEDLRRVDEESAKLVEDADDENKRVDEESAKIVEDLKREKKDDDEKVRRVLKELEDKYRRLAERNKRILDELDKLYKELAKRVKEVLDRIREKVKDVEREDKDGTERIRDLKEKVRRLMEDVKRLLEELERSLERWKEKVRDSLEKLKKSLEEWAKELKDTSK

SEQ ID NO: 26366 - protein, 180 aa, Artificial Sequence; identical to SEQ ID NO: 26365
  Synthetic sequence.

SEQ ID NO: 26367 - protein, 180 aa, Artificial Sequence
  Synthetic sequence.
KDLETVLEEIKRIVDDLDRRNKEVDKESAKLVKEADEKNKRVDEESAKIVKRLEREKKDDKDKVTEARRRLERTYREVDKDNKRILDELRRRYEELERRNEELLREIREKVERAAKKDKDGTDRVRRLREEVTKLLDEVRRSLDRLRESLKEWKERVDDSLRRLRDSLRKWKRKLEEATR

SEQ ID NO: 26368 - protein, 180 aa, Artificial Sequence; identical to SEQ ID NO: 26367
  Synthetic sequence.

SEQ ID NO: 26369 - protein, 180 aa, Artificial Sequence
  Synthetic sequence.
SELDDLLRRIRELVRRAEEDLKRVNEESARLVEEMDKDNKRVDEESAKIAEDLKREKKEDRDKVREVLKRLEDKYRELARRNKKILDELRKKYEDLIKKVRDIIREIDKRVKEVKDEDKDGTKKIEELKREVKKIADELERILKELEDSLREWSERVRKSLEELKDSLRRWAEELKRDLK

SEQ ID NO: 26370 - protein, 180 aa, Artificial Sequence; identical to SEQ ID NO: 26369
  Synthetic sequence.

SEQ ID NO: 26371 - protein, 180 aa, Artificial Sequence
  Synthetic sequence.
KDLERVVKEIERLVREAEKKIREVNDRSAKLARDLDRRNREVLKEIKKIAEDLEREKKEDEKAVRDLLREIRKKVEDVKETNERILRKLRKEYEELRREVKKILEEIEKLVRDVERKDKDGKERVERLKRELERLKRELEETLKRLDEELEKWEERVRESLKRLEDRVREILKRLEDDAR

SEQ ID NO: 26372 - protein, 180 aa, Artificial Sequence; identical to SEQ ID NO: 26371
  Synthetic sequence.

SEQ ID NO: 26373 - protein, 180 aa, Artificial Sequence
  Synthetic sequence.
DELETVMKRIRELAKELNKKNKDVLDEIEDLVRKADKRNKEVLKRIEEILREARKRKKDDKDRVREVLEEIKREVKKLERENEEILKRIEDTLRELERDNERILEEIRRLVEDAERKDKDGTERVKRLKDELRRLIEEVRRNLKRLKEEVDKIRERVRRSLKKLKEDVKRLSDEVKETLK

SEQ ID NO: 26374 - protein, 180 aa, Artificial Sequence; identical to SEQ ID NO: 26373
  Synthetic sequence.

SEQ ID NO: 26375 - protein, 182 aa, Artificial Sequence
  Synthetic sequence.
KEIEDLLRELRELVKEIDDLIKDATREIERLVKEVHDKNEKVTRRLEKLMRELREVARRGDLRDDDIRKAIREMEELSKEVEDTNRKVIEDLRRLSERLEEEVRKLIRRAEELVADIARKRGRDERIETLERALRELVRELEEKVDEHRKRTDKVARDLKKSVDDHRRRTEELVRELRKTEE

SEQ ID NO: 26376 - protein, 182 aa, Artificial Sequence; identical to SEQ ID NO: 26375
  Synthetic sequence.

SEQ ID NO: 26377 - protein, 182 aa, Artificial Sequence
  Synthetic sequence.
SELEDVLRRAKKLVEDVHRDNKRVTEELEKLARELHKKNEDVLRELKKLADDLREMLKRGDLREEDIKRVRTEIRKLLEDVRETNKRLIERIKDLSERVREINEEVIKEMEELLEDLRRRDGDDEKVKRLEEEIRRLARELRESVRRHKERTEELVERLKESLKKLEEDIRRLEKELEDDRR

SEQ ID NO: 26378 - protein, 182 aa, Artificial Sequence; identical to SEQ ID NO: 26377
  Synthetic sequence.

SEQ ID NO: 26379 - protein, 182 aa, Artificial Sequence
  Synthetic sequence.
SDLDDVLRRIRELAKRVHDENKRVTEELERLVEELEKKARELLRRIEELVRTLKEMRERGDARREEIEKVIEDIERLVRKIEDLIRKLIERARRLSEEVEDINRRVIEELRELVRELERRTGEDERVERLRRELEKLVKELEESVRRHKKRTRELEERLKDVLRELEDAVRRLVEELEKTDE

SEQ ID NO: 26380 - protein, 182 aa, Artificial Sequence; identical to SEQ ID NO: 26379
  Synthetic sequence.

SEQ ID NO: 26381 - protein, 182 aa, Artificial Sequence
  Synthetic sequence.
EEIERLLEEIKRLVETVHESNRRVLKELRDLAEELKRRNTKSNRDMERLVEELEEMRRRGDAREEVIRRVIEELKELLDRLHKDNRDAEREVERLVREVKRENDDVIRRIEELVEDLRRKRGEDEKVKTARDEVRRLVEELKESVERLARELKKLVDELRKVDEDNKRRLEELERRLRESTR

SEQ ID NO: 26382 - protein, 182 aa, Artificial Sequence; identical to SEQ ID NO: 26381
  Synthetic sequence.

SEQ ID NO: 26383 - protein, 182 aa, Artificial Sequence
  Synthetic sequence.
SELEDVLRKLEKLAREVDKINKDLIKRVEELARELKKKNEKSNKEARDLVKKLKEMKDRGDLRREDIDRVEKRLEKLLKELHEENKRVIDEIRKLLEEAEETNRRVIEEIKKLVKELEDRDGDDERVRRLKKEVEELERRLRRSVDDLRRKIKELEDRLREIDERNKREIEKLVKELRDTDR

SEQ ID NO: 26384 - protein, 182 aa, Artificial Sequence; identical to SEQ ID NO: 26383
  Synthetic sequence.

SEQ ID NO: 26385 - protein, 182 aa, Artificial Sequence
  Synthetic sequence.
DELETVAKLLEDLSRTNEDRLREVKETLKRLADTVDKINKEVLRRLRELAKRLKELKERGDLREEKIERVKEELERLVDKVRKENKEVDDEVRRLVDEVRKHSKRVIEELRKLVDDLRRRRGEDEDVRRLEEELRKLEERNRRLVRELEEVLKKLKDELKKSVDRLKEELDRLVKELDEIKK

SEQ ID NO: 26386 - protein, 182 aa, Artificial Sequence; identical to SEQ ID NO: 26385
  Synthetic sequence.

SEQ ID NO: 26387 - protein, 182 aa, Artificial Sequence
  Synthetic sequence.
SEIEDALRKMEKLAEDVNRKNEEVIREVRRLSEENKKKLDDVLETLKKLVRELAEMTKRGDIREEDIKRVIREAERLVKELDDHSKEVIKEIKERLRRVEEENKRVIDEIKKLVKEIVDKEGRDERIRTLEKAVRDLVRELEESVDRLRREADRLVEENERVVERLKRELKRLVEELERRAK

SEQ ID NO: 26388 - protein, 182 aa, Artificial Sequence; identical to SEQ ID NO: 26387
  Synthetic sequence.

SEQ ID NO: 26389 - protein, 182 aa, Artificial Sequence
  Synthetic sequence.
DELREVLERVKRLVDTVNKINDDLTKRNEDLSRKNVDKIRRLTEEIERLVEEVDRARREGRLREREIEKVIRRSKKLSEDLKKHSEDVIRESDELLKDAERVNREVIKEIEELVRDLERRRGRDEDVRRLEEEVRKLVEELRRSVEDHKRRNKESVDRNRRAVEEHERRNREVVERLERKAK

SEQ ID NO: 26390 - protein, 182 aa, Artificial Sequence; identical to SEQ ID NO: 26389
  Synthetic sequence.

SEQ ID NO: 26391 - protein, 182 aa, Artificial Sequence
  Synthetic sequence.
SDIEEALKTMEELSRRNEETLRRVLKRLKELADEVNRKNERVLEEAKELADRLRELRERGDLRKEDIDRVIREIERLVKEVADTNKKVIEEVKRLVERLEEHSREVIRRLEELLRDIRRKKGDDERIKTLEEDLRRLVEENKKVVEELKRRLKKLVDELRESLKELEKAVRKLVKELRDDEK

SEQ ID NO: 26392 - protein, 182 aa, Artificial Sequence; identical to SEQ ID NO: 26391
  Synthetic sequence.

SEQ ID NO: 26393 - protein, 177 aa, Artificial Sequence
  Synthetic sequence.
SSKETVAKRVEDVKRELEEVLKELARESKRLSDRDKKLNEEAAEEIERLKDELRKKVRDKDTLEEVLRRLEELLRRLNEHSRDVIRRSEDSLRKAADFVRRLKETADKLLEELKRVDDDEVLERIVKRVRDLVEEIKRRLEKLAEDNRRLSKRNEDVIRTLLEEARKLVEKVKEEVR

SEQ ID NO: 26394 - protein, 177 aa, Artificial Sequence; identical to SEQ ID NO: 26393
  Synthetic sequence.

SEQ ID NO: 26395 - protein, 177 aa, Artificial Sequence
  Synthetic sequence.
RSKEEVAKEIKRLKEENKRLLDELAKRSEELERRDRRLNEEHHREIRRLTDELRKKVRDEDTLREVEERVRKIDEDVNRHSEEVIRESRESLKRVADHSRKVVEDLERLLEEAKRVDDDRVLKEIVDEARRLSERNEEVLRRLLKENEDLSKRNEDFIRKTMKELRDLAEEVKERAK

SEQ ID NO: 26396 - protein, 177 aa, Artificial Sequence; identical to SEQ ID NO: 26395
  Synthetic sequence.

SEQ ID NO: 26397 - protein, 177 aa, Artificial Sequence
  Synthetic sequence.
KSKEDVKREIERLKKENREVLDTARKRIEDLIREDERVNREAAEEIKRLVEELERRVRDREELRKVTEELKKLLEDLNRHSEEVIRTLRKLLDDLRKHSEEVERRLEKLLEELKRVEDDRVLKEIVEELRRLSEENKRRIERALEELEKLSKDNTDRIEEAREDLRRLVRELLEKEQ

SEQ ID NO: 26398 - protein, 177 aa, Artificial Sequence; identical to SEQ ID NO: 26397
  Synthetic sequence.

SEQ ID NO: 26399 - protein, 177 aa, Artificial Sequence
  Synthetic sequence.
KDEEEVAKEIERLKEENDRVLKEAADKIEKLKKENREVNTRAAEEIERLKKELREKVRDKDLLRKLEEELRRLLEELKEHSERVERELEKLLEDLARHSEDVKRRLDEILEELKRVRDSRVLEEVVRRLRKLSEENKKRIKEMLDDVERLSRRNEEKIRRVLEDARRLLEDLTRKAK

SEQ ID NO: 26400 - protein, 177 aa, Artificial Sequence; identical to SEQ ID NO: 26399
  Synthetic sequence.

SEQ ID NO: 26401 - protein, 177 aa, Artificial Sequence
  Synthetic sequence.
SEKETVAEEIRRLIEKNKKMLEDHTRDIRRLEKENDDVNRKHHEDIRRLKDRLRKEVRSEETLRDLTKKVEEIDEEIKRHSEEIKRRLREINKELKEHSDRVVERLRKLLEDAKRVDDSRVLKEIVDEARELSKRNEDKIRKSLEELKRLSERNKKKIEDTLKELRKLAEEVKRRAT

SEQ ID NO: 26402 - protein, 177 aa, Artificial Sequence; identical to SEQ ID NO: 26401
  Synthetic sequence.

SEQ ID NO: 26403 - protein, 177 aa, Artificial Sequence
  Synthetic sequence.
SEKERVADDIRKLEEENKEVLDRAAEEIKRLKKRDRELNKRHHKTIRDLVDELEKKVRDEETLRRVKERMREIDERVKESSKRVEDELEKLLEELKRHSEEVVRRLRELLERLKRVDDSRVLDEIVKEARDLSEENRKLIEEALERLRRLSRENEETIKKTMEELKRLVEEVKERAR

SEQ ID NO: 26404 - protein, 177 aa, Artificial Sequence; identical to SEQ ID NO: 26403
  Synthetic sequence.

SEQ ID NO: 26405 - protein, 177 aa, Artificial Sequence
  Synthetic sequence.
KSKEEVADKIRKLKEENRKVLERHTREIEKLKRDDEEANKKHHEDVKEVMKRLEKEVRDKDTLEKVKREAKKIDEDLRKSSEEVMRTLDEINKDVARHSKEVAERLEELLERLKRVDDDRVLEEIVREAEELSKRNKDRIDESLKELRKLSEDNKREIERTLEEIKRLAEEVRRRDT

SEQ ID NO: 26406 - protein, 177 aa, Artificial Sequence; identical to SEQ ID NO: 26405
  Synthetic sequence.

SEQ ID NO: 26407 - protein, 177 aa, Artificial Sequence
  Synthetic sequence.
SSKERLKEMIDRLKERNKDLLRKAAEEIKRLEDEDREVNRRHHEEIERLKKELREKVRDKDTLKELEERVEKIDEDVKRNSKRVVETLRELLKRLADHSKRVLEELDRLLEELKRVDDDRALDEIIKEAKKLSDDNERLIRDVLRRARDLSRRNKETIRRTLEKLKREAEKVKEDAR

SEQ ID NO: 26408 - protein, 177 aa, Artificial Sequence; identical to SEQ ID NO: 26407
  Synthetic sequence.

SEQ ID NO: 26409 - protein, 185 aa, Artificial Sequence
  Synthetic sequence.
SDADRIIEEARRLSEENKRRIEEVLKRNRKLSKENHDKNDELLKRVRELLRRVVERLRREEGREEIKKLVEELEKELDKILEESRRSTEEVKDESRRLLEEIRRSTKEVKKTLDDLLRKVRERVRDKDKLKRLEDEVRKLTDENRRVTEKAERDLRRSNRENDRSTERLEEEIRRIKKRLRDEAR

SEQ ID NO: 26410 - protein, 185 aa, Artificial Sequence; identical to SEQ ID NO: 26409
  Synthetic sequence.

SEQ ID NO: 26411 - protein, 185 aa, Artificial Sequence
  Synthetic sequence.
REAEDLIRRLRELVRRHHELNRKLAEELRKLSEENKRKIEKVTREVEKLVKDVADTLKDDRGDERLERLVKELKDRLDELVKEIERSTREVERRMREVLKRSRDSAREVEERVERLLEEVRRRVRDKDKLKRLEEELERLKEEVRKSNRDLEKEVRDLRKENEKVTEEVKKRIEDLKRKLDEDRR

SEQ ID NO: 26412 - protein, 185 aa, Artificial Sequence; identical to SEQ ID NO: 26411
  Synthetic sequence.

SEQ ID NO: 26413 - protein, 185 aa, Artificial Sequence
  Synthetic sequence.
SEVDKIIKDARDLLKEHHEKNKRLIEENRRLSEENKDRIRRALEKLKKLVDDLRRLIEEVDDRDTLRELVRRVERTLDELLKDIERSTDEVRRESERLLEESRRSAEEVKRRLDELLKEVRRRVRDKKKLDELETEVRRIKETIDRSNERLERELEKSNRENKKVTDDAREVVKKLKEEIKRDED

SEQ ID NO: 26414 - protein, 185 aa, Artificial Sequence; identical to SEQ ID NO: 26413
  Synthetic sequence.

SEQ ID NO: 26415 - protein, 185 aa, Artificial Sequence
  Synthetic sequence.
SEADEIIKEAKKLADDHHRLNKEIIERNKRLSEENHKLNEKIIEDVRRLVKDVAERLKRDEDRRDLDRLVDEVREELRRLLEESERSTEDVKRESKRLLDESKKSAEDVKRDLDRLLKEVEEKVRDKEKLDRLREKVEEIKRRVDKSNDELRRSMEESNKRNDESTDRLREELRRLDEELDRRRK

SEQ ID NO: 26416 - protein, 185 aa, Artificial Sequence; identical to SEQ ID NO: 26415
  Synthetic sequence.

SEQ ID NO: 26417 - protein, 185 aa, Artificial Sequence
  Synthetic sequence.
SDLERVLKELRELVRRHHELNKDIIRRARRLSEENEKDIKKLLDDARKLLEEVKRTLDRMEGKEEVDKLIEELERRLDKLTKRLEDSSRDVKRRLRELLKRSEESAREVKKTIRKLEKELTERVRDKKKLDEARTELRKLEEEVDKSNKELRDEVEKLERRNDELLERAREEVERLKEELRRKAT

SEQ ID NO: 26418 - protein, 185 aa, Artificial Sequence; identical to SEQ ID NO: 26417
  Synthetic sequence.

SEQ ID NO: 26419 - protein, 185 aa, Artificial Sequence
  Synthetic sequence.
SKAERIIEEVRRLSEDNKRRIKKLLDEAKELLDRHHKRNKELLEEIERLLREVKERLKKDRGRDRIRRLVEEAKKRLDEVLEDSKRSARELKKTLDELLKRLEKSSEDVERRLRKLEDDVRREVRDKDRLEELRRDLERLRKENKDVLDRVREDIKRLKEELDDSNRRLKDTIEDLKRELDEEAR

SEQ ID NO: 26420 - protein, 185 aa, Artificial Sequence; identical to SEQ ID NO: 26419
  Synthetic sequence.

SEQ ID NO: 26421 - protein, 184 aa, Artificial Sequence
  Synthetic sequence.
SEVEELVKDLKRILDEIKRTNDELNKELKRLSDESRKLSKENIDRLRRILEEIEKTIRRRKTEEVKRRIEELVERMRRSSEEVVRRIEKLNEEANRKVEKVKRENKELLERAERKVREVAKRIKDEEKVRKLEKLLEDIKRTVDKIIRESEKRAEEINRDNRRIIEENKKKLEEIARRVEELAR

SEQ ID NO: 26422 - protein, 184 aa, Artificial Sequence; identical to SEQ ID NO: 26421
  Synthetic sequence.

SEQ ID NO: 26423 - protein, 182 aa, Artificial Sequence
  Synthetic sequence.
SSIEELAKRLEDLIRELRDRHRRLNEELKELTDRNRKEIEEANERIKRLIDDLERLRRRGDIDEKRIREIIKRIRELSKEIEKRSEKIIRELERLVEELAKETEDIIRRARELVEAIRKERGDNEEIDKLRRELERLEEELKKVLDRTREELERLVRDNRRLNKEHKDHSDTLVRRLEESRK

SEQ ID NO: 26424 - protein, 182 aa, Artificial Sequence; identical to SEQ ID NO: 26423
  Synthetic sequence.

SEQ ID NO: 26425 - protein, 186 aa, Artificial Sequence
  Synthetic sequence.
SEVEDLIRDLERLLKEHDELNKRSMEELEKLLKDLEKMVRDSLREAREIAERVKETIKRTSDKEDLRRRLKKVKDDLDESHKDLARLLKEIEERIDRILRENERHLEEIKREIKKILEELERAKKGEEKKLDEARKVLEEIKKRLEDSLRRLREEAERIKRELKRILDEHRKEIERIKKEIDEAAR

SEQ ID NO: 26426 - protein, 186 aa, Artificial Sequence; identical to SEQ ID NO: 26425
  Synthetic sequence.

SEQ ID NO: 26427 - protein, 186 aa, Artificial Sequence
  Synthetic sequence.
SEIEKVLRDVEKLVREHEDLNKKSAEEAERLTRDNKRRVDESKKRIREILKEVDEIIRRTERKEDLERKLTEVRRRIDKSHKELKEHSDEVVKRLKEILDRNAEHLEEIERRIDKILDDVRKRKQGDDKDLRRLAEEAERIKKRLRDSLDELRKIIEELEERNRRINEDHRRDLEDVKRRIEEKSK

SEQ ID NO: 26428 - protein, 186 aa, Artificial Sequence; identical to SEQ ID NO: 26427
  Synthetic sequence.

SEQ ID NO: 26429 - protein, 186 aa, Artificial Sequence
  Synthetic sequence.
SEIEEVARRAEKLTKENEELIRRSLRDIERLVKEMEDIVRKSLKEIKELVERLKDISRKTSRKEDLRRIIEDIKRKIEESHKRLAELLRDIVRKIRESHERVNKHSKEVMERLDRLLEEVEKAKKGEDEKLRRLAKRIEELKKRNEDLNREHRKRLEEAEKRLKDVLDEHRRRLEEVKKELDEEAK

SEQ ID NO: 26430 - protein, 186 aa, Artificial Sequence; identical to SEQ ID NO: 26429
  Synthetic sequence.

SEQ ID NO: 26431 - protein, 186 aa, Artificial Sequence
  Synthetic sequence.
DEIERVLEEIKKLTDDNRKLVKESIDRAEELLKRHEEENKKSVERARKLVRDLDEIRRKTDRKEDLRRIIKEVREELKKILKENADHAREIMRRLEESHKRLNEHSKRVVEEIRRLLEEVKKAKKGDKKKLDELARRAEDMERDNKRINKEHRERIKEIKERIKESLDRLAEEIKKIEKELEDKAR

SEQ ID NO: 26432 - protein, 186 aa, Artificial Sequence; identical to SEQ ID NO: 26431
  Synthetic sequence.

SEQ ID NO: 26433 - protein, 186 aa, Artificial Sequence
  Synthetic sequence.
SEIEKVLEDAKKLTKENEDLIRKSLEDNERLLRRHEEENKKSAEDMRDLLRRLEDIIRKTSRKEDLERIIREVIETIRRILKRNAEHAEEVIERSRRSHEEVNRHSKEVIDTLRKLLEEVREAKRGSEELLERLAREIKKLIDKNRKLNEDHRRESEKSERRLRESLRKLAEEAERIEREMDKSRK

SEQ ID NO: 26434 - protein, 186 aa, Artificial Sequence; identical to SEQ ID NO: 26433
  Synthetic sequence.

SEQ ID NO: 26435 - protein, 184 aa, Artificial Sequence
  Synthetic sequence.
SKIEKIVRDAERLLDELRKLAEDVLRRLEELNRRAEDVIRRLAEENTELLKRLEDLLETEKTADEKLKRAVEKLEKASEESVDRLRRLIEELKKEHKRLLEELERVVKKVDDDLKRLTKEIEGTDKKKAEELKRKAEEIKRRIDKIVDEVRKAIRDSAEHLKRLLEEYRRRVEEVKKRVRDAAK

SEQ ID NO: 26436 - protein, 184 aa, Artificial Sequence; identical to SEQ ID NO: 26435
  Synthetic sequence.

SEQ ID NO: 26437 - protein, 190 aa, Artificial Sequence
  Synthetic sequence.
DELERLREEVKRLSEENKELIKEMEKRNRELSKENEKVNRELKKRVDDIIRTLKELRKEGRDEETLTRMLDRVRKELKRLKEENKKILEDLRRRSEELARRLERADEELKKRLEDLARDLKRKLKDGDEKEEREIRRVLEDIKRIADENERENREALKRLEETNKRNTDHNRDVLREIDKLFREVAEELR

SEQ ID NO: 26438 - protein, 190 aa, Artificial Sequence; identical to SEQ ID NO: 26437
  Synthetic sequence.

SEQ ID NO: 26439 - protein, 180 aa, Artificial Sequence
  Synthetic sequence.
SEKEEVIKRIREELKENEKENRDVIRKIRELLDELRRRVEEVLRRLKKSNEDIEREAEKKPRTEELKKLLDEVKERSKELTERLREALKEAAKVVERVVEEIKRINDELRKRIERLEEKLDEVREEELKERIKKLSKENKDRVRRMLERIKKLVDDLRRLLEELRRRNEKLLDRLRKAIK

SEQ ID NO: 26440 - protein, 180 aa, Artificial Sequence; identical to SEQ ID NO: 26439
  Synthetic sequence.

SEQ ID NO: 26441 - protein, 180 aa, Artificial Sequence
  Synthetic sequence.
KDEEKVIEDIRRILEENHRENKEVIDKIRELLRRNEEENKEAIRRMRKSNKEITDRAEEKPQTEDLRRLIKEAKDESDKIIRRLEELNKRLRDAVRELEKKIKEINKELKRRIEELERRLDKIRREELERRVRELSKENKEMLKRVEDKIRELSERNKRTVKKVREDNERLIRRLEEEDK

SEQ ID NO: 26442 - protein, 180 aa, Artificial Sequence; identical to SEQ ID NO: 26441
  Synthetic sequence.

SEQ ID NO: 26443 - protein, 188 aa, Artificial Sequence
  Synthetic sequence.
SELERIEEDVERLNRRNEETLKRIDEALKRLEKSNKELDEKLEETVKRIKDRVERVKRRNVDEEDLRRLDEEIERTLRELKKELDEHLRRVEDTLRRLKTESRRLLKEIKDRLEEIEKEEADGNLPDKAKREVDKVRTDAREILKENKRRNEDVIRKIEEKVRDLERRNRDLLRRVKTKIDRLREELK

SEQ ID NO: 26444 - protein, 188 aa, Artificial Sequence; identical to SEQ ID NO: 26443
  Synthetic sequence.

SEQ ID NO: 26445 - protein, 186 aa, Artificial Sequence
  Synthetic sequence.
KELEDIARRVDELNKRNEELIKDAKRVLKEASDKNKEMNERVDDKLRRLAKKVKELTGTSEEMVERLKRELETVKEKIRKESREILEELKEVLKDLERRMRKLEEENKTVLREIEERLRKRNGGKEERDKIRDLLRRIREKIEKNRKDAEDVLREIKKLIDENKKRNEEVLKKIEELLRELEKRLE

SEQ ID NO: 26446 - protein, 186 aa, Artificial Sequence; identical to SEQ ID NO: 26445
  Synthetic sequence.

SEQ ID NO: 26447 - protein, 182 aa, Artificial Sequence
  Synthetic sequence.
SRLEKVIKEIKKTHEELERRFKKNSDEAEESLKRLEDELRKVVTDIERKLRDLERRVREAGRRREELEKLAEDLKETIERLRKEVKELMDRHRDVNREIEERLRRLARENEERLRKADEKPRSEELITRLKKHVDDTAREVEELIKRHTEHNEKLRRDIKKLLEELKRKVDELRKEIETRTR

SEQ ID NO: 26448 - protein, 182 aa, Artificial Sequence; identical to SEQ ID NO: 26447
  Synthetic sequence.

SEQ ID NO: 26449 - protein, 181 aa, Artificial Sequence
  Synthetic sequence.
SELEELIKRAEDTIRRLEREIDELIERHRRSAERLRETLKELIDRHRKSIEDVMRELKRRRGRVPDEVKRTLEKSKRDLDRLAEELEKTLKESEEELKRLKDRLKETLDKLREDLKELAKRGRTGKEEIERLIKELEKKIKEVVKRIRDIDEDLKRKAKKVVDDLRELNERLERKAKEATK

SEQ ID NO: 26450 - protein, 181 aa, Artificial Sequence; identical to SEQ ID NO: 26449
  Synthetic sequence.

SEQ ID NO: 26451 - protein, 185 aa, Artificial Sequence
  Synthetic sequence.
SEEERLRDHSRRVEELARRAAEKLRRHSEDVKRLITELIKLIEDVMKKIEDEVRDAEKRGDTDETLVKRIEELVTRLEKTLRDMTREIRRSHKELEDTVRRLVEELKRSNKELKKEIDEGDLRDELKKRIDELHKRNKDKLDEISERLKRLLEENRKLIKEVEERLRKLLEDLRKLIEDVKRRLR

SEQ ID NO: 26452 - protein, 185 aa, Artificial Sequence; identical to SEQ ID NO: 26451
  Synthetic sequence.

SEQ ID NO: 26453 - protein, 185 aa, Artificial Sequence
  Synthetic sequence.
DFEEEIRRNLKRVRDLAKKLEDLIRKHSEEVKRLAEEVKREIEEVIKRAKKKMEDVRRDGDNDETLLRELERTLRELERKLRELSERLRRSNEKLKRDLKRVRDDLKRSHDDLERRIREGDLRDELKKRADRLLDEHREELKRIEDRLRELLERNNRLLEDIDRRLKELLEDLRRVLKEIEEELR

SEQ ID NO: 26454 - protein, 185 aa, Artificial Sequence; identical to SEQ ID NO: 26453
  Synthetic sequence.

SEQ ID NO: 26455 - protein, 186 aa, Artificial Sequence
  Synthetic sequence.
SEVERLLEDLRRLAKESDESLKKSHRELRKRHEEVRRTIEELLKDLERTVKEIKEELERDVKDEKKLKELEDRLRELIERLRELMKRLTDESRRNLEEDKRLLEEYREALKKLEEELKELRRAGLPEEDVRREIKRVLDTIRKLNEDWKRRNEESKRRLDKLLDDAKKAIDKIVEDVKKLLEDARR

SEQ ID NO: 26456 - protein, 186 aa, Artificial Sequence; identical to SEQ ID NO: 26455
  Synthetic sequence.

SEQ ID NO: 26457 - protein, 186 aa, Artificial Sequence
  Synthetic sequence.
SEVEKLLRDLERLARRVREELRKSHEKLDKLARDSKKSIEDLLEDLRRIIEEIEEELDRRVRDKDKLKRARDELRRLIDELRKIVEKYEEELKRLKKEDRDTLKDVDDKLRDLRRRLKKLREDGLPREDVEREVRRIKREIKELLDRWRRANEEIAREIRKLNEEVKRRVEKILRDLEELLRRLRK

SEQ ID NO: 26458 - protein, 186 aa, Artificial Sequence; identical to SEQ ID NO: 26457
  Synthetic sequence.

SEQ ID NO: 26459 - protein, 184 aa, Artificial Sequence
  Synthetic sequence.
SELEKLEKELKDLLDKIRRDLEKSLKENDELVKKIEEDLKDLLKKLDDRLEKVARDLKREKSGREKELEDLRRELEKIKEELKDELRRLKDENRKSKEDNERILKKLEDELREIERRLREAKIERETATKRVKEVLDKLRKMLEDLRRHNEENKRRNKEVLDELRKKAEDVLRRIDEALKELKR

SEQ ID NO: 26460 - protein, 184 aa, Artificial Sequence; identical to SEQ ID NO: 26459
  Synthetic sequence.

SEQ ID NO: 26461 - protein, 183 aa, Artificial Sequence
  Synthetic sequence.
SVEEMETRLKEVADDLKKKIDEVLTRLEKLNRELTKRSRDMNRELERLNKEAEDRARDVLKRVDKDTLKRELEELKKHVKEVKDRSREIEEKLRRHLDEVRKRVEELKRRLDDTLRRLRERQVDRDEARKLLRDLERLIEEIKKTLDELLKHHKEELDRIDREHEELLRHHKKTLERIEEKID

SEQ ID NO: 26462 - protein, 183 aa, Artificial Sequence; identical to SEQ ID NO: 26461
  Synthetic sequence.

SEQ ID NO: 26463 - protein, 176 aa, Artificial Sequence
  Synthetic sequence.
DRVEKVLREIEKRLRDHRKRLKDALDEIRKRIEEHEEKSERLNRESKKLLKDLEDMKRRGDLDEDTVRRLEEENKKLLDELDKHLKRLKEEIEKLLRDLNRHLEKLKEDIKRLEDEVNIDEEVVRRARELVKRLEEDHRRMVEEIRRTIKRAEERHKKSVEDNEKLLRDLRDRLEK

SEQ ID NO: 26464 - protein, 176 aa, Artificial Sequence; identical to SEQ ID NO: 26463
  Synthetic sequence.

SEQ ID NO: 26465 - protein, 176 aa, Artificial Sequence
  Synthetic sequence.
SEVEKVLEDLKRLLDEHEKRSRELNKRSKKLADEARRINEELLRELKKLLDELKELKDRGDLDERTVEELRKTAEDINRRNKEMLKKLSDENEKLLDELNKHLEELERRVRELERDANVDKKFLDDMRRLLEELKERHERSERENRKLLRKLEEDSKRTNDESKKLLDKLRDDLEK

SEQ ID NO: 26466 - protein, 176 aa, Artificial Sequence; identical to SEQ ID NO: 26465
  Synthetic sequence.

SEQ ID NO: 26467 - protein, 176 aa, Artificial Sequence
  Synthetic sequence.
DRVEEVLKRVEELVKRHDERLKELEDDLRRLIEEHLEKSRRLNKESEKLLKEILEVKRRGEADEKVAEDVERRNEKLLRELNEHLERLERTAKKILEEIDDHLRRLEEEIERLKRELNLSEEVVKTIDEIVKELRKRHEEVRKRLKELLDEMRERHERSVRRNRERLEKLLDDLRK

SEQ ID NO: 26468 - protein, 176 aa, Artificial Sequence; identical to SEQ ID NO: 26467
  Synthetic sequence.

SEQ ID NO: 26469 - protein, 176 aa, Artificial Sequence
  Synthetic sequence.
SEVERVLRDVERLLEEHRKKSKEANDTSRELARRHKEESDRLNKKSEDDARRLEDVKRRGEVDEEKLKELSKRNKKLLDDLNRHLEKLKEDNERLLRELDEHLRRLEETIKKLERDVNIDEDMVRRIREIVKKLKRDHEKSVEDNRRLLRELEERHRESVERNEDLLRRLEERARK

SEQ ID NO: 26470 - protein, 176 aa, Artificial Sequence; identical to SEQ ID NO: 26469
  Synthetic sequence.

SEQ ID NO: 26471 - protein, 176 aa, Artificial Sequence
  Synthetic sequence.
DEVETVLRDLKRLLDEHRRRSEELNKRSEELLREHEERSKRLNERSEKLARELREMKKRGEVDEETVKDLARENEELLRRLDKHLEDLERENKRLLRDLDRHLEELKKTVEDLKRRANVSEEFVKRMDELLRKLEEDHRRSVRENEKLLEELRRRHKKSVDDNRRLLEKLKRDADR

SEQ ID NO: 26472 - protein, 176 aa, Artificial Sequence; identical to SEQ ID NO: 26471
  Synthetic sequence.

SEQ ID NO: 26473 - protein, 176 aa, Artificial Sequence
  Synthetic sequence.
DEVEEVLRRIEELLTRHRKKSDDLNRRSEELAERHERTNRTLLEELRDLAKKLEDLKREGKLDERTVEELKKRAEKINRENKKHNDELRERNKRLLRELDKHMRELEERIRKLEKDVKVDEEVVKRMRDLVRRAKEEHKKSVDDNRRTLKELHDRSKKTNDDSRELLKRLEDRLRK

SEQ ID NO: 26474 - protein, 176 aa, Artificial Sequence; identical to SEQ ID NO: 26473
  Synthetic sequence.

SEQ ID NO: 26475 - protein, 176 aa, Artificial Sequence
  Synthetic sequence.
REAEEVLERIRRRLEEHLEDNERILREIKKRLDEHREKSKRVNDRSRELVERLLAVKREGKVDEEKVERLKKENEDLLRELDKHLEELKRRIRKLHEDNRRHNKELEDEIRRLEREANLSEDIVREIRRIVRELHERSKDSNREVERLVRKLEDDHRESVERNRELLKKLEDDLRR

SEQ ID NO: 26476 - protein, 176 aa, Artificial Sequence; identical to SEQ ID NO: 26475
  Synthetic sequence.

SEQ ID NO: 26477 - protein, 180 aa, Artificial Sequence
  Synthetic sequence.
RLEDVLREVREDLRRLNEESRKVLEENDKLDKDLNRRLKRLEEEARTEIKKVKDRLRDDEELKRLEKELEKILDRLRREVRKLNERNREELERLDKADKDINRELKRIEDEVKKLKERVDEDELEKRLTEVRKELEDRYRELIERSKDIIRRLEEEVRKLEKELRKVLEDLDRRAREATR

SEQ ID NO: 26478 - protein, 180 aa, Artificial Sequence; identical to SEQ ID NO: 26477
  Synthetic sequence.

SEQ ID NO: 26479 - protein, 177 aa, Artificial Sequence
  Synthetic sequence.
SEREDIKRLIEEIRKLVDEAAKEIERNIEEIRRLVKELEELSKKHIDEAREILERLKRRDDKKTIDEATERLRRSHKRLEERIREVKKRIDESHEKLREDLETLIREIRKLLRELRERTGDTELVEEMERDVREVERALRRLLDKHRRVLEDVERRLRRALEENRRVLEEIEEDSRR

SEQ ID NO: 26480 - protein, 177 aa, Artificial Sequence; identical to SEQ ID NO: 26479
  Synthetic sequence.

SEQ ID NO: 26481 - protein, 181 aa, Artificial Sequence
  Synthetic sequence.
KDEEATKKLRKAHEDSERHIKKLSEDTKKVHEESDRHIRKVSKETEDEARRIEKELRKLPDREELRDVMRRLKELLKTLREENERVRKRSEDLLRELEKRNKEVADESRKLLRDVEEALERGEVDEDTLEKIIEENKRLNDELAKENKEVIKENRKLNRELEERNKEVIDRMERILEETKR

SEQ ID NO: 26482 - protein, 181 aa, Artificial Sequence; identical to SEQ ID NO: 26481
  Synthetic sequence.

SEQ ID NO: 26483 - protein, 181 aa, Artificial Sequence
  Synthetic sequence.
REEELKREMEKAHEESERHLEELSRKTRDVHRRSEEHLKRLHERTKEVVDRIVEELRRLPKTDELRKVIEELERLLRTLKKENEDVRRESEELLKRLEEENKRVLKESRDLVRKVEEALRRGEVDEETLRRVIEKNRKLNEDIAKRNEEVIETNKKLNEEIARRNEEAIKTARKIVEDTKR

SEQ ID NO: 26484 - protein, 181 aa, Artificial Sequence; identical to SEQ ID NO: 26483
  Synthetic sequence.

SEQ ID NO: 26485 - protein, 181 aa, Artificial Sequence
  Synthetic sequence.
REKEVVDRLREEVRRVEEEVDRLNKELEEIARKVERELDKINEDYKRRLDKVREDIKRLPKTDELRTVEKRSDDHARELHKRSEEIKRDIRRRLKELHDRSREIKKTIRDLLRELEEMMRRGDVDEETVKRILETARELLDRWKKEVDEIVKTLEELLDRWRKEVERVKRENDKLLEELEK

SEQ ID NO: 26486 - protein, 181 aa, Artificial Sequence; identical to SEQ ID NO: 26485
  Synthetic sequence.

SEQ ID NO: 26487 - protein, 181 aa, Artificial Sequence
  Synthetic sequence.
DEKKVLDDLRRIVEKVKRDLDELLKDNRRVLREVEEELKRLNEELRRIAEEVTRELRRLPRTRELERIEKEIERRLKELHERSDELRRRLRKLHDELREKLERLKKRMEDLLRTLKDLVDKGDVDEKLAEEVARELRRLLREAEETSRDTKRKLREVLREWRELVKKIVDEMRRLLEEIKR

SEQ ID NO: 26488 - protein, 181 aa, Artificial Sequence; identical to SEQ ID NO: 26487
  Synthetic sequence.

SEQ ID NO: 26489 - protein, 179 aa, Artificial Sequence
  Synthetic sequence.
DLERLVEEIKRRLRELLKELHKKSKEIEEEIRRILKRHHELLERIVRRLEELVEEVKRRNSDDDTVKKRVKEEIDRLLEDYKRHLEEVERLLRKLLREYEEKVKEIEKEIRKLKKRLEEAGVDKKLLEDLEREIEKVKKAARDDLRRLEEIVRDVERRLRENVKRLKEEADRVKEELEK

SEQ ID NO: 26490 - protein, 179 aa, Artificial Sequence; identical to SEQ ID NO: 26489
  Synthetic sequence.

SEQ ID NO: 26491 - protein, 186 aa, Artificial Sequence
  Synthetic sequence.
EELERIKDEIRRILEELKREMEELTKESDRILRELERENEESAKRIKEILDELEKRVRDKPVDEKLKRELEELKERLKKLLKEVEDTTRKLKRELKELNRELRRRLEELEKRLRELLKKVDRDKSDDETLLRRLRESLEKLAKEVEDLLRKYERDVRELAKEDRKLNEELLKRVDDLAKEVRERLR

SEQ ID NO: 26492 - protein, 186 aa, Artificial Sequence; identical to SEQ ID NO: 26491
  Synthetic sequence.

SEQ ID NO: 26493 - protein, 182 aa, Artificial Sequence
  Synthetic sequence.
SKLEEIERELRELERSNEEEDRKWDDTTRKLEEDNREKNREWKKLTKDIRERVERLIRDLKDDKKTVRELRKEIRERSEKVRKELERHLEEVKDASRKLKKRLDDHRRELRDTVRRIRERLDKSEEARRLDEELEKVLRELKKRNEDTERRDREVNKKLEKENRDSEKENRDVLREIERALR

SEQ ID NO: 26494 - protein, 182 aa, Artificial Sequence; identical to SEQ ID NO: 26493
  Synthetic sequence.

SEQ ID NO: 26495 - protein, 179 aa, Artificial Sequence
  Synthetic sequence.
KKLEDLEEEIKKLLEELKERNERSAREDREILERLRDENRRTAEELDKSVREILKKTGDTEDLKKLKEEHKELKKRLKETTDRIRKTSKDLEKELRDATERIARELKRLVDDLRRKNLEDDRKLKEVRDTLEKLREENRKLNEEWRRKSEELRRRNEKVNKEVRDRNRETIERVDRKAK

SEQ ID NO: 26496 - protein, 179 aa, Artificial Sequence; identical to SEQ ID NO: 26495
  Synthetic sequence.

SEQ ID NO: 26497 - protein, 186 aa, Artificial Sequence
  Synthetic sequence.
EELERADRRLDRLLEESERDLDTIIRKLKKVVEELERTLEEAKRKAERTLEEIRRELKEAGLEERRLRELEEKLRRAEEELRKLEEDHRRRLKEVTDEVRRLIERHRRRLEEIKRRLEDLRRKGEPVEDLLREIKELLDDLRRHNEKLHRELEELIKTLRRHNEKLLEDIERLLRELRKEVEKLRR

SEQ ID NO: 26498 - protein, 186 aa, Artificial Sequence; identical to SEQ ID NO: 26497
  Synthetic sequence.

SEQ ID NO: 26499 - protein, 186 aa, Artificial Sequence
  Synthetic sequence.
DELRELRRELRKLLEDIRRRLEELTRENRDVLRKSREELERLLRRLKELLDRIRDSLRKRNGDEDKKRELEKVEREIEKLLRDLKRDLERLEKESEDSLRELEKELKRIEDEIKKLLEDAERLLERGEVDKDKMKKLLRDLERKLKRAEEESKRHIRENEKLTEEAARKVEELLKEIKRKLEELEK

SEQ ID NO: 26500 - protein, 186 aa, Artificial Sequence; identical to SEQ ID NO: 26499
  Synthetic sequence.

SEQ ID NO: 26501 - protein, 172 aa, Artificial Sequence
  Synthetic sequence.
SVEDTIRELEKRIRDLNREMERLNRESVEKIKRLNEKVRREIEDILREIKRLAENLKDVDERDLERLLKELRDELERLSRDSERELKRLEEEHRRARKKSEEDLRRLDKEVKDKPIDESLRRKLKKLADEHRETVDRMHEKNRKLADDHRDSVRKLEERIKRLTDRLREERK

SEQ ID NO: 26502 - protein, 172 aa, Artificial Sequence; identical to SEQ ID NO: 26501
  Synthetic sequence.

SEQ ID NO: 26503 - protein, 172 aa, Artificial Sequence
  Synthetic sequence.
SEVEETLKRLEEVIREAEKTIDDSNREIEEAVRRIKTTIEKSNRDLKDLVEKLKRLKEIDSEEVKRRLDEAAKRHKEILDDLRRKLEELEKRHRDTLKRLRERLDRIREEIERRGTTEDVRRRVKEIIDKLERKIEESERNLKRIIEDLEREMRESEERVKEIIRDLERTEK

SEQ ID NO: 26504 - protein, 172 aa, Artificial Sequence; identical to SEQ ID NO: 26503
  Synthetic sequence.

SEQ ID NO: 26505 - protein, 179 aa, Artificial Sequence
  Synthetic sequence.
SEIDEVLKRVEDSVREIERKLEEIERRLRRLNEEVKKRLDEIEEEIRRLVEELRRRNTKDERALRRIEEKIRDLKRKLDEILKKLKEDYERLKRELDKLLREHEERSERIKEELKKRGLPDDRLREIEKRIDDLNKKVRDEVERLKREADKSLETIKRLVEELKEKLDRLLEEVREEVR

SEQ ID NO: 26506 - protein, 179 aa, Artificial Sequence; identical to SEQ ID NO: 26505
  Synthetic sequence.

SEQ ID NO: 26507 - protein, 175 aa, Artificial Sequence
  Synthetic sequence.
STRERLKKVLRDVERANKELSDRNKRVLEKLRRDVERLSRENEKLVRELEEAIKDLRRKGRDLREEVERLSDEDRRANEELKRRLKKLEDDLDRIDRDLERKSRRLVEELEDLLRRLNVDEDLRREVEEVLKRIRDSNRDNRRKNEKVKKDIREILRRNEKRNREVNEKIRRDET

SEQ ID NO: 26508 - protein, 175 aa, Artificial Sequence; identical to SEQ ID NO: 26507
  Synthetic sequence.

SEQ ID NO: 26509 - protein, 185 aa, Artificial Sequence
  Synthetic sequence.
KETEEVKDVLRRVRKRIEDLSKKNKDDLRRVEERNKELNERVKRLLEELKRRVDDLKRKGRREDDLTREVEKLERELEEVLRRMREETRKLEDEIRRLNEELDRRLKKLEKEIRDTLKALRERVERREDLERVEEDVRRVIKEIRDLARENHEENRDVIRRIRESNKRTEDEAREVLDRIRKTAT

SEQ ID NO: 26510 - protein, 185 aa, Artificial Sequence; identical to SEQ ID NO: 26509
  Synthetic sequence.

SEQ ID NO: 26511 - protein, 177 aa, Artificial Sequence
  Synthetic sequence.
KEREEAEEMLKRLEEELRRLLEESEKIIERSERHLEKLLKDAEDEIRRVKEELDKIDIEEKVIEEVKRKIDEIKRRLEELAERARKVHKDLRDRHRKLFEEFKRVLDEIRRRLDSGGDREEIRRLIERLRELLEEIARRIEKTNRELEELNKRLADDIKRLIDELERVLREVEERSR

SEQ ID NO: 26512 - protein, 177 aa, Artificial Sequence; identical to SEQ ID NO: 26511
  Synthetic sequence.

SEQ ID NO: 26513 - protein, 175 aa, Artificial Sequence
  Synthetic sequence.
DEVETLLEEARKVLEELRKKIKELNEDSKRVLEELEKRIRDLDRRSTEVLRRLEESDLDRKEVKKMLDDLRREYEDMERRIKEVLDELEKKYRELEKEIDRAREELTKRLEDLKREGKSTEELEDALRKIRKAVEELKKDVRRTLEEIKKEVKRLIEEARRSLDKIRRDVEKRDE

SEQ ID NO: 26514 - protein, 175 aa, Artificial Sequence; identical to SEQ ID NO: 26513
  Synthetic sequence.

SEQ ID NO: 26515 - protein, 175 aa, Artificial Sequence
  Synthetic sequence.
EEVKRLVDDLREVTKENEKRARDLDRDSKRVSEENARKIETLNRDNERVNKELADSDRREEEVEDALRRLEEEYRRVHKENREETKRLREKYEELHERNKEVLERLKRKVDELRRKGKSTEKLDEDLERLERRNRKINEDAKTTLREIERENEELNKRLEETLRRSEKHLRDRRK

SEQ ID NO: 26516 - protein, 175 aa, Artificial Sequence; identical to SEQ ID NO: 26515
  Synthetic sequence.

SEQ ID NO: 26517 - protein, 179 aa, Artificial Sequence
  Synthetic sequence.
REVEKLIKELEDLNRDHARKVKELIAELEKLLRDHAEKVRKLIEEARKTLEDLREIVERKGPVEELLKEAEKKLKEIKEEIERSSKELKKEIDRIEEDIRRSTERLRREHKRVADDLRKKGLDKKDVREMIRRSEENLKRLNEEVKRAIRKVEEDLKELNKRARDVLEELRKRVEDTFR

SEQ ID NO: 26518 - protein, 179 aa, Artificial Sequence; identical to SEQ ID NO: 26517
  Synthetic sequence.

SEQ ID NO: 26519 - protein, 177 aa, Artificial Sequence
  Synthetic sequence.
SEEEELEKRLRDSEREIEKWLRDLERVIEEVAREDKKIHEELEKILEDVKRELDKLGIDDELRKELEKKLRKIKEELEKLNEDTRRELERVRRDLERLAEELKRRHDEIRKELERTGDSKVVEKLVEDLRRINEEAKRRLERLKEELRKVLKDYKDEIDKLVEELKRTLDEVRKKAK

SEQ ID NO: 26520 - protein, 177 aa, Artificial Sequence; identical to SEQ ID NO: 26519
  Synthetic sequence.

SEQ ID NO: 26521 - protein, 177 aa, Artificial Sequence
  Synthetic sequence.
DEEEDVRRTLEKVERDVERIDEDVERELRKVEEDDKRLHKELSEVVEKVERDIRRTGIEEELMDTARRRLEEARRELERLNKRTKELLDRIRKALEESHREVKELLERIEEELERTGDKKKLEELKERLKEALKRHEDKVRELKKELKKILDDYTEDVKRIKERLKRILEEIRRRKK

SEQ ID NO: 26522 - protein, 177 aa, Artificial Sequence; identical to SEQ ID NO: 26521
  Synthetic sequence.

SEQ ID NO: 26523 - protein, 177 aa, Artificial Sequence
  Synthetic sequence.
SSEEDVKRELERVRREDERIHRDLERVLEESERRVETWDRDAKRTLEKVEEDLRRDGLEKELVDKLKEALDRIREDIERSHRELRKLHEEIRDELRKLNEETDRRLRDIEDKLRKTGEEELLEELKRRLKEILDRYRREAERLKRENEEMNKRHRERLEELKKRLKELLERMKEARK

SEQ ID NO: 26524 - protein, 177 aa, Artificial Sequence; identical to SEQ ID NO: 26523
  Synthetic sequence.

SEQ ID NO: 26525 - protein, 177 aa, Artificial Sequence
  Synthetic sequence.
STEEDVRRVMKKVEDDVREINRDLERDLRRVEEAVERLDRDAKREIDRLREEIDREGIEERLKKEADEVLRRVEEEIKKSHEEVRRLLEEVERRLRESTKELEDRLRKVKEELDRTGDEKFAEDLKRKLKKVLDEHRRRIEELKRELEEVLERHARELKRLKDELKKLVDDIRRRRK

SEQ ID NO: 26526 - protein, 177 aa, Artificial Sequence; identical to SEQ ID NO: 26525
  Synthetic sequence.

SEQ ID NO: 26527 - protein, 177 aa, Artificial Sequence
  Synthetic sequence.
SDEEDVERELKRVKDEVDKINEDVRRELRKSEEDVERWDEDLERVVRRVEEEVRKTGIDEELKRKADERLEEAKKRVEDSHRRLREEHRRIEKDLRDSTREIEKLLRDIRKRLTDTGDKKVLEKLKKDLRDALKRHRDRVEKLKEENRKLNEDHKKTLEDIKEELKRLLDELKETRR

SEQ ID NO: 26528 - protein, 177 aa, Artificial Sequence; identical to SEQ ID NO: 26527
  Synthetic sequence.

SEQ ID NO: 26529 - protein, 177 aa, Artificial Sequence
  Synthetic sequence.
SDEEDVERELERVKRDVERLDEDAKRVLDEVRKAVEEINRDVERDLRRVEEEIKKTGIEERLMEEAKRRLERIKEELKKSTEELERLLEEVKRRIEESHRRMEEELRRIREELERTGSKEKLKELKERLKRLLDEHRRELKRLKDELKKALDDHKRKVDKLKKELKDILKKIRDDRR

SEQ ID NO: 26530 - protein, 177 aa, Artificial Sequence; identical to SEQ ID NO: 26529
  Synthetic sequence.

SEQ ID NO: 26531 - protein, 177 aa, Artificial Sequence
  Synthetic sequence.
DDEDDVRRVLRRVAEEVRKLDEDLKRVLKESKERVKRWNDDAKRRLDKVREDLKRKGLDESALRRAEDVLRRIKKRIDESTEDLDRLHKEIEKEVRDSHKKMREDLDKVREDLERTGDKKVLEELKKRLEDLLKRHEEEVRRLKEENKKLNDDHRRELERLKKELTDLLKRLDDERK

SEQ ID NO: 26532 - protein, 177 aa, Artificial Sequence; identical to SEQ ID NO: 26531
  Synthetic sequence.

SEQ ID NO: 26533 - protein, 177 aa, Artificial Sequence
  Synthetic sequence.
SLEEDVKRVIDRVREAVKKINDEVEKELRKSEKAVEDWNRRLEEIHDRARRELEKAGIDEELRKREKREHERSEEELRRSTEELKKKHDEIRKRLEDSTREAKKTLEEVERELRETGDKDKLEELKRRLKRLLDEHRKRVEELKEENKRLNKEHEKKVEDNVRRVRELLKRVEDRRR

SEQ ID NO: 26534 - protein, 177 aa, Artificial Sequence; identical to SEQ ID NO: 26533
  Synthetic sequence.

SEQ ID NO: 26535 - protein, 179 aa, Artificial Sequence
  Synthetic sequence.
SEVEEIVKKLEELLRRWEKTVRDIVEELKRLLEEIEKLSRETKERLKKILEDVKRLAEEGRLDDAEVDRLRKELEDLHRELEERLRELMREMEERLKEANERSKRIKEEIEKDLKELTDRRGRVDELEDIARRVKEELDRLNEELERIARKVKEDLKRLLEDNKRVLDEVKERLDRIRK

SEQ ID NO: 26536 - protein, 179 aa, Artificial Sequence; identical to SEQ ID NO: 26535
  Synthetic sequence.

SEQ ID NO: 26537 - protein, 179 aa, Artificial Sequence
  Synthetic sequence.
SEIEDIVRRLEELLERWKRRVDKAKERNKRLLEKWAKEVEDIKRELEKLLEDVRRLKEEGRSDKRDVDRLIERIEELLERLHRRSEEIKRDSRRHAKELHRISEEIKERIRRLLKKVTDDKGRVDELEKIVEDVERELDKINEDYNRVLKRVEEELDRLNEDLNRVAKRVKDALRKIEE

SEQ ID NO: 26538 - protein, 179 aa, Artificial Sequence; identical to SEQ ID NO: 26537
  Synthetic sequence.

SEQ ID NO: 26539 - protein, 179 aa, Artificial Sequence
  Synthetic sequence.
SEIEKVVEEAKKLLKRWEDEVRKHDKELKEVLDRWKKEVDDIKRRLEELLREVRRLKEEGRSDDRKLEELKREIDKLLEDLHRRSKRLVEDLKRTHDEVDDRSKKIKKEIRDRLKDIERRRGPVDELRKIVEDVERELDRLNDENRDSLRRVVEALEEINKDLNRDVKRVKDELDKTRK

SEQ ID NO: 26540 - protein, 179 aa, Artificial Sequence; identical to SEQ ID NO: 26539
  Synthetic sequence.

SEQ ID NO: 26541 - protein, 179 aa, Artificial Sequence
  Synthetic sequence.
SEVEEIKKELKKLDEENKRVIDRIVREIERLNEENERVARKVIKEIEELLRKLEKLRRDGRSDETVVRKIKKDLEELLKRLEEHIRESKDRLRDLLRRVREHLERSRRRMEELRDRVRRNGKEEEDLRRVLKESEDRNRKLLEDLERKVRDVKRRDDELLKRAREALKRVKDEIEKIRK

SEQ ID NO: 26542 - protein, 179 aa, Artificial Sequence; identical to SEQ ID NO: 26541
  Synthetic sequence.

SEQ ID NO: 26543 - protein, 179 aa, Artificial Sequence
  Synthetic sequence.
SEVEDIIRRIKELDDRNERKVRELVKTNEKLLRDLHEKSKRIVKEMRELLKEIEDLARRGKSDDRRLEEVRERLKRLLDDYERTVERLKETNERLNRELEKHLEDSKKRLEDLREEVRRRGKDEEELKRVIDESKKRNEKLMRDYEEISKKVHEDVERDAERLRRIAKEVEEELERVRK

SEQ ID NO: 26544 - protein, 179 aa, Artificial Sequence; identical to SEQ ID NO: 26543
  Synthetic sequence.

SEQ ID NO: 26545 - protein, 179 aa, Artificial Sequence
  Synthetic sequence.
SEVEKIKEDLKRLLDEVRKKAEELKRENRELLRRLHELSKKIIRELEKLLEELADLVRKGRSDDKVVKRIRDELEKLKREYERAVKELRDRNRELNEELKRVLERVKEDMDRLREEVRRRGKEDEDLERTIREVEKELRRLLEDYRRESKKVHEDIDEDRRRLEDAVREVEKEIEKVRR

SEQ ID NO: 26546 - protein, 179 aa, Artificial Sequence; identical to SEQ ID NO: 26545
  Synthetic sequence.

SEQ ID NO: 26547 - protein, 182 aa, Artificial Sequence
  Synthetic sequence.
SEVERIKEDIKKSNEDIRRTAEEIKERIKKSNKEVEDEVREIKERIKRILDKLKRVKEEGRLDDRLKKEAEKVLEDIKRKLEELEEKHRRDLKRIRDRLREVEKRHRDELRRLREELKRRGSDKSVVDDLERVMKESEERVKRIIDDLERTLRESEKNLKRIIDDLERVMREAREAIDRLKK

SEQ ID NO: 26548 - protein, 182 aa, Artificial Sequence; identical to SEQ ID NO: 26547
  Synthetic sequence.

SEQ ID NO: 26549 - protein, 178 aa, Artificial Sequence
  Synthetic sequence.
SEDDELRRRLEELKRRIEDLIRKLREVLKRSEDELRKILRELREVDKDLRRRIEELIKDIQDEEVIDRLKKLLKRHTDRSRELEKRLKEILDELRKRHEKVERDLRRILEELKKLSDDRELDEDEAKKRLEEILRRAEELLERLKRTNERVNRKVREDMKRAKEHAKRLLEEAEELAR

SEQ ID NO: 26550 - protein, 178 aa, Artificial Sequence; identical to SEQ ID NO: 26549
  Synthetic sequence.

SEQ ID NO: 26551 - protein, 180 aa, Artificial Sequence
  Synthetic sequence.
DEVEELIKEVEKVNEDAARESEKRNRELKKMLERVKRENKRLIRELKELLDDARRKNSKDSTLSETLKRVLKESKERVDRLVKRVDDLLRELERRDRELHKKLEERHRRIRDRLREEVREKREVLKKLEEVLRESKKRLKEWNDRNKKTLDDIRREIEKSKKEHEDALRRIEEELKKTET

SEQ ID NO: 26552 - protein, 180 aa, Artificial Sequence; identical to SEQ ID NO: 26551
  Synthetic sequence.

SEQ ID NO: 26553 - protein, 180 aa, Artificial Sequence
  Synthetic sequence.
SELEKLVKELRDLNEKVARDSKRLNDKLEEVLDRLRRRNEELIKRLEEVLEDVERKNSKDSTLEEELDRLLKKSREDLDRLVDEARKLLDEARKRDKKLHEDLKREHDRVAETVRRDISKDKELLDRLRKMLKESRDSLRKLNKENEETLRRIKKKLDESKRKHEEVLKDIKRRLEELSR

SEQ ID NO: 26554 - protein, 180 aa, Artificial Sequence; identical to SEQ ID NO: 26553
  Synthetic sequence.

SEQ ID NO: 26555 - protein, 180 aa, Artificial Sequence
  Synthetic sequence.
DEVERIIERLRRVNKRVREENERLIKEIEDLITEIAKRSRDLNRELDKTLKDVRRKNDKDERLKREVEELLKRLEEEDKKLHDDAERALKRSKEEMDKLMRELERLHKEVKDELDRDVREKEEVLRRLEKVLRESRKSLEDSAKKHKDVLDEVKKTLKKLNDENREVLKRIKKELDKTRT

SEQ ID NO: 26556 - protein, 180 aa, Artificial Sequence; identical to SEQ ID NO: 26555
  Synthetic sequence.

SEQ ID NO: 26557 - protein, 179 aa, Artificial Sequence
  Synthetic sequence.
SEVEKLIEDMKKVAKELADESEEHIKRAEEVIDRLAKEVEKHDRDVEDTIRRLEESDRDKREVEEVLKKIKRSSEELKEKLRRVLEKLRKTSKELEEKLREVLKRLEDRIRKLETEDRSSEEVKKRLREMLEELRRRLERLKDKNKEVLDRLEEKLRKLEKENDDSLKEAEDKLRERER

SEQ ID NO: 26558 - protein, 179 aa, Artificial Sequence; identical to SEQ ID NO: 26557
  Synthetic sequence.

SEQ ID NO: 26559 - protein, 179 aa, Artificial Sequence
  Synthetic sequence.
SEVEKLIEDIERIIRTLAEEVRRHDEDARRVLEDLARKVRKHNEDVKKVLEDLRESDRDRKFIKEVLERLRKTSEELKRELEEVLRRLRESSKELKRKLREVLKEIKRRAKKLEKDDTSSEEMKERLRRMLKRAEDELRRLEEENDRVVERLERELRRLTEDNKRTLKKIEEDLRRREK

SEQ ID NO: 26560 - protein, 179 aa, Artificial Sequence; identical to SEQ ID NO: 26559
  Synthetic sequence.

SEQ ID NO: 26561 - protein, 179 aa, Artificial Sequence
  Synthetic sequence.
DEVRDLIRRLEETVKRLADEVREHDKRARDILRELKKEVKETNRRSEKVADDLEKSDRDDKEVDEALDKLRKEYEDLKKRLDDVLEEIRKSSEELEKKLDKVLEEMARLVDKLRRDDTSSEEVKERLKKVLEKLKRDLEKLKEDNRRVLKELEEELRKIKEELDKSLDDLRKRLEDRKK

SEQ ID NO: 26562 - protein, 179 aa, Artificial Sequence; identical to SEQ ID NO: 26561
  Synthetic sequence.

SEQ ID NO: 26563 - protein, 180 aa, Artificial Sequence
  Synthetic sequence.
SLEEKFRRVLEESKESLERLKRKVEKVLRESEERLKRWLDKVKKVLEEVDDALRRLKDRLDEKLLKRLRDLAREILEEIKRLLDEAKKRHDEVRERVERLLKKVLDDHRRAEERVKREVRTKEIVERLIEELKKLNKELADRLEEIIRRLEEINERLRERIERIITRLRRLLEELEREAE

SEQ ID NO: 26564 - protein, 180 aa, Artificial Sequence; identical to SEQ ID NO: 26563
  Synthetic sequence.

SEQ ID NO: 26565 - protein, 184 aa, Artificial Sequence
  Synthetic sequence.
SEDEDLKRVLDEAEKRLKDLLDDLRRALKRSEDELRKNNEDLERVLKRVEERLKELLDRVDRDSLKELLDRVREALERLRREVEETTKRVSDEHRRLLEEAERTLEEIRRRLEDLERRVRKKSRRREIVEEIKKRIRDLLRELEKKIEELKTTSERLNREHHKKIEDIKKEIEDLVRELEKKVK

SEQ ID NO: 26566 - protein, 184 aa, Artificial Sequence; identical to SEQ ID NO: 26565
  Synthetic sequence.

SEQ ID NO: 26567 - protein, 184 aa, Artificial Sequence
  Synthetic sequence.
SLREKLEEVLRRIEEALERIREEVEKVLRDSRDDNRRVLKELKELLERVREALEDLLRKVDRDRVRETLKRVEDRLRELEEEVRRHHKRSEDRHRELEKDLERVLEEVKRRLRKLEKDVEEKSRTDKIVKEIIEELEKLLRDIKKRARELIEESKRINEDNNRRAEEVAEEIRRLLEELERKLR

SEQ ID NO: 26568 - protein, 184 aa, Artificial Sequence; identical to SEQ ID NO: 26567
  Synthetic sequence.

SEQ ID NO: 26569 - protein, 184 aa, Artificial Sequence
  Synthetic sequence.
SLEEDVKRVLREAEEELKKNNERLRKVIEDSKRDNDRVLDELRKVLEDIEKALRDLLREVDRDRLREDLERVRRRLEELSRRAKEHHKESRKEHEKLRDDARRVTEKVEERLRRIREDLERRSRTDKIVDEVRKEIEKLVRDHHKRIKDLKDDLKRLNDENNKRAKEIIDEMKRLLEEIEKRVR

SEQ ID NO: 26570 - protein, 184 aa, Artificial Sequence; identical to SEQ ID NO: 26569
  Synthetic sequence.

SEQ ID NO: 26571 - protein, 182 aa, Artificial Sequence
  Synthetic sequence.
KDVEDIKRRIEELNKKLKEKIERIKKRIKELNEEAAKKVEEIKERLKRLLDEIRELVRRDGPREDEIRRLREDLKRLLKEMEDTLKELEDRHERLREEVEKTLRELEKKHKELKEELDRQPVDDSLRKRLEEVLRESKKTAEDLKRDLRRALEESKKNLKRLLDEVRKVIDEIRKALEELER

SEQ ID NO: 26572 - protein, 182 aa, Artificial Sequence; identical to SEQ ID NO: 26571
  Synthetic sequence.

SEQ ID NO: 26573 - protein, 182 aa, Artificial Sequence
  Synthetic sequence.
SEVEKIKKDIKDLNDDARRRLEEIKRRLEKLLKELEEKHRELKKELKKLLDEVRDLVRREGPREEVLREVKKRLDDVRRENKKLTDEVREILKKLEEEMKRILEELERRHRELKKRLDEEPVDDRLREDAERVLRESKKNLDELEKDVRRVIKRIEDEARRLNEDLKRMLERIKRELEKLEK

SEQ ID NO: 26574 - protein, 182 aa, Artificial Sequence; identical to SEQ ID NO: 26573
  Synthetic sequence.

SEQ ID NO: 26575 - protein, 176 aa, Artificial Sequence
  Synthetic sequence.
SEEERLEEVLKRVETELRRLKRELEKVLRESEEALREIIKKIEDAVRDNAEKVKKLSRTVDEDLVRELEKLLRDLERKSREAIRRLEELYREVKERVERVTRELEERLKDLERRVKERPVDRRVEKELEDLLRTATKVLEDLKRDLKRLNEETEEVVKTLEDSHRRSNEEVERRVR

SEQ ID NO: 26576 - protein, 176 aa, Artificial Sequence; identical to SEQ ID NO: 26575
  Synthetic sequence.

SEQ ID NO: 26577 - protein, 176 aa, Artificial Sequence
  Synthetic sequence.
REREELEEVLERSKRELERLVEEIKRALDESRRRLEEIEKRIEEVIRRNKEEIKKLSRRVDEETVRELEKRLRDLERRSKKVLTDLKKKYEEVEREAREVIKELREKYKRLEEEARRRPVDEKLKEELKELNRESRKVVEDLREKLDRLNKDTERVVRELEKEHRKSNEEVRKTVK

SEQ ID NO: 26578 - protein, 176 aa, Artificial Sequence; identical to SEQ ID NO: 26577
  Synthetic sequence.

SEQ ID NO: 26579 - protein, 182 aa, Artificial Sequence
  Synthetic sequence.
DEEEELKEDIKRILEELRRLAKEHEELNRRINKELEDLVREHKKRLEDALKRLREIVRDRGNDEDVTRRMDEILDELRKHSEDLKRRMDKLLRENEEHSDRLRKRIKELTDRLRRRVEDLVRKRGRVEELEKVLKEAEDDVERIKKRLKRINDESRKHVERLKEELDRADKRIEDEVEKLKK

SEQ ID NO: 26580 - protein, 182 aa, Artificial Sequence; identical to SEQ ID NO: 26579
  Synthetic sequence.

SEQ ID NO: 26581 - protein, 182 aa, Artificial Sequence
  Synthetic sequence.
RIEERLKRVVDKVDDTLRKSEKHLEDVVRDADRDIDRNRRENEKVVKEAEDILRRLVEEAGRELDDLRRVKKEVDKLLKENEEKLKKVREDIERILRDLKRKHEAVRERLRKLLTDVAREKIPEDKVRELEEEAERLLDELRRKNEEAVRRIKKLLDDLNKHSEETIRRIKKLLKELEDKTR

SEQ ID NO: 26582 - protein, 182 aa, Artificial Sequence; identical to SEQ ID NO: 26581
  Synthetic sequence.

SEQ ID NO: 26583 - protein, 178 aa, Artificial Sequence
  Synthetic sequence.
STEEKLKELKKEADKLLKELDKELRDNLRRLRKIVEELKKENRDLTRESEEVLKRLNSDDETVERVLRELRERHRKLEEETEEVLRRLERKHDKLREDLKRIVDEIEKKIRDIRRKPVDDKDVKKLIEEIRRILEKAREEVERLSRDSKRVAEELRKRHKELIDRNKRVLEELKRRRD

SEQ ID NO: 26584 - protein, 178 aa, Artificial Sequence; identical to SEQ ID NO: 26583
  Synthetic sequence.

SEQ ID NO: 26585 - protein, 178 aa, Artificial Sequence
  Synthetic sequence.
SEVEEVARRSRKLNDDLKKIIEELIRRSRKINDELRREIERLIRESRKLNRELEELKRRGELTEEILKKAKEDHERLDRKVKELLKRALDTHRKLTDEARKKLEEVLKRHEDLARKLKDTIEEDKVRRLNEENKESLRRLERELEKLNKENEDSLRTLEELLRELNKENKRSLDELRK

SEQ ID NO: 26586 - protein, 178 aa, Artificial Sequence; identical to SEQ ID NO: 26585
  Synthetic sequence.

SEQ ID NO: 26587 - protein, 177 aa, Artificial Sequence
  Synthetic sequence.
SLVEEVEERVKKLHDENRELDRKSKRDVEEVHKKNEKLIKDVERTVREMIRKLRELKGTSEETVRRIEEEVRKVRTELEKEMRELSKENEDVARRLREEYKRAEEKNKRAVEEIRKRLLDVEEELRRLEEELRRSIKESREELRRLEDELRRSIEKLEDALRRLAKELDEVIKDLKD

SEQ ID NO: 26588 - protein, 177 aa, Artificial Sequence; identical to SEQ ID NO: 26587
  Synthetic sequence.

SEQ ID NO: 26589 - protein, 177 aa, Artificial Sequence
  Synthetic sequence.
SLVDEVRRRVDELHKDNKRLDDESEKKVRDAHRENERLDDESRRKVKEAIRKLEELKGTSEETVKEIIKEVEKVVDELRKEYDDLERRNKEVADRLREEYERARKKNEDVLREIRDKLLDVKESLDRLAEKLKKSIKESEDILRELEKRLRDSIRESRKILEDLRRELEEVIKRLED

SEQ ID NO: 26590 - protein, 177 aa, Artificial Sequence; identical to SEQ ID NO: 26589
  Synthetic sequence.

SEQ ID NO: 26591 - protein, 177 aa, Artificial Sequence
  Synthetic sequence.
SLAEEVEKRVRDLHRKNEELDRESEKKVRDMDRKNKELIKRAEEEVKKVIDKLRKLKGTSEETVRRISEEVKKIVEDLERELRKLEEENRRVVEELRDKYRKLEKENRDMLEDIKRRLLDVEEKLRELARRLKESIRESRERLRRLEKELEDSIRELRRAIDTLTKRLEKAIEELER

SEQ ID NO: 26592 - protein, 177 aa, Artificial Sequence; identical to SEQ ID NO: 26591
  Synthetic sequence.

SEQ ID NO: 26593 - protein, 177 aa, Artificial Sequence
  Synthetic sequence.
SLVEEVERRVRKLHEENKKLDKESEDKVREANRRNEELIKKVTESVRRMIEKLRRLKGTSEETVRRIKREVEEVVKKLRKEMKDLEEENKRVVEELRKRYKDAKKRNRDALEDIKRRLLDVEEELRRLADELRRSIEESERILKKLEEELRRSIEELRRALEELDEELKRVIRELER

SEQ ID NO: 26594 - protein, 177 aa, Artificial Sequence; identical to SEQ ID NO: 26593
  Synthetic sequence.

SEQ ID NO: 26595 - protein, 177 aa, Artificial Sequence
  Synthetic sequence.
SLVEEVKKRVDDLHKRNRELDDRSEKMVRKANEENKELDKKSKEDVDRLIERAERLKGTSEETVKEITRDVERVAKRLEDEYRELEKRNREVVRELRKRYDDLEKENRDMLKDIRDRLLDVEEELRRLAEKLKRSIEESREILKELERRLRESIRRSREILKRLKEELERAIERLRR

SEQ ID NO: 26596 - protein, 177 aa, Artificial Sequence; identical to SEQ ID NO: 26595
  Synthetic sequence.

SEQ ID NO: 26597 - protein, 177 aa, Artificial Sequence
  Synthetic sequence.
SLAEEVEKLVRDLHRKNKELDRRSKKTVEDIEREARELDKRSKEEVERMIKKLRELKGTSKETVDDIEREVREVVEKLRKEYEDLSKKIRDVADKLRDDYRKLEEENRKALEDIRRELLDVEDKLRELEKELRDSIRESREILERLERRLEELIRRSKRILEELERELEEVIRELRR

SEQ ID NO: 26598 - protein, 177 aa, Artificial Sequence; identical to SEQ ID NO: 26597
  Synthetic sequence.

SEQ ID NO: 26599 - protein, 177 aa, Artificial Sequence
  Synthetic sequence.
SLDDDVEKKVRELDKRNEDLDRKSEKEVEKVHRKNKRLDDESEKEVKRMIEELKKLKGTSEDTVRKIKEEVEEVVRKLRKEYKELEEENEEVVKKLRKEYREAEEENRRMLEEIEKRLLDVEEELRRLAEELRESIERSRERLKELERRLRESIARSREILEELERRLKRAIEDLER

SEQ ID NO: 26600 - protein, 177 aa, Artificial Sequence; identical to SEQ ID NO: 26599
  Synthetic sequence.

SEQ ID NO: 26601 - protein, 177 aa, Artificial Sequence
  Synthetic sequence.
SLAEDVEEKVKELNRRNKKLDDESKEMVKRAHDRNRELDERSKDRVRRVIEKLRRLKGTSEETVERIDREVKKIVRELKEEYERAKEENKRVVDDLRRRYERLEDENREMLDDIRRRLLDVKEKLEELAERLRKSIEESRDILRRLEKELRDSIKRSEEILKELTDRLRKVIKDLRD

SEQ ID NO: 26602 - protein, 177 aa, Artificial Sequence; identical to SEQ ID NO: 26601
  Synthetic sequence.

SEQ ID NO: 26603 - protein, 177 aa, Artificial Sequence
  Synthetic sequence.
SLVEEAERRVRELIKELERLDDRSREMVKEMHERNRELIERVEKRVREVIEELRRLKGTSEETVKRISEKVKEILDRLRKLVEDLRRENERVVEELRRRYKEAEDRVKRLLDEIRKRLVRSEDDLRKLAEDLKRVLKRSRDILRKLEEDLRRSIRELEEALRKLEEDLRRAIEELET

SEQ ID NO: 26604 - protein, 177 aa, Artificial Sequence; identical to SEQ ID NO: 26603
  Synthetic sequence.

SEQ ID NO: 26605 - protein, 177 aa, Artificial Sequence
  Synthetic sequence.
SLKDDVEKKVEDLKKEAKDLDRESDKKVKTAHKRNEELDRKSADDVRKLIRKLEKLKGTSEETVKRIEEEVKEVVRRLREEYKRMEDENREVVRRLEKEYRDLERKIRELLERIKDKLLDVEEELKRLAEELERLIRDSRRILEELKRELKRSIEESRKILEDLERELEKVIRELKR

SEQ ID NO: 26606 - protein, 177 aa, Artificial Sequence; identical to SEQ ID NO: 26605
  Synthetic sequence.

SEQ ID NO: 26607 - protein, 177 aa, Artificial Sequence
  Synthetic sequence.
SLAEEVERDVKRLDEENKRLDDRSRREVEKMDEENKKLIEDARREVREMIEKLKKLKGTSEETVERIKREVEKVLRELEERVRRLAEKNKEVVERLKKEYEEAAKKNKEVLDDIRRRLLDVDEKLKELAKRLRDSLERSKEELKKLEEELRKSIKELEDALKKLEEDLRDVIRKLEE

SEQ ID NO: 26608 - protein, 177 aa, Artificial Sequence; identical to SEQ ID NO: 26607
  Synthetic sequence.

SEQ ID NO: 26609 - protein, 177 aa, Artificial Sequence
  Synthetic sequence.
SLVEDVERKVRELDKRNRDLDRKSKRKVEEADKENRKLDEDSERKVRELERKATELKGTSEEAVKRIEDEVREVVRRLRELYKTAEEKNKEVVKTLEKLYRDMERRNKEVLDEIKKRLLDSEESLRRLEEELRKSIKESKEILDELRKELEKSIRESKERLKELEKRLEELIRELKR

SEQ ID NO: 26610 - protein, 177 aa, Artificial Sequence; identical to SEQ ID NO: 26609
  Synthetic sequence.

SEQ ID NO: 26611 - protein, 177 aa, Artificial Sequence
  Synthetic sequence.
KLVEDAEELVRRLDEENKRLDDDSKRRVEEANRENEKLIKEIEDEVRKMIKKLRDLKGTSEETVKRIEKEVRDVVRDLKRLVDELKRRNEKVVKDLRRKYEEAKRKNEEVLEDIKRRLVRSEEELRKLAKRLKDSIDRSRKILEELERELRRSIDELRRALEELTDELRKVIEELRK

SEQ ID NO: 26612 - protein, 177 aa, Artificial Sequence; identical to SEQ ID NO: 26611
  Synthetic sequence.

SEQ ID NO: 26613 - protein, 177 aa, Artificial Sequence
  Synthetic sequence.
SLAEEVEKEVKKLDEENRKLDRDSTETVKELNKKNERLDRESKRKVDEVIEKLERLKGTDREIVERIAEEVKEIVKELEEEYRRAKRENEEVVKKLRDEYRRLEERNKKALKDIRDKLLDVKEKLDELADELKKSLDRSRRILERLEEELRRSIRRSEDILRRLKEELERVIRELRR

SEQ ID NO: 26614 - protein, 177 aa, Artificial Sequence; identical to SEQ ID NO: 26613
  Synthetic sequence.

SEQ ID NO: 26615 - protein, 178 aa, Artificial Sequence
  Synthetic sequence.
SVDEEVEKLLKEHEERIRELIKEVEKLNREHAKRIEELIRKLKETNKRIADKIRDLKRQGRDAKEEVEKELRRLEEEHERVRREVKRSTEELEKRHEDLERRVRKSSEDLKDRLRRLRDGLDEEKLRTIARRIKELNDRFKRAIDESRKHIEELNRRLEKVVEDSRRHLEELADEVRR

SEQ ID NO: 26616 - protein, 178 aa, Artificial Sequence; identical to SEQ ID NO: 26615
  Synthetic sequence.

SEQ ID NO: 26617 - protein, 178 aa, Artificial Sequence
  Synthetic sequence.
SVLEELKRLLDEHRERLERLIRELRKLNEDHDRRIKELIERLKKLNEDIAKRIEDLKRDGRKVDEEVEEILKRAREEHRRLEEEVRESTERLKRKHDRVKEEVEDSSRELKERLDRLRDGADEDVLRKIEEDIKRLNREVEKAIRESEENIKRTNKRFKDELRKSEKHLEELVKRFRD

SEQ ID NO: 26618 - protein, 178 aa, Artificial Sequence; identical to SEQ ID NO: 26617
  Synthetic sequence.

SEQ ID NO: 26619 - protein, 178 aa, Artificial Sequence
  Synthetic sequence.
SVLEEVTKLLKDHEDRIREIIKRLRKLNRDIDERIKRLIDEVRKKNDDIRRKIEELKRRGRDRREEVRKDKKDLKKDHDDVRREIDDTLRRAREEHDRVREEIRESSRRIEERLKELKDGLDEERLKRLREELEKLNRDVERVIKESKENLDRTVTEAKRELKRSEDNLERLAREFER

SEQ ID NO: 26620 - protein, 178 aa, Artificial Sequence; identical to SEQ ID NO: 26619
  Synthetic sequence.

SEQ ID NO: 26621 - protein, 175 aa, Artificial Sequence
  Synthetic sequence.
TEEEILRRVERDLERLNRELERIVREVEKELKKINDDYERVLKKVKDDIDRIREELDRQGVRTEEADERVKELIKKSRDHARRLNEESKKIIDDIRKLLREVHEKSEEIIKEMRRAKLSDKELEELLKRWEEDVKRIVEEVKKLLDEWRERVKRAKDENEKLLRDLEKLVEDLAR

SEQ ID NO: 26622 - protein, 175 aa, Artificial Sequence; identical to SEQ ID NO: 26621
  Synthetic sequence.

SEQ ID NO: 26623 - protein, 175 aa, Artificial Sequence
  Synthetic sequence.
SKEDVLREVKRELKRLLDDNRRMLEEVEEAARRLNKDYNDVLKEVEEEIEKIIRELEKKGKKDERVDRRIEELKRDSRRHAEKLHDDSRKLREKLKEIHDKLKRDLDELRKRMDDADLSEEDLKRLLDEVRRLSEKTKEDLERILRKWKEDVERAKERNRRELERLEREIKELAR

SEQ ID NO: 26624 - protein, 175 aa, Artificial Sequence; identical to SEQ ID NO: 26623
  Synthetic sequence.

SEQ ID NO: 26625 - protein, 178 aa, Artificial Sequence
  Synthetic sequence.
ELDKIVEEVRKALREILEDYKRFSKEIHDRDKELADRLREILKDVKRAVDELIKKLSRTKELEETARRLEKRIEELRKEVEDHLKKSEDRNRELKEELRDTLRRVEETIEEIRRRGEPVEDVVRKLRELLERFRKKAEDLKEENKRINEENERKIREIVKTLRKLLDELREKLERTKK

SEQ ID NO: 26626 - protein, 178 aa, Artificial Sequence; identical to SEQ ID NO: 26625
  Synthetic sequence.

SEQ ID NO: 26627 - protein, 178 aa, Artificial Sequence
  Synthetic sequence.
SLEDTLRKVDKDLKDNMRRLEETAEKVRRDIDRDEERLRRISEELHRRIEELIKRLSRDERVKRKVEELKKRNEDNEREYKDTVRRIKEEIKRLEDEYKKHLEDVARRLEEIRRRGEPVEDVVRDAKRLLDEHHDLARKIVEDLRRLLEDLHRKSKKSVEDNERLLKRMEEILRETER

SEQ ID NO: 26628 - protein, 178 aa, Artificial Sequence; identical to SEQ ID NO: 26627
  Synthetic sequence.

SEQ ID NO: 26629 - protein, 171 aa, Artificial Sequence
  Synthetic sequence.
SELEEVARRVEKLLEKHKEDLKRLLEKSEEDLRRAEEEVKRLLEEIREELDRLRKRNVDRETVKEMEKKLEEKIKRLEDMLRRLEERDEELNRRSEEHNKELRKEIEDLLRKLPEDEEIKKVRKKVEDVHEESKRLNEENRRRTKEVSDKIREIIKEIRKEIKKASDELEK

SEQ ID NO: 26630 - protein, 171 aa, Artificial Sequence; identical to SEQ ID NO: 26629
  Synthetic sequence.

SEQ ID NO: 26631 - protein, 171 aa, Artificial Sequence
  Synthetic sequence.
DELERAVEEVEKRLREHLERIKRLLEESRELLKRHEKLLEDVLRRIRELLKRAEDRRIDEETVRRLRKEIEDLERELEKHNRELRKRDEDLNRESEEHNDKLRREIEELERRLRDDELIKRVKERVKEAHKRSRELNERNRRETEKMHKKSRDLLRKIREEVDRMSDKLRK

SEQ ID NO: 26632 - protein, 171 aa, Artificial Sequence; identical to SEQ ID NO: 26631
  Synthetic sequence.

SEQ ID NO: 26633 - protein, 170 aa, Artificial Sequence
  Synthetic sequence.
SEEELLRELEKKLRELRRKVDETLRDLRRRLKELEEDHRRTLEESERHLREVEKKLSRTRELERLAEELERRHRKASEEVKKRLTDLKRDLDRLKKDIDERLERLRDELRKRRVDEKLDRRVEELIKEIEELLREVEKLVEDLIRTIKKLNDDLREDNKRLAKEMEDRAR

SEQ ID NO: 26634 - protein, 170 aa, Artificial Sequence; identical to SEQ ID NO: 26633
  Synthetic sequence.

SEQ ID NO: 26635 - protein, 181 aa, Artificial Sequence
  Synthetic sequence.
SAVEDLEREVRKLIRDLEDLIRRLEERNKRIAEEIEKLNEELNRENKRIADEIRRIKDERGTDEEVAERIKRLLDDAARAHRELDREVERLLKEAEDEHKKLADEIRKLLARVDKALKDLRKDVSEEALERLKRELRKLAEELKKVLKRSRDHLKEVKRRHDENIKRSDDHLKRVADEARK

SEQ ID NO: 26636 - protein, 181 aa, Artificial Sequence; identical to SEQ ID NO: 26635
  Synthetic sequence.

SEQ ID NO: 26637 - protein, 181 aa, Artificial Sequence
  Synthetic sequence.
SVAEELEKDIRRIEEEIKELLERHRELNERIVREIEDLNRKLNEMNKRVVEELRKVKRDRGTDEEVEKRIRDILDKLRRLHRKVDREVEELLRALEEHAKELERRIRELLKRAREKLEELRKDVDDRVLKKLEKRLRELEEEAKKLLKESKEHVDEVRKRHEENIRRSEEHLRRVLEELRR

SEQ ID NO: 26638 - protein, 181 aa, Artificial Sequence; identical to SEQ ID NO: 26637
  Synthetic sequence.

SEQ ID NO: 26639 - protein, 181 aa, Artificial Sequence
  Synthetic sequence.
SVVEELERRIEEIAREIEELNERHNRKNKEIADRIRDLNRRLNEANKKIVREIEEIKRRDGDDEDVRREIRELLERLKELHRRVDRKVKELLDELEKHLREVDRRVEELLRRARKTLEDVRKDVDSRVLDKLRKELDDLRRRHEENVDRSRKHLEEVRKEHEENIKRSERHLEEVKKEAER

SEQ ID NO: 26640 - protein, 181 aa, Artificial Sequence; identical to SEQ ID NO: 26639
  Synthetic sequence.

SEQ ID NO: 26641 - protein, 181 aa, Artificial Sequence
  Synthetic sequence.
SVVETLEKRVRELIETLERLIERLDRENKRVAEEIKRLLDEHDKTNKEIVERIRDIKRREGTDERVRTEIEELLRRLEAHVRELKKTIEDLLRKLKEMHDRLREEIRRLLEEARKELEDLRKDIDSRVLRKLEEELRKLEEKLRKLLKDSEDHLREVLERAKRVLDDSRRHVDEVRREAEE

SEQ ID NO: 26642 - protein, 181 aa, Artificial Sequence; identical to SEQ ID NO: 26641
  Synthetic sequence.

SEQ ID NO: 26643 - protein, 181 aa, Artificial Sequence
  Synthetic sequence.
SVMEDLERRIREIIKEIEKLLEDLKRENRRVAEEIERLNREHNELNKRIAEEIERIKRRRGRDEDVSERIRELLEALKEHLRRLDEEVRRILKRLEDLHRELEKRIRELLKRAEDELEALRKDVDSRVLKKIEDELKKLEDKAREVLKRSRDHLKKVEDDHRENVRRSEEHVKDVLRRFEE

SEQ ID NO: 26644 - protein, 181 aa, Artificial Sequence; identical to SEQ ID NO: 26643
  Synthetic sequence.

SEQ ID NO: 26645 - protein, 181 aa, Artificial Sequence
  Synthetic sequence.
KVLEDLDRDIKRIIDEIRRLNEELNREIEEIKRRIKRLNEEHNERNKRLAEEARRIKDERGTDEEVLKRIKKLLRELEEHLEKLDEDVKKLLREAEESIRELDERVEKLLREIRKLLEDLRKDVEDEVLKRLEEKLERLREEHERNAREIRKELEKLEKEHRENVERSRRHVERVEREFET

SEQ ID NO: 26646 - protein, 181 aa, Artificial Sequence; identical to SEQ ID NO: 26645
  Synthetic sequence.

SEQ ID NO: 26647 - protein, 181 aa, Artificial Sequence
  Synthetic sequence.
SVVERLKEIAEEIIRRIEELNKEHNKRNREIAETIERLNREHNELNKTLVREMKEIKRDKGKDEEVTKTIEKLREELERHLDKLDKDVKKLLDDLRRHNRELDREVRRLLEELRKLAEELRKDIESEVLKKIEEDLRRLLRKHEENSKESEKHVEEVEERHRRNAEDSKRHVEKVKEEVDR

SEQ ID NO: 26648 - protein, 181 aa, Artificial Sequence; identical to SEQ ID NO: 26647
  Synthetic sequence.

SEQ ID NO: 26649 - protein, 185 aa, Artificial Sequence
  Synthetic sequence.
STEEVLKEIRDRLEELKREAKKVNDDTRERLKELEERNRRANEESKRRLEELERRVEERGTSEDMRRELERLRREADKTNEDDKRRTEELSKEVEDTNKRHEEELERLLTEVEKSLRRMEEENSEDERLLRELRRKLKEVEDTIRELNERLRKRIREIEEEVRESNERLRKKLREILEEIKETEK

SEQ ID NO: 26650 - protein, 185 aa, Artificial Sequence; identical to SEQ ID NO: 26649
  Synthetic sequence.

SEQ ID NO: 26651 - protein, 178 aa, Artificial Sequence
  Synthetic sequence.
SVVEEIDKIIKRIADRVRKIIEDLERLNKEIADLLRRIIEELKRLNDRIREEVDRLRRRGRDEEKKLADLIRTIAEVHKRAKEDIDRIAEKLRRAHTEVEKEVRKLEKELRDILRKVRDDVDEKVLEDVERKLERLKREVRRVLEESRKRLKEWKDRAREVLEESKRSLEEISRRLRE

SEQ ID NO: 26652 - protein, 178 aa, Artificial Sequence; identical to SEQ ID NO: 26651
  Synthetic sequence.

SEQ ID NO: 26653 - protein, 178 aa, Artificial Sequence
  Synthetic sequence.
SADETLRKVVEEVARKSEKLNKELEKVNKDLARAVEELIEELKDVITKIEERAKRLKDRGEPLEEEVRKLKEEVRKILKELEDRLRELEKRARDIHREVKKTDEDLRRRLEELLRRVKDRVDERVLEEIRERIERLNKRNKEVLDRSEESLRRLAEKLRRVIERVEEKLRKIEEDLKT

SEQ ID NO: 26654 - protein, 178 aa, Artificial Sequence; identical to SEQ ID NO: 26653
  Synthetic sequence.

SEQ ID NO: 26655 - protein, 175 aa, Artificial Sequence
  Synthetic sequence.
DKEDAIRTAEKRIRDSERENEKVDEDYRRELKRSEDKNEKADKEYKRRIEELVRRLLETRGREDEELRKLTEDSKRLSEENKKIVEDLKRDSEELLKRNEKLLRELKEEVREVKKEGRDEDTLRKLVDDIEERNRRIIEELKRHLDKLREDNERVIEELKRHLEEVAREVERRRK

SEQ ID NO: 26656 - protein, 175 aa, Artificial Sequence; identical to SEQ ID NO: 26655
  Synthetic sequence.

SEQ ID NO: 26657 - protein, 172 aa, Artificial Sequence
  Synthetic sequence.
SEKEEAEKLLREHHEKIKRLKEESKRINDENRKRIEELKRRSREINKELEEKVRRNDKDRKVIEKTLEEIERKHDELLKDAEDHHRRSEERHRELEDRVRKETRKVEDKLRKDGLREDTVKRIEDELKKNLDDLRRVLEKSKDDNRKLLEDLERELRESKKDARRLLEEVRK

SEQ ID NO: 26658 - protein, 172 aa, Artificial Sequence; identical to SEQ ID NO: 26657
  Synthetic sequence.

SEQ ID NO: 26659 - protein, 172 aa, Artificial Sequence
  Synthetic sequence.
SKEEELEKLLREHHEKIKRLKEESKRINDRIRRTVEELIKESEKINRDINDTVRKNDRDEKVIRRLLEDVRRKHEELRERLKRELDKVRERHKELLDRARRATERVKERLDRAGLREDSVERIKRELERNLDDLRRVLKESEDDLREILRRLKEVLEESERDLERVEREVRK

SEQ ID NO: 26660 - protein, 172 aa, Artificial Sequence; identical to SEQ ID NO: 26659
  Synthetic sequence.

SEQ ID NO: 26661 - protein, 176 aa, Artificial Sequence
  Synthetic sequence.
SELEELLERLERLIEENRRELEELIRELKEESDRTREELKRLIDRLKEKIDRVLKLKEDGRSREEEVRKIEEDIKKEIREMEERHEETKKRIEEKKKEADERHEELRERIKKEERDIPVDKDVLKEARERLRKLHEETKEAKKDLDRILDENEKEVKEVKKRLEDLLKELRDRLRK

SEQ ID NO: 26662 - protein, 176 aa, Artificial Sequence; identical to SEQ ID NO: 26661
  Synthetic sequence.

SEQ ID NO: 26663 - protein, 171 aa, Artificial Sequence
  Synthetic sequence.
SELEEVLKRIREEAERLMRRNEETLRRVKKTIEDLLRRNEKRLEDVKREADEIEKRKLDEDEVRKEDKRIEEEIKKLSDDSRDMERRIEEEIRRLEEDHKKKRRDTRERLKKAKLSERVKEEIERIEKRVREVHEEVNKRIEDLRREYRKEHKRVEDEIRRILREVREKRR

SEQ ID NO: 26664 - protein, 171 aa, Artificial Sequence; identical to SEQ ID NO: 26663
  Synthetic sequence.

SEQ ID NO: 26665 - protein, 179 aa, Artificial Sequence
  Synthetic sequence.
SEKEEVKKESEKLSRDTKKRSDEVHKEIKRLTDETERELREVEKEIERLAEELRRQNSVDERLAEELEREREKLREDLRRLKERYDRKLEELKERNKKEKKEYEDRVERTRDERDRNDTSEKVLEDELRENKKENKDLKERHDRTLEEVERTNRKVKEELRRVLRRVEESVREVAERAT

SEQ ID NO: 26666 - protein, 179 aa, Artificial Sequence; identical to SEQ ID NO: 26665
  Synthetic sequence.

SEQ ID NO: 26667 - protein, 186 aa, Artificial Sequence
  Synthetic sequence.
SKEETIEKRVEELKRENDEKVERIKREIEDLIRRNKELLERIKKEVRELLKELKDRAEKKGTSEDERRKLEDMERRIREKERKSEEDHRREEERLREETKRSEDRTRDLKRKIEEDERRLKKKDGKDRELDKALEDIERRIREHNKELDDELRKVREDSRRHLEKLKRELEEIREEARRITEELKK

SEQ ID NO: 26668 - protein, 186 aa, Artificial Sequence; identical to SEQ ID NO: 26667
  Synthetic sequence.

SEQ ID NO: 26669 - protein, 182 aa, Artificial Sequence
  Synthetic sequence.
EEKELLDKLKEDADRIKKELEDTLRELKKKHDDVNDRNRKHHEEVRRRAEKIKDKLRRDKVDEDEKRRIEEELRRLDEKSKKDEDRLKDEHEEITRELEKKKRDTRERIKKIRKDTEDKLRTKGTTGEEVRKRLDDLEREIKKIIDEIDERHRRLTEENKRSLDRDREELEKLKEEIKRTAD

SEQ ID NO: 26670 - protein, 182 aa, Artificial Sequence; identical to SEQ ID NO: 26669
  Synthetic sequence.

SEQ ID NO: 26671 - protein, 175 aa, Artificial Sequence
  Synthetic sequence.
DEAEKIKEDAKRLIEENDEIVRRIEEEMKKSHKENREILKKIKEDVDRSHEDLRRRSGDTDELREDKKKNEEDARRTEEDTRRAEKENKEETDKMRRDTEEDRKELKRKLDEVRKKGFREEVLKDLRRRSEEHKKKLEDDLRRHEKKSRDHKEKLKELLERHKRRVEEVRKRETK

SEQ ID NO: 26672 - protein, 175 aa, Artificial Sequence; identical to SEQ ID NO: 26671
  Synthetic sequence.

SEQ ID NO: 26673 - protein, 182 aa, Artificial Sequence
  Synthetic sequence.
SREELMEELERLLERLIREIEKASRENEERVKELKREIEESTKRNKETAKKLLDELTRSNSDEKVKRDLDRRLKELKDRNRKEEEDTKRRLEKLEKDNRDRERETDEREKEITRKVEEDVRREKKPKDELRKTLEDIRRRVEEAKERHRRILKTIKERSEKLTREHRKVNEDIEEKLRRAKK

SEQ ID NO: 26674 - protein, 182 aa, Artificial Sequence; identical to SEQ ID NO: 26673
  Synthetic sequence.

SEQ ID NO: 26675 - protein, 176 aa, Artificial Sequence
  Synthetic sequence.
SERETVERVLDRLREELEKIKKELEDVNRESKKEVERLLRRNEELHKKVEKDARDILRKKGETREDVRRELEKERRRSEDESRRLKEEDEREKKKSEERMRELDKDVKRKEDELRKKDLVGEELKKTLDKILEDAKEEVREDRKRNEKLNRELEERSRRNEEDLRRLLKKLKDEAD

SEQ ID NO: 26676 - protein, 176 aa, Artificial Sequence; identical to SEQ ID NO: 26675
  Synthetic sequence.

SEQ ID NO: 26677 - protein, 173 aa, Artificial Sequence
  Synthetic sequence.
DEKETIEERRKEIEKIIKDLEKNVRDHEKRIEEIIKEIRDNTEKLKKEAEDLLRRIRKEGNRDELRRRKEKRDRDSRRRMEEIKKRTDELAREHEETKRKIKEEEDERKERTKGKPTSRELEETLRRLDERTKKVIKEAEDVHRRLRERLRKIEKEHEDTLRELKKRLDDEAR

SEQ ID NO: 26678 - protein, 173 aa, Artificial Sequence; identical to SEQ ID NO: 26677
  Synthetic sequence.

SEQ ID NO: 26679 - protein, 186 aa, Artificial Sequence
  Synthetic sequence.
SAEDRLREADERYERELRRLKRELEEVIKEYRKAIEELKKELEDVLRRFREELKRLEEEKGTTSKEMDELKKRVEEEERKKKEEIDRNREENERRLKKVEDDTTRKEEDNRRRRKKVRDDITRRKGSGEEVREIIERLKESLKRNEEDVRRLIRRLKEELKRNKEEVERLKKELEDILRELADRAR

SEQ ID NO: 26680 - protein, 186 aa, Artificial Sequence; identical to SEQ ID NO: 26679
  Synthetic sequence.

SEQ ID NO: 26681 - protein, 186 aa, Artificial Sequence
  Synthetic sequence.
DAERELKKVEDEYEKRIRDLERDLRRVLEEYERAIEELKKELDDVLREAEKALEDLLRKKGENSEEVKEEEDRVRRKLERVREETKKNKRENDERLKRTREEMDENRKRNEKKRREVRDKIEKDKGSGEEVKEIKKELEESLKRNEDKVRELKRRLEELLKENEKKVRELIRRLEEELRRLAERTR

SEQ ID NO: 26682 - protein, 186 aa, Artificial Sequence; identical to SEQ ID NO: 26681
  Synthetic sequence.

SEQ ID NO: 26683 - protein, 186 aa, Artificial Sequence
  Synthetic sequence.
SAEEELKKVDDDYEREIRRLEKELEDVLRDVDRDHRRLEEELKKVIRDIEEALKDLLRKKGEETEELKKMAEDVRRRLEEVRRRIEKDKEDNKRKKEEIEKEIRDNREKNKRDRDRTRDKIRKDKGRGEEVREIKERLRKSLEDNERKVKEIIDRIREDLKENRDRVRKLIKDLDDELKELAKKAK

SEQ ID NO: 26684 - protein, 186 aa, Artificial Sequence; identical to SEQ ID NO: 26683
  Synthetic sequence.

SEQ ID NO: 26685 - protein, 179 aa, Artificial Sequence
  Synthetic sequence.
DEEREIEERIKRILEDLKRNLEDNERKIRKIVKDNRENNKRNEDKIRRILEELKRAKEEGNLTDDKLRRTEEETKRNSERNEEESRRTEDRERRNTERNEKKERDTREETKKDRERLRERGVETERVRKLEKDLEKALEEIRRRYEELLKRLKRENEESKKTYDKLIEELRRAAREIKR

SEQ ID NO: 26686 - protein, 179 aa, Artificial Sequence; identical to SEQ ID NO: 26685
  Synthetic sequence.

SEQ ID NO: 26687 - protein, 179 aa, Artificial Sequence
  Synthetic sequence.
DEKERIEEEIRRILRELEELTERNEKKIRDIVREIRKNSEENRRKIEKILEELEELKKEGSNTEETAKRKREEVDRNRRRNEEKARRIEEELRRNKEENDKRLEDTERELEKRRRDVRRRGVEDEEVEELLRRLRKRLEDLERRNKELLEELKERLERAEKRNRDLLKELEDALERIRK

SEQ ID NO: 26688 - protein, 179 aa, Artificial Sequence; identical to SEQ ID NO: 26687
  Synthetic sequence.

SEQ ID NO: 26689 - protein, 179 aa, Artificial Sequence
  Synthetic sequence.
DEEEEIEKKLRKNIRDAEEKTKRNKERAEDNLRKARENSKRNEEDIRRKLKRLKELKEEGNQRDEDDRRTREDSKRNEDDNDRKRRESEKDHKRNREKNKEDKERSRKRHEEETEDLKKKGLRTERVDRLKKELERMHRKLDKENRDIEKRVREEHRRLTERNRKLLEDLEEALERIRT

SEQ ID NO: 26690 - protein, 179 aa, Artificial Sequence; identical to SEQ ID NO: 26689
  Synthetic sequence.

SEQ ID NO: 26691 - protein, 179 aa, Artificial Sequence
  Synthetic sequence.
SEEEEIERRLRDNIRKAEENTRRNKEKIDRILEEMRENSKENKRRIEEILDELRKLKEEGNLTEEEAKRVREELERNKRRNDEKLERKRKDIDDNERRNREKEEKSRRDHEEETKELEKRGVRTERVDELKEKVERDHERLRKENEDLLRELRKRLDELRRENEKLLRELEEALDRIRK

SEQ ID NO: 26692 - protein, 179 aa, Artificial Sequence; identical to SEQ ID NO: 26691
  Synthetic sequence.

SEQ ID NO: 26693 - protein, 184 aa, Artificial Sequence
  Synthetic sequence.
SELERVREEIRRLERENEETLREVEEKIRKLLEENREALERVEERVRRVKEELKEVRRRQLDREELKKVEDELRRREEKIRREEDERRRRSEEDRKEEEKRTRRRSEDSERKREKTRRDISRVKDDDVRRDIERLDEEYERRHKDVNRKLKRLDDEYEKATRDVRRRLEELTKELRDEAEKVRK

SEQ ID NO: 26694 - protein, 184 aa, Artificial Sequence; identical to SEQ ID NO: 26693
  Synthetic sequence.

SEQ ID NO: 26695 - protein, 175 aa, Artificial Sequence
  Synthetic sequence.
SERERVDRLEERYEEESRRVEEELRRLLKRYEDFHRELRKRLEDIVREVRKTLKELEDRIDEEVVRTTEKRLEDLRRDLERRSRETEKRLKEIEDRLREEKEKSERDRERTKKLEDEIDTREIEKRVERLLEENEERLRRVRKEIKKALDENREILKEVEDRARKILEELRRKAK

SEQ ID NO: 26696 - protein, 175 aa, Artificial Sequence; identical to SEQ ID NO: 26695
  Synthetic sequence.

SEQ ID NO: 26697 - protein, 185 aa, Artificial Sequence
  Synthetic sequence.
SELEEVKRRVEEIKKKLKEDLDDHKRRNEKHIKELEDRLEEHRREIEELVRKLEELKRRNVDEETMKRVKEELEEMARRSKEREKDLRRRSEEAHRKSERDLEEAEKKLEEERKRIRDRARRRNSDEEVRKALKELEDDLRRVLEEIKRAHKKSKEDNKRVLDDLTEKHKRSEEELRDVLRDLER

SEQ ID NO: 26698 - protein, 185 aa, Artificial Sequence; identical to SEQ ID NO: 26697
  Synthetic sequence.

SEQ ID NO: 26699 - protein, 185 aa, Artificial Sequence
  Synthetic sequence.
SSLEELEKRNRERIEELERTLRELEERSRELNERLKRELDEHKKRIDELLEELRRLKEENVDEETLKRIEEKLRRDLRRSKERLREIKERLEREHKKIDDRKRERDKKSEKDKKDEREEVRRENSDEEVRRALEELEKSHDEVRERIKRRLDESKERNKRALEKIKRDHEESEERLRRALDRTRK

SEQ ID NO: 26700 - protein, 185 aa, Artificial Sequence; identical to SEQ ID NO: 26699
  Synthetic sequence.

SEQ ID NO: 26701 - protein, 185 aa, Artificial Sequence
  Synthetic sequence.
SSLEEVKKENEKLIKELKEELDKIRKENEEHIEKLERELERVKREAEKIKKKLEELKRENVDEKTLRELEKELRDRARKTKKETDELRRESEERHKRTDERERRLEEKSRRDERRTEDRVRREKSSKEVKDALEELKRSHRKVAKEIKEAVKESRKKNEEVAKKIKKALDELKRELDEALKEAKR

SEQ ID NO: 26702 - protein, 185 aa, Artificial Sequence; identical to SEQ ID NO: 26701
  Synthetic sequence.

SEQ ID NO: 26703 - protein, 183 aa, Artificial Sequence
  Synthetic sequence.
DEVETLEERVRRLKKELRDELKRNEDKVRKLKRELEESLKENAKKVEEVERDLERVKREGSDREEKRDERRRRTDKNREDNREDERRKEEDTEKNERDNERRTREVKRTADEDEKDLKRSNRETDEVRREIERLKRELERVIREYREAIERLKRDLKRAIDKYREDIKRLEEKLRRVDKELEK

SEQ ID NO: 26704 - protein, 183 aa, Artificial Sequence; identical to SEQ ID NO: 26703
  Synthetic sequence.

SEQ ID NO: 26705 - protein, 179 aa, Artificial Sequence
  Synthetic sequence.
SEVERVREENKRSEEKLKKLLEDSRRNLEENRKRLEELLRKSEENLERLKRELDELRKQNIKDSRDEKRTKDRLDRHREEVKRAEDRSREEHKRHKERVEREERKEERRNEEEEEDLRRKGVETEDLRRNRETNEELRDRVRRTHEKLEREAEKVHEDVRRRHKELEDEVREVLKELRR

SEQ ID NO: 26706 - protein, 179 aa, Artificial Sequence; identical to SEQ ID NO: 26705
  Synthetic sequence.

SEQ ID NO: 26707 - protein, 179 aa, Artificial Sequence
  Synthetic sequence.
SDEELIKRIREELERLLKELRDTIKEVEDRNRESLEDLDRVHKRIKEEIERLEKDLDVEEELLKRMREELTELHKENKERKERDEEKNRRVRERLEEEERKEEKEIRDVEREDKDSDRPSEELAKKLKDELRRAKDKVEEIKKRIRDTLEDNRKKAEELKRKNEEDLRRFEKKAEDVRK

SEQ ID NO: 26708 - protein, 179 aa, Artificial Sequence; identical to SEQ ID NO: 26707
  Synthetic sequence.

SEQ ID NO: 26709 - protein, 172 aa, Artificial Sequence
  Synthetic sequence.
SKEDKAREDVKRTIEELKDRNRKLNDKIRKTIEDLERRNEELNKENKDLVDELRDGDRRDEEIRKRSTEYRKRTEETDEEVERTERELRKELRDEDRKLKRRKDEIERKIREDNLPEEVLRELREEIEKLEKEHRDNVRKLERDLDRLRKKHEDNKERLERHTRRVEEEKRR

SEQ ID NO: 26710 - protein, 172 aa, Artificial Sequence; identical to SEQ ID NO: 26709
  Synthetic sequence.

SEQ ID NO: 26711 - protein, 179 aa, Artificial Sequence
  Synthetic sequence.
STEEDVRKIVDDARRNLEENKRRIEKIVKELEDKLRENEKKIRKILEDIRRLLEKFKRDDDKREEVEERIRTTKERTEDDTRRNTEENKKTSERKKKEIDDNSRRNEEKRKRIEDKERRDNLPEDIMRDLRRRLERIAREYKRLLDELKKRLDDIKKTYEDLLRRLREEIERAEEKARR

SEQ ID NO: 26712 - protein, 179 aa, Artificial Sequence; identical to SEQ ID NO: 26711
  Synthetic sequence.

SEQ ID NO: 26713 - protein, 179 aa, Artificial Sequence
  Synthetic sequence.
DEEEEVRKILEEIKKELDDNERRIRKNIRDAEETLRENEKRIRDILKEIEDLLKELKDRDDKREELEERIRREAKKKREELKRNEEDNERRREKSEREHRENSKRNKKRRDDTEERERRANLSEDILEKLRRDIERADEEYKRLEEELRRKHDEIRKTYEKLLKELEEAIERVEREAEK

SEQ ID NO: 26714 - protein, 179 aa, Artificial Sequence; identical to SEQ ID NO: 26713
  Synthetic sequence.

SEQ ID NO: 26715 - protein, 175 aa, Artificial Sequence
  Synthetic sequence.
SSKDLLEELRRTVEEVRKRSDDLSRESEEATRRVRKEHDRINKEVEDELRRVREDGERPKEAEEEAKEIRKKTEKETRDIREEIKRLRDEYEKTKKRLEDEKKKLEEDTEEIERRGSVSEDIVREMRKRLEELLRENEKRNEELLRRLKELLDRSRERVREIEERLRELLEEVRR

SEQ ID NO: 26716 - protein, 175 aa, Artificial Sequence; identical to SEQ ID NO: 26715
  Synthetic sequence.

SEQ ID NO: 26717 - protein, 182 aa, Artificial Sequence
  Synthetic sequence.
DAEKLKRDYEEKSRRVKETLDDLVRRYREEHRRVNEELRKLLEDLKKTVEDVEKEEGSSGEKARELEKTKKTLEEELKRIEEEVKEISERSKEKEERIKKEVKEIRDKSERDKKEIDDKRIDSERLEREIRKLEEENKRTLERVKEKIERLLEENEKVLKEVRDKVKTIKDRLRKLVEEIRR

SEQ ID NO: 26718 - protein, 182 aa, Artificial Sequence; identical to SEQ ID NO: 26717
  Synthetic sequence.

SEQ ID NO: 26719 - protein, 175 aa, Artificial Sequence
  Synthetic sequence.
SVEDEVRKIKRRLEEALERSEKKVRDMVRRNKEFLERAKRRVEEVVKENERALEEVKRRGNGEKELEDLHRKNREDKERERKDARKLHEDNRDEHRKHEEELRKLRRDLERKEKDADIDEEILRRVRKTVKDVEDTLKELNDRLEKIHREVKKELDRLLKELDDRHRKVAEDLKK

SEQ ID NO: 26720 - protein, 175 aa, Artificial Sequence; identical to SEQ ID NO: 26719
  Synthetic sequence.

SEQ ID NO: 26721 - protein, 180 aa, Artificial Sequence
  Synthetic sequence.
SVEELLRKLEEVLRKIREENERSLKELRDRAREIVKRNRETNRELEEVIKELEKRLSGADKEKVEELVRRIRRIVERVVEEDRRTVEEIEKIAREVVKRDRDSADRVRRTVEDVLRKATGSEDIVRKIERIVETIEREVRESVKKVEEIARDIRRKVDESVKNVEKLLRDVDKKARDRKK

SEQ ID NO: 26722 - protein, 180 aa, Artificial Sequence; identical to SEQ ID NO: 26721
  Synthetic sequence.

SEQ ID NO: 26723 - protein, 172 aa, Artificial Sequence
  Synthetic sequence.
DEVEKVLEEIKRALDDLRKKVEESKREIKEALKAVEKHTRDSDTANKRTLAEIERGVKSKDTERVRKLVEELSEENERSLREVRRVAEELLEINERVLEEVERVVEALLDLVRRGGSERVVEEVRRVLEELRRRLEKVTEDSRRAIERLAREDARVSKKSIDVNKKLDDDVR

SEQ ID NO: 26724 - protein, 172 aa, Artificial Sequence; identical to SEQ ID NO: 26723
  Synthetic sequence.

SEQ ID NO: 26725 - protein, 178 aa, Artificial Sequence
  Synthetic sequence.
DAEELVRELEERIKRSHERLEELLREVKRLIERSHEELKRLNEEVLRELDRVLDEVAKRGSDSEELLRELEERVARIKERSKESYARSKESLDRAKEVLEELYRASKRSLEEFERELREKGVDKDSARELERIVKENAELAERVFREVEKIVRENTKLAEDSVRELKRLVEELKKRAK

SEQ ID NO: 26726 - protein, 178 aa, Artificial Sequence; identical to SEQ ID NO: 26725
  Synthetic sequence.

SEQ ID NO: 26727 - protein, 177 aa, Artificial Sequence
  Synthetic sequence.
SAADEVVERMKELVATVKRENDEVVKELKKLVKELEDDNRRVVEESKKSVEDLARRVGKDKREVVEEVRRTSKELVERNEETAKRVDDLVRRLVEENRRSVTEVEELVKELVKELRRGSGSEDLVREVEKRVRDIVEESRKLAEETRKAVEDIIEKSKRIAEDTLEKNKEMVERLER

SEQ ID NO: 26728 - protein, 177 aa, Artificial Sequence; identical to SEQ ID NO: 26727
  Synthetic sequence.

SEQ ID NO: 26729 - protein, 174 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 26730 - protein, 174 aa, Artificial Sequence; identical to SEQ ID NO: 26729
  Synthetic sequence.

SEQ ID NO: 26731 - protein, 174 aa, Artificial Sequence; identical to SEQ ID NO: 26729
  Synthetic sequence.

SEQ ID NO: 26732 - protein, 174 aa, Artificial Sequence; identical to SEQ ID NO: 26729
  Synthetic sequence.

SEQ ID NO: 26733 - protein, 174 aa, Artificial Sequence
  Synthetic sequence.
SESDDVIRKLRELLEELRTHVEKSIRDLRKILEDSTRHAKRSIEELERLLEEVRKKPGDEEVRKTVEEISRRVAENVKRLEDLYRRMEEEVKKNLDRLRKRVEDIIREVEEARKKGVDEEKLKDLIRKLRDILRRAAEAHKKLIDDARESLERAKREHEKLIDRLKKILEELER

SEQ ID NO: 26734 - protein, 174 aa, Artificial Sequence; identical to SEQ ID NO: 26733
  Synthetic sequence.

SEQ ID NO: 26735 - protein, 174 aa, Artificial Sequence; identical to SEQ ID NO: 26733
  Synthetic sequence.

SEQ ID NO: 26736 - protein, 174 aa, Artificial Sequence; identical to SEQ ID NO: 26733
  Synthetic sequence.

SEQ ID NO: 26737 - protein, 178 aa, Artificial Sequence
  Synthetic sequence.
DREREVKKRLDEVRERIERLLRRVEEESRRVAEEIRRLIEEVRRRNKKVTEEIRELLKGLKDKEEVRRVLERLRKLNAESDELLERILERLRRLVEATNRLVKAIIEELRRLVEKIVREVPDSEELREELKKLERKIEKVAKEIHDHDKEVTERLEDLLRRITEHARKSDREIEETAR

SEQ ID NO: 26738 - protein, 178 aa, Artificial Sequence; identical to SEQ ID NO: 26737
  Synthetic sequence.

SEQ ID NO: 26739 - protein, 178 aa, Artificial Sequence; identical to SEQ ID NO: 26737
  Synthetic sequence.

SEQ ID NO: 26740 - protein, 178 aa, Artificial Sequence; identical to SEQ ID NO: 26737
  Synthetic sequence.

SEQ ID NO: 26741 - protein, 181 aa, Artificial Sequence
  Synthetic sequence.
SEVDEAVKNNEEDAKESRRVVEEAVKRDEDIARDIERAAREVVERDKEIVDEVRRGVKDEKKLREVVTLSKKIVDETKEIADRVLELSKRIVKETRDIAKRVLKLNDDSVKDVRRIAREGRSKETKDLLDENSKRSNEISREVKKDLERTVRENKKIVDEVAKALEDTVDKNRRIVEEVTT

SEQ ID NO: 26742 - protein, 181 aa, Artificial Sequence; identical to SEQ ID NO: 26741
  Synthetic sequence.

SEQ ID NO: 26743 - protein, 185 aa, Artificial Sequence
  Synthetic sequence.
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKEVVDEIKRIVDEVRERLKRIVDENAKIVEDARRALEKIVKENEEILRRLKKELRELRK

SEQ ID NO: 26744 - protein, 185 aa, Artificial Sequence; identical to SEQ ID NO: 26743
  Synthetic sequence.

SEQ ID NO: 26745 - protein, 172 aa, Artificial Sequence
  Synthetic sequence.
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 26746 - protein, 172 aa, Artificial Sequence; identical to SEQ ID NO: 26745
  Synthetic sequence.

SEQ ID NO: 26747 - protein, 172 aa, Artificial Sequence; identical to SEQ ID NO: 26745
  Synthetic sequence.

SEQ ID NO: 26748 - protein, 172 aa, Artificial Sequence; identical to SEQ ID NO: 26745
  Synthetic sequence.

SEQ ID NO: 26749 - protein, 177 aa, Artificial Sequence
  Synthetic sequence.
DEVRELLERNRRLLEEIKKTVKDLIRANEELLKRIEDDAKRLIDRNEELLDELEKGLSDDETIREAKERLKASLEDVKRRVEEVKRLLEKSLEEVETIIREAEKRNRDSLREMERRGSSEELEELRRVVEESDETIKRLLEEAKESVDRSLDRIRKLLEDVRRSVERSAKRIDEKRK

SEQ ID NO: 26750 - protein, 177 aa, Artificial Sequence; identical to SEQ ID NO: 26749
  Synthetic sequence.

SEQ ID NO: 26751 - protein, 180 aa, Artificial Sequence
  Synthetic sequence.
STEEVLDEIRKLHKTLTEDIKRVLREIEELHRRTIEENKEVLDKIAEDYKRVIDDVRTKDTPNVEKLLKDLEKSAKENIEHNERTLREDDRVLKEIRRRATELLKANEEMLRRIEEVARKGGVDAEELLRESKEAIKEVKRVLEELRKESKRVVDETRKLSEENLEHSERVLRKVEEDLR

SEQ ID NO: 26752 - protein, 180 aa, Artificial Sequence; identical to SEQ ID NO: 26751
  Synthetic sequence.

SEQ ID NO: 26753 - protein, 188 aa, Artificial Sequence
  Synthetic sequence.
SEIEKILKEIEDLARRDEEVSKKIVEDIRRLAKEVEDTSRDIVRKIEELAKRVLDRLRKDGSKEELEKEVREVVKTLEELVKDNHRLIRRAVEEMKRLVEENHRHSREVVKELEDLVRELRKGSGSEDSERLVREVEDLVRRLVRRSEKSNEEVKRTVEELVRRMEESNDRVRDLVRRLVEELKRAVD

SEQ ID NO: 26754 - protein, 188 aa, Artificial Sequence; identical to SEQ ID NO: 26753
  Synthetic sequence.

SEQ ID NO: 26755 - protein, 178 aa, Artificial Sequence
  Synthetic sequence.
SEAEKAKETIDRLADRVRKLLEEIKRSLDDSRRKSKETVEENEKTLDRMRKEVDAAKRGSVSEEELERLIRKLKKTLDELRRRHEKLVEDLRRNLERIKRRLEELTREMRETLERLAREGLDEEVLRTLEEIIRRLTKELEDVLREYERELRRLEEENKRVIDKTEEEIRRLADRLRR

SEQ ID NO: 26756 - protein, 178 aa, Artificial Sequence; identical to SEQ ID NO: 26755
  Synthetic sequence.

SEQ ID NO: 26757 - protein, 178 aa, Artificial Sequence; identical to SEQ ID NO: 26755
  Synthetic sequence.

SEQ ID NO: 26758 - protein, 178 aa, Artificial Sequence; identical to SEQ ID NO: 26755
  Synthetic sequence.

SEQ ID NO: 26759 - protein, 179 aa, Artificial Sequence
  Synthetic sequence.
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESEELDRRIEKVLKEIEEKIREVIKEWERVHREVEELLKRLIDENRKVLDEIRKLLEEKSK

SEQ ID NO: 26760 - protein, 179 aa, Artificial Sequence; identical to SEQ ID NO: 26759
  Synthetic sequence.

SEQ ID NO: 26761 - protein, 179 aa, Artificial Sequence; identical to SEQ ID NO: 26759
  Synthetic sequence.

SEQ ID NO: 26762 - protein, 179 aa, Artificial Sequence; identical to SEQ ID NO: 26759
  Synthetic sequence.

SEQ ID NO: 26763 - protein, 182 aa, Artificial Sequence
  Synthetic sequence.
SELEEIEKKVRELTKRHRELVERVRKTVKELIETNRRLLETLTERIKRVLEEVRDLERRGEPKEDLKARLEDIIRRLAEDIERVKRETDKLLEELARIIEEVEKEMRETNKELDKEIKDGGLDDKALEEAKRVLAENNEVIKDIKRALDELLKELEKSVRESEERLRRLLEEVKRVIEEVAT

SEQ ID NO: 26764 - protein, 182 aa, Artificial Sequence; identical to SEQ ID NO: 26763
  Synthetic sequence.

SEQ ID NO: 26765 - protein, 186 aa, Artificial Sequence
  Synthetic sequence.
SEAERLEARARELLRANEELMDDLRAKAEELLKRNDRLVKEIEKKVREVLAAIEELKRRGEPKEEVARKIEEILRRLEETLRRIKEESDRLDEELKRELERVKRESEELDRELRKLIEDVERRGSGSKRLEELLRRLNEEHKRISDELRKLLDEALEAHRELSRRLEEELERLLREIERLVEEVTR

SEQ ID NO: 26766 - protein, 186 aa, Artificial Sequence; identical to SEQ ID NO: 26765
  Synthetic sequence.

SEQ ID NO: 26767 - protein, 176 aa, Artificial Sequence
  Synthetic sequence.
SVDEVLKEIEDALRRLKEEVERVLKENEDELRRLEEEVRRVLKEDEELLESLKRGVGESDEVDRVVDEIAKLSAEILEKVKKVVKEIRDSLETVKRRVDDVVRRLKELLDEIKRGSDEKAIRDVAKEIRDRLKELEEEIEEVTRRNLKLLADVEEEIRRVHEKTRRLLETVLRRAT

SEQ ID NO: 26768 - protein, 176 aa, Artificial Sequence; identical to SEQ ID NO: 26767
  Synthetic sequence.

SEQ ID NO: 26769 - protein, 184 aa, Artificial Sequence
  Synthetic sequence.
DDLERAREEVADLIRKHEEKTRRILEESRRLNERHRELSARILDEIRKLAERIEELIKRERGKDELRRKVEDLEARVEDLIRRLEEHLRRVHDKDRRLIEDLRRHLKRVVEELKRLIDELRRGVPKEELDRIEEELKRLIDTLREKNREVEKRARDSNRDLKRTNDEIAKEVRELIKKLREDLK

SEQ ID NO: 26770 - protein, 184 aa, Artificial Sequence; identical to SEQ ID NO: 26769
  Synthetic sequence.

SEQ ID NO: 26771 - protein, 174 aa, Artificial Sequence
  Synthetic sequence.
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIKGGSDIKTLLDRVRKLAEEDAERLDRLRRESEELNERVRRVDKKLLEEIRRKAKKVEDDTR

SEQ ID NO: 26772 - protein, 174 aa, Artificial Sequence; identical to SEQ ID NO: 26771
  Synthetic sequence.

SEQ ID NO: 26773 - protein, 174 aa, Artificial Sequence; identical to SEQ ID NO: 26771
  Synthetic sequence.

SEQ ID NO: 26774 - protein, 174 aa, Artificial Sequence; identical to SEQ ID NO: 26771
  Synthetic sequence.

SEQ ID NO: 26775 - protein, 174 aa, Artificial Sequence
  Synthetic sequence.
DEEEDLERAIKKLLDENRELLKRIAEELRRLLEELRRLTEESADRLRRLLKELKDRGVPEEDLADVAEKVKKVLKESEDSNADVARKLEKLLRDLERSTERLEREARKVRKLLRGGKDAETLLRELEKLSRDNKELLKKIEKEIRDLIKEDKERNIELSERLRKLVEELKKKAT

SEQ ID NO: 26776 - protein, 174 aa, Artificial Sequence; identical to SEQ ID NO: 26775
  Synthetic sequence.

SEQ ID NO: 26777 - protein, 174 aa, Artificial Sequence; identical to SEQ ID NO: 26775
  Synthetic sequence.

SEQ ID NO: 26778 - protein, 174 aa, Artificial Sequence; identical to SEQ ID NO: 26775
  Synthetic sequence.

SEQ ID NO: 26779 - protein, 178 aa, Artificial Sequence
  Synthetic sequence.
DDAERILREMERLLEENKEISDEIAKELKRLLDENRKLSEDVVKALEDLLRDLERRSGVSEEVLKRVREVLERIKRELDRSDDELRKVAERILRDAERSNDELRKVIEEIEEELRGSRDKDTLRELARSIRKLSAENKERLKELLRELKKLSDENKERIKKLLSDAEKIIEDVARRAK

SEQ ID NO: 26780 - protein, 178 aa, Artificial Sequence; identical to SEQ ID NO: 26779
  Synthetic sequence.

SEQ ID NO: 26781 - protein, 177 aa, Artificial Sequence
  Synthetic sequence.
SSEERLRAVIEDLKRLAEESRKRHKELIDELAKAVERIERRHKKLLDEIKAVVDDIRRGVSEELLKRIEEVLDEIRKELEENIKRIRKVLDELRRTSEENIARIEKVLRELEDLVRKGGSDADTIIEEVKRVLEELARSTEEVEKRVRDAIEELERSSEELARRIKEVLKRLEEETR

SEQ ID NO: 26782 - protein, 177 aa, Artificial Sequence; identical to SEQ ID NO: 26781
  Synthetic sequence.

SEQ ID NO: 26783 - protein, 178 aa, Artificial Sequence
  Synthetic sequence.
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGLDERILRELEERVKELEKEAREILKRSEDETDKLREKAERILEDLERANRRTMDEARR

SEQ ID NO: 26784 - protein, 178 aa, Artificial Sequence; identical to SEQ ID NO: 26783
  Synthetic sequence.

SEQ ID NO: 26785 - protein, 178 aa, Artificial Sequence; identical to SEQ ID NO: 26783
  Synthetic sequence.

SEQ ID NO: 26786 - protein, 178 aa, Artificial Sequence; identical to SEQ ID NO: 26783
  Synthetic sequence.

SEQ ID NO: 26787 - protein, 184 aa, Artificial Sequence
  Synthetic sequence.
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 26788 - protein, 184 aa, Artificial Sequence; identical to SEQ ID NO: 26787
  Synthetic sequence.

SEQ ID NO: 26789 - protein, 184 aa, Artificial Sequence; identical to SEQ ID NO: 26787
  Synthetic sequence.

SEQ ID NO: 26790 - protein, 184 aa, Artificial Sequence; identical to SEQ ID NO: 26787
  Synthetic sequence.

SEQ ID NO: 26791 - protein, 176 aa, Artificial Sequence
  Synthetic sequence.
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDATRVIEEAKRILDEARKLNEETIRRSEELVRRIERVIEEIIKRSEKLLEDVARESK

SEQ ID NO: 26792 - protein, 176 aa, Artificial Sequence; identical to SEQ ID NO: 26791
  Synthetic sequence.

SEQ ID NO: 26793 - protein, 176 aa, Artificial Sequence; identical to SEQ ID NO: 26791
  Synthetic sequence.

SEQ ID NO: 26794 - protein, 176 aa, Artificial Sequence; identical to SEQ ID NO: 26791
  Synthetic sequence.

SEQ ID NO: 26795 - protein, 176 aa, Artificial Sequence
  Synthetic sequence.
STAETVAEEVERVLKHSDDLIKEVEDVNRRVEEEIKRVIRELEEENERLVAEVRKGVKGEILAEIEKRLADNSEKVREVAERAKKLLEENTARVKDILRESRKLVKDLLDEVRGTGSEEAAREIIKRLREVNKRTKEKLDELIKHSEEVLERVKRLIDELRKHSEEVLEDLRRRAK

SEQ ID NO: 26796 - protein, 176 aa, Artificial Sequence; identical to SEQ ID NO: 26795
  Synthetic sequence.

SEQ ID NO: 26797 - protein, 176 aa, Artificial Sequence; identical to SEQ ID NO: 26795
  Synthetic sequence.

SEQ ID NO: 26798 - protein, 176 aa, Artificial Sequence; identical to SEQ ID NO: 26795
  Synthetic sequence.

SEQ ID NO: 26799 - protein, 182 aa, Artificial Sequence
  Synthetic sequence.
DEVREVAERLRRLVDESRKRNEEVIKESEALVDRVRKTNEEVMKRLRELIDKLEKDIRRSGDKETVEKIIREVLSAIDELLKRVERTNAEISKENARLLDEVRKTNEEISRRLAKLLEDIRRGSGDAETIERVVRELLEENKEVLRKTEEAVKRSTETNKRLLEASKEVADRLRERIKEAAK

SEQ ID NO: 26800 - protein, 182 aa, Artificial Sequence; identical to SEQ ID NO: 26799
  Synthetic sequence.

SEQ ID NO: 26801 - protein, 186 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVAEVAEKVLRDIDKLDRESKEAFRATNEEIAKLDEDTARVAERVKKAIEDLAK

SEQ ID NO: 26802 - protein, 186 aa, Artificial Sequence; identical to SEQ ID NO: 26801
  Synthetic sequence.

SEQ ID NO: 26803 - protein, 186 aa, Artificial Sequence; identical to SEQ ID NO: 26801
  Synthetic sequence.

SEQ ID NO: 26804 - protein, 186 aa, Artificial Sequence; identical to SEQ ID NO: 26801
  Synthetic sequence.

SEQ ID NO: 26805 - protein, 186 aa, Artificial Sequence
  Synthetic sequence.
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDEVTKVKKVADDVLAEIKKLDDETRRVIEDTNKKIADLDKATRDVVRKVLEEVKKLEK

SEQ ID NO: 26806 - protein, 186 aa, Artificial Sequence; identical to SEQ ID NO: 26805
  Synthetic sequence.

SEQ ID NO: 26807 - protein, 180 aa, Artificial Sequence
  Synthetic sequence.
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSEKLKELRDVIAEVAKRIDELDEYTRESIRRAKKEIERLNRETKKVIEEVVKRIEEERK

SEQ ID NO: 26808 - protein, 180 aa, Artificial Sequence; identical to SEQ ID NO: 26807
  Synthetic sequence.

SEQ ID NO: 26809 - protein, 180 aa, Artificial Sequence; identical to SEQ ID NO: 26807
  Synthetic sequence.

SEQ ID NO: 26810 - protein, 180 aa, Artificial Sequence; identical to SEQ ID NO: 26807
  Synthetic sequence.

SEQ ID NO: 26811 - protein, 181 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELLRRIKKLLDEIKKAIEDSSREIKRLLEESERVMKRSSEDIKRTLDDTRRVVEEVRR

SEQ ID NO: 26812 - protein, 181 aa, Artificial Sequence; identical to SEQ ID NO: 26811
  Synthetic sequence.

SEQ ID NO: 26813 - protein, 181 aa, Artificial Sequence; identical to SEQ ID NO: 26811
  Synthetic sequence.

SEQ ID NO: 26814 - protein, 181 aa, Artificial Sequence; identical to SEQ ID NO: 26811
  Synthetic sequence.

SEQ ID NO: 26815 - protein, 177 aa, Artificial Sequence
  Synthetic sequence.
SSDEVLKEIEEIIRRLEAEVRRVNAEVNASTEDLAREVEEVLRATNELIEELERRVTGTEELKRVIDELRDRDRKVRRRVERVIEESAKRDDESRKRLTRAVEKLRADLKKLADDGVPEEALSKAIKDVRDIVKKVKDELKEWRDRNKELVDRLSEELKEWLKDVERVLKELTDKDR

SEQ ID NO: 26816 - protein, 177 aa, Artificial Sequence; identical to SEQ ID NO: 26815
  Synthetic sequence.

SEQ ID NO: 26817 - protein, 175 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPDSEELSAEVKKLLDEVRKALARHKDENDKLLKEIEDSLRRHKEENDRLLEKLKESTR

SEQ ID NO: 26818 - protein, 175 aa, Artificial Sequence; identical to SEQ ID NO: 26817
  Synthetic sequence.

SEQ ID NO: 26819 - protein, 175 aa, Artificial Sequence; identical to SEQ ID NO: 26817
  Synthetic sequence.

SEQ ID NO: 26820 - protein, 175 aa, Artificial Sequence; identical to SEQ ID NO: 26817
  Synthetic sequence.

SEQ ID NO: 26821 - protein, 185 aa, Artificial Sequence
  Synthetic sequence.
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDEDKVERVVREVEKLHEEDRKRLEESTRSVRKLLEELKRELEKSTRSVKALVDELRERVR

SEQ ID NO: 26822 - protein, 185 aa, Artificial Sequence; identical to SEQ ID NO: 26821
  Synthetic sequence.

SEQ ID NO: 26823 - protein, 185 aa, Artificial Sequence; identical to SEQ ID NO: 26821
  Synthetic sequence.

SEQ ID NO: 26824 - protein, 185 aa, Artificial Sequence; identical to SEQ ID NO: 26821
  Synthetic sequence.

SEQ ID NO: 26825 - protein, 175 aa, Artificial Sequence
  Synthetic sequence.
SEAEEIRRRLEEISRRSVEHLRKVLEEIKRISERSKRHLDRVLEENARRLEELAELLKRGGDKEELLADLKAVHDESRKVIEKNAEENDRALKAAKEVIDENRERNKRVLDEVRKGGLPEEVLRELEELLKESEERIKRIEEEIKKIIDKSREDIKRVLEEIERLNAKAADDLRK

SEQ ID NO: 26826 - protein, 175 aa, Artificial Sequence; identical to SEQ ID NO: 26825
  Synthetic sequence.

SEQ ID NO: 26827 - protein, 181 aa, Artificial Sequence
  Synthetic sequence.
SEVDDVLRRLEELIKTLEDINAKSLEDIKKLIDDLAKILEDALRKHEKLIRELREAKKGIDSREAEEIAKRVLEELKRTSDDLRKKVERVDEDLRRLLRENHERNKKILRDLERLLRDAARRGVPKEALDRMREEIRRLEEESRKSDETIERLIRELRRRVEEVLKTSTDLIRELEEEVKK

SEQ ID NO: 26828 - protein, 181 aa, Artificial Sequence; identical to SEQ ID NO: 26827
  Synthetic sequence.

SEQ ID NO: 26829 - protein, 181 aa, Artificial Sequence; identical to SEQ ID NO: 26827
  Synthetic sequence.

SEQ ID NO: 26830 - protein, 181 aa, Artificial Sequence; identical to SEQ ID NO: 26827
  Synthetic sequence.

SEQ ID NO: 26831 - protein, 178 aa, Artificial Sequence
  Synthetic sequence.
SDAEELLKRVADLLKASLESLEKILRDSKELMDRWRKKLEDLLRESEELVDRAEKILRRGGSDKEVLDKIAEEVRRTNDDSRRLDEELHRLSRDTLRKLEENLRRTEKEVREMDKRAAERGVDERVREELKKLLTRVEEEHRKVLETDKKILKEAHKESKEVNDRDRELLERLEESVR

SEQ ID NO: 26832 - protein, 178 aa, Artificial Sequence; identical to SEQ ID NO: 26831
  Synthetic sequence.

SEQ ID NO: 26833 - protein, 178 aa, Artificial Sequence
  Synthetic sequence.
DAAERAKEKLDKILEDLRDVVRASKENLDRLHAENAETLERSKANLDRLLEKVKKDGVPEELLKELERIIRDLKRKHAKLLEDHRKIIEELKREHDRLLKEAEEIVRRIKDELEKGSDDERDIERILRELEAVLKKLTDESERLNREVERVSRDTKKKSKELNEELKAVLDEVKRKAD

SEQ ID NO: 26834 - protein, 178 aa, Artificial Sequence; identical to SEQ ID NO: 26833
  Synthetic sequence.

SEQ ID NO: 26835 - protein, 181 aa, Artificial Sequence
  Synthetic sequence.
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLDKEDIDKLLKELRDLVEKIKKDLKELLERYEEIVRRIKELLKDLNREAEEVVRRLKEELR

SEQ ID NO: 26836 - protein, 181 aa, Artificial Sequence; identical to SEQ ID NO: 26835
  Synthetic sequence.

SEQ ID NO: 26837 - protein, 174 aa, Artificial Sequence
  Synthetic sequence.
KELEDVIEEVKKLLKTVNEESRRVAEEVRKLIREVSEELTEVIRRVERLVEEVAKGVDSEEALDAVRKRIEELVRRVEEVNAASKRRIEELEDELRKVDEESRETIERLIDLLRRGLDAETVLRSAEDIVAKNRKLAEEVLRRVKKIVEENRKIASEVLDDVRKLVEDVLARAS

SEQ ID NO: 26838 - protein, 174 aa, Artificial Sequence; identical to SEQ ID NO: 26837
  Synthetic sequence.

SEQ ID NO: 26839 - protein, 183 aa, Artificial Sequence
  Synthetic sequence.
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVTKEADEVVERAERISEENKRRVEDVARKSKELVEDVRRHSEEVVRRVEELVKEVEERVR

SEQ ID NO: 26840 - protein, 183 aa, Artificial Sequence; identical to SEQ ID NO: 26839
  Synthetic sequence.

SEQ ID NO: 26841 - protein, 183 aa, Artificial Sequence; identical to SEQ ID NO: 26839
  Synthetic sequence.

SEQ ID NO: 26842 - protein, 183 aa, Artificial Sequence; identical to SEQ ID NO: 26839
  Synthetic sequence.

SEQ ID NO: 26843 - protein, 173 aa, Artificial Sequence
  Synthetic sequence.
SAEEVKEELKRIATKLKEEIKENIRRLEESVEKIAKELAENIKRLEDILRDVKRGLRDERIVKTVEDIARRVVEDNERIMEEDKDVVRRLVERNEEIVRRVDETVKKIVELIDRGEPGEELVERLRRVVEEVRERLKDSSRELRKINEDSRKAVEDSSAEVAKVVEELERRDT

SEQ ID NO: 26844 - protein, 173 aa, Artificial Sequence; identical to SEQ ID NO: 26843
  Synthetic sequence.

SEQ ID NO: 26845 - protein, 175 aa, Artificial Sequence
  Synthetic sequence.
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGGDADDVLARVEELAKRAHDENERLIREVEELVRAHNKRNKELVDEVKRLVEKVIEEER

SEQ ID NO: 26846 - protein, 175 aa, Artificial Sequence; identical to SEQ ID NO: 26845
  Synthetic sequence.

SEQ ID NO: 26847 - protein, 175 aa, Artificial Sequence; identical to SEQ ID NO: 26845
  Synthetic sequence.

SEQ ID NO: 26848 - protein, 175 aa, Artificial Sequence; identical to SEQ ID NO: 26845
  Synthetic sequence.

SEQ ID NO: 26849 - protein, 183 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKKKLDEVLERAKRTIDRLLETSDRSLEKVEADLRRLNEELDRSLERAERTIRELAK

SEQ ID NO: 26850 - protein, 183 aa, Artificial Sequence; identical to SEQ ID NO: 26849
  Synthetic sequence.

SEQ ID NO: 26851 - protein, 183 aa, Artificial Sequence; identical to SEQ ID NO: 26849
  Synthetic sequence.

SEQ ID NO: 26852 - protein, 183 aa, Artificial Sequence; identical to SEQ ID NO: 26849
  Synthetic sequence.

SEQ ID NO: 26853 - protein, 173 aa, Artificial Sequence
  Synthetic sequence.
STEDVLRKIKEDVKRVIDDNRRILDEVRRTSKRVLDDLRANLKHIAEEVERVLRGSDSEEVVRELAKILDEIREEHRRLIRTNEKVLEDIERDHRRISEELKRILDEVDELLRGGKPSKELLEKAKAVVDEIKRLAEESLKRLEDLSRDHKRRAKELNDEIAKVVDELAKRAT

SEQ ID NO: 26854 - protein, 173 aa, Artificial Sequence; identical to SEQ ID NO: 26853
  Synthetic sequence.

SEQ ID NO: 26855 - protein, 180 aa, Artificial Sequence
  Synthetic sequence.
SAEELLREVAELVKRVDEDLRRLLEEVRASNEEVIRRLEEILKRIEEENRKVVEELRRGGVSEDLVRESKRLVDESRRVIEKLVKESADSVERTRETVDRLREELKRLVEEIAKMVKGGSSEETVKRLLDELRELLERLKRTIEELLKRNRDLLADAEEKARRLLEENRKLLKAARDTAT

SEQ ID NO: 26856 - protein, 180 aa, Artificial Sequence; identical to SEQ ID NO: 26855
  Synthetic sequence.

SEQ ID NO: 26857 - protein, 177 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGVDEEVLKKLAEIVRRVKEENRKVNEEVEKRLRELEEENKKVIEDLKSTVEELVERLR

SEQ ID NO: 26858 - protein, 177 aa, Artificial Sequence; identical to SEQ ID NO: 26857
  Synthetic sequence.

SEQ ID NO: 26859 - protein, 177 aa, Artificial Sequence; identical to SEQ ID NO: 26857
  Synthetic sequence.

SEQ ID NO: 26860 - protein, 177 aa, Artificial Sequence; identical to SEQ ID NO: 26857
  Synthetic sequence.

SEQ ID NO: 26861 - protein, 180 aa, Artificial Sequence
  Synthetic sequence.
DEVEDVLRKIEKILDDHRKRIEKNSRDMARIIDEHRRKVEENSREMKKLVDDLKKAVDRGEGDEETAEDVKAKLEKSNRELEKHSEEVKRALDESNEDLRRHSEEVKERIERLVKKLREDGVEREEELKEVADRVKEKLDRLNRENEKSSEELKRELDKINDENRETSERLKREIDETTR

SEQ ID NO: 26862 - protein, 180 aa, Artificial Sequence; identical to SEQ ID NO: 26861
  Synthetic sequence.

SEQ ID NO: 26863 - protein, 177 aa, Artificial Sequence
  Synthetic sequence.
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGISEEELDKLLKEARDLIREIEKRLEELLKRVEKLTEDAKRDLERSNREHKELADRIKETAR

SEQ ID NO: 26864 - protein, 177 aa, Artificial Sequence; identical to SEQ ID NO: 26863
  Synthetic sequence.

SEQ ID NO: 26865 - protein, 177 aa, Artificial Sequence; identical to SEQ ID NO: 26863
  Synthetic sequence.

SEQ ID NO: 26866 - protein, 177 aa, Artificial Sequence; identical to SEQ ID NO: 26863
  Synthetic sequence.

SEQ ID NO: 26867 - protein, 185 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERARETLKRLLDENRDRSKKVKEEIRRILEDLTRTTERVKREIAKLLKELEDTAR

SEQ ID NO: 26868 - protein, 185 aa, Artificial Sequence; identical to SEQ ID NO: 26867
  Synthetic sequence.

SEQ ID NO: 26869 - protein, 185 aa, Artificial Sequence; identical to SEQ ID NO: 26867
  Synthetic sequence.

SEQ ID NO: 26870 - protein, 185 aa, Artificial Sequence; identical to SEQ ID NO: 26867
  Synthetic sequence.

SEQ ID NO: 26871 - protein, 180 aa, Artificial Sequence
  Synthetic sequence.
SELEEVLRRIEALVRKAHKENEDVLREIERLVRTAHRLNKKVDDDSAKIAEDLKRGGREDKDKVEEALRRLRELYRRLEEENRRILREIEELVKELEKRNREILKELEDLVADAERKGSDGSEAVRRLKEILERLKEEVRRSLEELRKEVERLKKEVEDSLRELKKSLEEWVKSLEEATR

SEQ ID NO: 26872 - protein, 180 aa, Artificial Sequence; identical to SEQ ID NO: 26871
  Synthetic sequence.

SEQ ID NO: 26873 - protein, 180 aa, Artificial Sequence; identical to SEQ ID NO: 26871
  Synthetic sequence.

SEQ ID NO: 26874 - protein, 180 aa, Artificial Sequence; identical to SEQ ID NO: 26871
  Synthetic sequence.

SEQ ID NO: 26875 - protein, 172 aa, Artificial Sequence
  Synthetic sequence.
SKEEELEKLLREHHEKIKRLKEESKRINDRIRRTVEELIKESEKINRDINDTVRKGDRDEEVIRRLLEDVRRKHEELRERLKRELDKVRERHKELLDRARRATEAVKERLDRGGLSEDSVERIARELERNLDDLARVLKESEDDLAEILRRLKEVLEESERDLERVEREVRK

SEQ ID NO: 26876 - protein, 172 aa, Artificial Sequence; identical to SEQ ID NO: 26875
  Synthetic sequence.

SEQ ID NO: 26877 - protein, 252 aa, Artificial Sequence
  Synthetic sequence.
SEAEEAAERAKRAAKEAVERAKRAVERNEEAARRAAEKAREATERAERAARRAADKARKATDRRALRDAAKELEDAARENADALRKAIEDLARATDEAIKAAREAAKRLKDAAKEALDAARRTARDEDAERILRELKEAIERAARRLDRLLREWEKAAERIKRDAERLLEEWERAAEKIRKELEDIDRKAKDIKDAADKLAEAAKRAVDISKKAADDLKRLAKEDNEIAREAARRLAEAAKEAVKLVDDVTR

SEQ ID NO: 26878 - protein, 252 aa, Artificial Sequence; identical to SEQ ID NO: 26877
  Synthetic sequence.

SEQ ID NO: 26879 - protein, 233 aa, Artificial Sequence
  Synthetic sequence.
SEKEKAAEDLRRAIEEAKKRSEEAAKELEDALRKAEKEARDSAETLKEAAKRAADAGAPEEALRALEEAIKKAIKASKDALDALREAIKESIDSNREALKALKEAVERAEEGGDREIARRAAERAREAAKRAAEKNKRAARKAEEAAKRAVDEHRKAAKEAREAAERAVRKAEDKDAATEAKKAADTIAKLIEDNAKRALEAAREIAKLIEKSAKEALEAAERIARLIEEAAN

SEQ ID NO: 26880 - protein, 233 aa, Artificial Sequence; identical to SEQ ID NO: 26879
  Synthetic sequence.

SEQ ID NO: 26881 - protein, 234 aa, Artificial Sequence
  Synthetic sequence.
SVEEAARRAAKALKDAAKKLLEANEKAARAWKELAKELIKADEKALKILEEAARKARRDGPDKEIEKELRKAAREYEEIIKDLREKAKKVLEEYRRIVKKLEEDLKRALDKLREDGVKKDALDAARRAAELLAEAAKKAAKAHEEAARLLAKAAEDSARAAKEAAELLRRALEENKRAEEAAKEAIRIAEEALRRSAEAAERAARIAEDAARKSRKAAEDAAKIAKEAADRARK

SEQ ID NO: 26882 - protein, 234 aa, Artificial Sequence; identical to SEQ ID NO: 26881
  Synthetic sequence.

SEQ ID NO: 26883 - protein, 239 aa, Artificial Sequence
  Synthetic sequence.
SEEDRLRELAERARRLAKRNRELAKEIIDEIRKLIRDAREAAKKSAEKAKRLIDDARRVAGKPTDRKIVETLARRSAKANEENARLIKRLAEEAIRAAKKAADADRKSAKEVIDALKRIAEDLQAREAADAARRAAKIAKEAADEAIKAWEDAARIAERAARKSIEANKRAIKIAREAAERNAIEEAAKANEEAIKASEEAVDEAARALEEAAEASKRANEKADKALEDAVRAAEEATR

SEQ ID NO: 26884 - protein, 239 aa, Artificial Sequence; identical to SEQ ID NO: 26883
  Synthetic sequence.

SEQ ID NO: 26885 - protein, 238 aa, Artificial Sequence
  Synthetic sequence.
SEKEDVLRRIREAHERNKRLLERVAEEIKRIVEESRKLLEDVRKKAEDAARRAEEALRKEARDDEKAAEELAKILEDLARLLEEAARRNAKLLRDIAELVKRAAEENAKSNEEIARLLKEAGADDTAAKKVKEAADESLKAAEEAAKKIEEAARKSLEAARRAAEKIKRAAEKAREAAREKAKEALLKAAKEALEALEEALRLIAKATEEAARAAKEALDLILEADRKSAKAAEEALR

SEQ ID NO: 26886 - protein, 238 aa, Artificial Sequence; identical to SEQ ID NO: 26885
  Synthetic sequence.

SEQ ID NO: 26887 - protein, 238 aa, Artificial Sequence
  Synthetic sequence.
SEREEVAKRATDAHEENERLLREVEKRIKEALERNEELLKRVSDKAREAAKKLEDALRRRARDDERAAEELVKALEDLARLIEEAAKRNAESLREIAKLVRRAAEENAKSNKDLAKLLKDAGADDDAARKVKEAAEESLKAAEEAVKKIEDAARKSLKAAKEAAEKIRKAAEEARRAAEERAKEALRRAAKKALDAAEEALELIRKASKEAADAAREALKLILEADKKSLEAAREALR

SEQ ID NO: 26888 - protein, 238 aa, Artificial Sequence; identical to SEQ ID NO: 26887
  Synthetic sequence.

SEQ ID NO: 26889 - protein, 244 aa, Artificial Sequence
  Synthetic sequence.
SEREEIEEIKKRVDRTLEEYERKVEDIRRKLTELKDESDKKVKDVRRKLKETEDRVREEGSSEVIERIIEDVKKILEDLVRVHRESLDTAVRIAEELVRVARESIKRVKEILRELAEASKTKDEEKLREILERVKEKLKKIIDDNREVLKRVEEKVKEIIKRNKDVNDRVREELKRLAEELERANVEELRELIERLVRIAEEVSEEDERVLRSLEDILRKVVEENERLLERLKRILEELIRRTR

SEQ ID NO: 26890 - protein, 244 aa, Artificial Sequence; identical to SEQ ID NO: 26889
  Synthetic sequence.

SEQ ID NO: 26891 - protein, 245 aa, Artificial Sequence
  Synthetic sequence.
SEDEELKKELEKLLKELEEKLEKYRDDLRKDKERLKEKLDRYRERLRELMEELKDLLDKRVRAKELLDRIREIIKESADANRELLEEIRKTLEKSKRMNEELLKKIKEIIERIEERLRKRGVPEEVLRTLAEKARRLLEELKKESERIVREAEEILKRIEEELREVHKELEEILRRIKRKLDEETSEDVLRDIVRRVVEVLRKNLKIVEEIIRKIEELLEKNLRLVEEILRRIARLLEEVLEKTR

SEQ ID NO: 26892 - protein, 245 aa, Artificial Sequence; identical to SEQ ID NO: 26891
  Synthetic sequence.

SEQ ID NO: 26893 - protein, 242 aa, Artificial Sequence
  Synthetic sequence.
SDAEVIEELVRLHRKLLEDILKLLKELVDIHRETLRRIEEIVERIVRLIEALLDKIRKEGKVDEAADEVDRRLKRLAEEIERLVRETERIIREVLKELERTLRETEKRIEDVKKELEERGTDEKLRRLLEMLRKLHEEVAEVVRRVVKLLLDNHKEVIDRVREVLEKLRTVLKELVDVASDSRKEALERLLERLKEIVDRIKEELDRLLKRSEDSIREIEERVKRLLEESKRVVDEIRERLK

SEQ ID NO: 26894 - protein, 242 aa, Artificial Sequence; identical to SEQ ID NO: 26893
  Synthetic sequence.

SEQ ID NO: 26895 - protein, 236 aa, Artificial Sequence
  Synthetic sequence.
SKEKKILDRLRELLKESRDLNRRVKETLKKLLEDSKRLLDEIRKRLKELLDELEKENKVPEELIRTVREALERLLRRLERHTDELRKALEDLLRRLEEHNDELEDALREILDVKRRRDEDERELRRKIEELKRRSDKLRRELKEEIKRLRDRSRKVKEEIERELKKLKEEIDRVLRETRNDEAVKRLKEVLDEVAELVKTLLEVNRKILEDVDKLIEEVLKLNDDILREVVKLAED

SEQ ID NO: 26896 - protein, 236 aa, Artificial Sequence; identical to SEQ ID NO: 26895
  Synthetic sequence.

SEQ ID NO: 26897 - protein, 243 aa, Artificial Sequence
  Synthetic sequence.
SEKEKLLEDIADIARKILKLLKEHLDKLRKLLEEIRRLLEEHSRVLRELIERILDALRRKKKLPEEELKRVAERLKELLDRSERRLREITERLKRLLEESERSLEEIKRRIEKLLDDLRKLSKRVDEDELLERLLEVLKRVVDLVREHNELNERILEEVLKLVEELLRFNEEVLKEIADLVRRVVGQDKDLERELKRVKEISRKLEEELKELKERVKRDSEKMNEDLDRLLEDAERRIRKTRE

SEQ ID NO: 26898 - protein, 243 aa, Artificial Sequence; identical to SEQ ID NO: 26897
  Synthetic sequence.

SEQ ID NO: 26899 - protein, 237 aa, Artificial Sequence
  Synthetic sequence.
SEEDKVLEELKRLLEELLRKHEEVLKEIKELLDKIIKKHEESLRRIKKLAEEIKERAKKPTSDEVLEEIERRLRREEEENEKILRELRREIEEARRRSEEILRRLRDKLRRLEERVRDDELLRRAAEIVDRVLKVHDKVIDDLKKILETILKIHKEVVERLSDIIRELLELIKEGRDGKTLTEELKRIEDKLEELIRRSKDELDKIVREAEKIIEESKRRLEKLLRELERIIEDAKR

SEQ ID NO: 26900 - protein, 237 aa, Artificial Sequence; identical to SEQ ID NO: 26899
  Synthetic sequence.

SEQ ID NO: 26901 - protein, 243 aa, Artificial Sequence
  Synthetic sequence.
SELEELVKRIEKTLRDLRRKNEELRKEVEEVEREDRERLERAAEDLERVEKKVEDEVRRRRDKSVVDKIIKDLRELLKKLLDIHADLSRKNLELLERLLRISKESVRELERLLRELLEEIRKAGRISEEELKRLKEEIETLSKRIEDIHRRLETELERLRKENREILERLKEELRRLDEEESRRRPIEKTIEDARRLLEKILKLHRENSEESRRLIEDINRVNRELIDEVAELAKKILRRVEE

SEQ ID NO: 26902 - protein, 243 aa, Artificial Sequence; identical to SEQ ID NO: 26901
  Synthetic sequence.

SEQ ID NO: 26903 - protein, 239 aa, Artificial Sequence
  Synthetic sequence.
RDEELLERVERLLRELLDTNRRKLEEVEKELRRLLETNKKTLDDVRRLLKELLDVLETREVKDEKRLRDIRRRLEEVVRRLDKLHRDIAEDLKRVKERLDRLHERIKRRLEEVVKELRDLKDRGVDERKVLERAAEVLRELLELLRESLEEIERIIRRLLELHKRSTEEAARALEELLRALEESDDLRELKKRIEDLLKEDKERLEKIARDIERDLERYRRDLKRLEDELREDIERARR

SEQ ID NO: 26904 - protein, 239 aa, Artificial Sequence; identical to SEQ ID NO: 26903
  Synthetic sequence.

SEQ ID NO: 26905 - protein, 244 aa, Artificial Sequence
  Synthetic sequence.
REEEVLRRLREIIKRLLDKNRKVNEDLVRLIKRVLDKNREVLKRLRDLIRELLEVVRNKRDDKDVEETVRRLERELEKLERTSEELVKKVKKELKDLLKDSRDVLEEVRKTLDTIVKETQEDEIVKKAKDIAKKLSDAHKKVLDDVRRILEKLVKLHRETLKKIRELLEELVRVVKAVRREKRPDEDLERALKKVKDELERIVRENEDADRKIKEEVDRLSEENEKVNREIKKELDDVVEETKK

SEQ ID NO: 26906 - protein, 244 aa, Artificial Sequence; identical to SEQ ID NO: 26905
  Synthetic sequence.

SEQ ID NO: 26907 - protein, 238 aa, Artificial Sequence
  Synthetic sequence.
EEDERLTKRVEEIKRENRELLRRLEEEVKELERKSEKIVRDLKEKVDRAKEKLDSNKESTELLVEELEKLIREILKLSEDHNRTLEEVVRKIEDVLRRNLERLKELVDEILKALKERKKRDVEELKRKVEKVARDYERLLRKLREVVKRILDESKRLDEELEERLKEVLKKLEELIKEGRPDKDVLTELKRILDELLKLVEKLIRRNLRLLEELLRLVREILRTSNEILEEILKDARR

SEQ ID NO: 26908 - protein, 238 aa, Artificial Sequence; identical to SEQ ID NO: 26907
  Synthetic sequence.

SEQ ID NO: 26909 - protein, 245 aa, Artificial Sequence
  Synthetic sequence.
SELDTLVELIKRILEEITRVNKELVDEVRKLLEEIVRINERSVRTIEKILRDIAELIRRGREDDRVKEDVKRRIEELKREHEEVEKKIREAIRRLEEESKRLEEDVRRMIKRLREEVERRRADEKVRRLLEELRRLLEELLELHKRLLELIREILERVLEVDKRSLDRLTEILERVLRMSDAGRPEEELEKELRRLKKELEEVVRKSREDLERLKKELEKIVKESEDELKKVEEKVKKLADDARR

SEQ ID NO: 26910 - protein, 245 aa, Artificial Sequence; identical to SEQ ID NO: 26909
  Synthetic sequence.

SEQ ID NO: 26911 - protein, 245 aa, Artificial Sequence
  Synthetic sequence.
TEEEVLRKVEKLIKDLLDVLRDLLRASEEVVREALRVLEELIEENKRVIEELSRALSDERRESVERMLRKNEERLKKILEDADRVLDKWRRLLEELSKKAKRVLDEVRKRLEEIKREVPETEKLRTLLTILEEILRRLEKIIRDILRINERLLEKLKRILERLRETNREIDERIRKLVEERRGAEERKLRRDLTETKKELEKRHEDLRRELEKLLRDYKRELEEIERRLEEIEKTLKRRADETRR

SEQ ID NO: 26912 - protein, 245 aa, Artificial Sequence; identical to SEQ ID NO: 26911
  Synthetic sequence.

SEQ ID NO: 26913 - protein, 238 aa, Artificial Sequence
  Synthetic sequence.
SDLERLEKEIRDLLDELRRLTEELEKRSRDILKRLKEILEELKRRIERLLDELRRRRGDTEVLKEVARVLETVLKLLEDVVRELEKLNKELLEANRRLLEEVERIVREVLRVLKEGRDKEELRRVLEKLREDIREVDERIKKINREYRKRVEEIREKLREAIRRAEELIRRIVEKIGSEDDSVRELIEVLKKALEDVRRVLRAIEEIVRRSVELNEKHSRELRRVLKELLELVAKAAE

SEQ ID NO: 26914 - protein, 238 aa, Artificial Sequence; identical to SEQ ID NO: 26913
  Synthetic sequence.

SEQ ID NO: 26915 - protein, 231 aa, Artificial Sequence
  Synthetic sequence.
SEEEELRKLAKKIEEVIKTSRDKLDKSRKELEKVIRDIERRLRELRRELEELVRRGLDEESLREILKRLIREVEEIARTLEELADDSLRKNKENIDEIKRLVEEILKKLEDNNVSEEVLEDVKRRIEELEKEAEEIHRRYKTELDKIKKKIRDILEELKKEVKRIDDEIKAGRDREDVLREIEKLLEEILRALRKLLKDLLDLHDEVLKADEKLLKRLREIVKKVLEEVRK

SEQ ID NO: 26916 - protein, 231 aa, Artificial Sequence; identical to SEQ ID NO: 26915
  Synthetic sequence.

SEQ ID NO: 26917 - protein, 231 aa, Artificial Sequence
  Synthetic sequence.
SEEEKLRELRKRLEDTVRRSKEELEKSTEELKDVIKKSEEKLEELKRRLEEMKRRGISEEAIKEIIRRLLESNRRNLEELRKLLEESLRKNRENLEKIMRLLDEVIRTLEENRVREEVLKEIRDRLREIKERAKEIHKEYKEELERIKERADRIHKEVKEKIEEVERRIEAGTDSEKLLTDAARILDDVVRVDRELLRLVLELHKRLVRADEKLLTDIRELARRVLEETRK

SEQ ID NO: 26918 - protein, 231 aa, Artificial Sequence; identical to SEQ ID NO: 26917
  Synthetic sequence.

SEQ ID NO: 26919 - protein, 236 aa, Artificial Sequence
  Synthetic sequence.
DEDERLRELRDRVRRSEEEDERRNKRHEERVKELEDEDKERNERHRKRLKEITDRLKERNTDDRVREILDELKRVAEEVNEVNERATKELSDLLKTLNDVNREASKLNVEAIERLLKLVKDGSPREEIEKRYRDIVKEIEERYEELLRRAKKILEDIKRKYDRLLERLEKIIDELRKNDIREDLLKVVRDSLEILKELIRTVLKAIEESLRILEELIERLKRHIETILRLAAETTT

SEQ ID NO: 26920 - protein, 236 aa, Artificial Sequence; identical to SEQ ID NO: 26919
  Synthetic sequence.

SEQ ID NO: 26921 - protein, 237 aa, Artificial Sequence
  Synthetic sequence.
DEEELEKEIKKLLEEATKKHEDVKREIKERLEKLRRDHEEAEKRVRDELRRLEEELERRNSDERTREAVELLKEIVKEILELVKRHVEKNAEIVERAIRLLEKHHKENKEIIREIIELLKRVTDRDRIREELKRLLDESEDSVRRILEEVEKLIRESEESVERIRRRLEELLKRLKDRAPDAEDLIRVLKKLIEDLERLLTKNRRLLEEIVKILTKLLKDNRDLLRRILRKVEETAK

SEQ ID NO: 26922 - protein, 237 aa, Artificial Sequence; identical to SEQ ID NO: 26921
  Synthetic sequence.

SEQ ID NO: 26923 - protein, 239 aa, Artificial Sequence
  Synthetic sequence.
DEARRIKEIVDRAVEIWRRLVEEIKRIVKEVLDKWRKLIRELIELVRKALEDLRRTNGAKEDVLRKIEEEAKKIIRDVEDLLKKIADKYKRIIEELEELLRRLTEKYKEIKKELDKGVDKKDVVKRLEELNREVLETVRKVLEDLARLDEDVLRTIAEILKRIAELIKRVLEAVIRDKGKTDELKRLEDDVRKKLKDLEDKLRKLRKELEETHRRLAETIRRIAEELERLHRELKRESK

SEQ ID NO: 26924 - protein, 239 aa, Artificial Sequence; identical to SEQ ID NO: 26923
  Synthetic sequence.

SEQ ID NO: 26925 - protein, 239 aa, Artificial Sequence
  Synthetic sequence.
SKDERLRKVLEDVERLLREVLKKHRKVIDDLRELLKRVVEIHRRVLEEILKRLEEEGIDETVLKRLDDAIKESEDSIRRVEELLEDVLRRSEEKAKRAEEDIRRVIEKLDRLARAGVPIEELVKELERLIDKLLRILREINRELKELLDRVIEILRRNNERLVRLAEDVLRRLRETGRVSDEVVERIRRTLEEIERRLRKTDKDLEKDLRELKKDLDRTDEELKRKVEKLKRELKETSK

SEQ ID NO: 26926 - protein, 239 aa, Artificial Sequence; identical to SEQ ID NO: 26925
  Synthetic sequence.

SEQ ID NO: 26927 - protein, 236 aa, Artificial Sequence
  Synthetic sequence.
DEKDRLEEEVRKLLKEAEDELRRLKRENEKLNRELKETLKRVKEESERLLRKLREDVRKDGTREESIKEVADRSIKLLKELLRILEEVIERSERSLEEVIKMLEDLIRRLEEILRRAGLREESLTKLKKKLEDVLKELRDMAKRYRDELRKIKRELEEAEKRYRKKVDELRRELEKGKPLEEVLEELDRLNKEVLKAIEEAAKKLEDLNRRVLEVLEDILRKLKEIVDEALKVLRK

SEQ ID NO: 26928 - protein, 236 aa, Artificial Sequence; identical to SEQ ID NO: 26927
  Synthetic sequence.

SEQ ID NO: 26929 - protein, 240 aa, Artificial Sequence
  Synthetic sequence.
KEEELLERLREVLKTDLDLLRDLVRTLKEDLDKDARLLEELVERLKKLLDKIKRLLEEEGAVSKDDLKRIEDRLREIKKELEKLLKEYKERLDKIKKELDKLLREYEEALRKLTKEARDLMREGNLREEVLKRISDRNERLIEEMAKKLRDVLRDNKRLVREIVEKLRTVLEDILRLVEEIDIDERVKREIRKDLDKIRREIEKIVKESEESNERSLEKIDRILEESKRRNERLKRELDR

SEQ ID NO: 26930 - protein, 240 aa, Artificial Sequence; identical to SEQ ID NO: 26929
  Synthetic sequence.

SEQ ID NO: 26931 - protein, 234 aa, Artificial Sequence
  Synthetic sequence.
SKKETIRKLIEENKDIIRKLAEKLKRLLEESERIAEEALRLIKELLERIERALRRVAKDIDEELLKELEKELRRLEEELKEILDRVRDLHRRLKEEIRKILEESKKLNEELEDRLRKDEDVEKLLELLERVHATDVRLLRELLKLLKKVHEDVVRLLERLLELLKRVLDRIVEELDLRDKELEKLLEDLEREIRRLKKRLKELSDRLEEKIRKIKRELDDLSRRLREKIERTRK

SEQ ID NO: 26932 - protein, 234 aa, Artificial Sequence; identical to SEQ ID NO: 26931
  Synthetic sequence.

SEQ ID NO: 26933 - protein, 240 aa, Artificial Sequence
  Synthetic sequence.
DDEKRLKDRLREALKRNEELLDRLRRRVEEILDRNRKLLERVRRELERVLKELEDLIRRGAPLEDILRRLREVIKELLELARRILEHNLRLNEELLERVERILKHNLDVVKELLDLVKERKGDTEELKKLLKRLKDLHDEVRKRLEEIERELRKLHRDVREELKKIDRRLEDRLRKVEEENSEDETVLRELVEELERVVRRILELLKRLSDASKRVVEEILELLRRLSEKTAKAVDDTRT

SEQ ID NO: 26934 - protein, 240 aa, Artificial Sequence; identical to SEQ ID NO: 26933
  Synthetic sequence.

SEQ ID NO: 26935 - protein, 235 aa, Artificial Sequence
  Synthetic sequence.
DDERRLETLIRLSRELIERVRKLLRDIIRTSKELIEEVLETVKRILDKIEELAKEVNLPREVLEEIKDELERILKELEDAVRDIERKYERLLTELEKMVREIEKKYKDLLEELEKGLDTKTILEEIKRLHDEVVEAIRRALKALEEIHREVHELIKRILDKLLEVLKKVVKVLEESGLRDEKISRKVEELEKEIRRLIEELKKKNEEVEKKIREIMKELDERSERLRRELDRTRD

SEQ ID NO: 26936 - protein, 235 aa, Artificial Sequence; identical to SEQ ID NO: 26935
  Synthetic sequence.

SEQ ID NO: 26937 - protein, 242 aa, Artificial Sequence
  Synthetic sequence.
SKEDELRKELEEVVKRIEDALRKLKERSKRVAKRVKKLLDDLKKESEEVVESLREKLEKERVPERIVRTLEELIKTNRDTIDELEKVAKKLIKLHEDTLREIERLLRELIRLLREALEANVEDERFLRELEKRLKEVLDELERLLRESEDRLERVIKEIEDKLRESRRKLEEDIERVEREGTTESVRKLLEELRRLHERIIKIIEEILELLRRVHKEVAKDVRRLARELEELVRRLVETLRR

SEQ ID NO: 26938 - protein, 242 aa, Artificial Sequence; identical to SEQ ID NO: 26937
  Synthetic sequence.

SEQ ID NO: 26939 - protein, 240 aa, Artificial Sequence
  Synthetic sequence.
SAEEILDTVAELIKTHLKIVREVLKTVRDLNRRSLDLIRRILERMRRLVERLVRLIRNNGRERELRELLKEIEEDARRLMEELRRLHKEVEDTIRKLIEELRRLNERIKREIERLIKDLRDERVIEVLRRLLDKLRRHAEEVEKALRDNLRLNRELIKRLEEIIKETLKRLEELVREVERDGPVEKRLREVEEEVERRLDTVRRELEEVEKESDRLLEELEKKSEDFERDIRRLLKEAKT

SEQ ID NO: 26940 - protein, 240 aa, Artificial Sequence; identical to SEQ ID NO: 26939
  Synthetic sequence.

SEQ ID NO: 26941 - protein, 237 aa, Artificial Sequence
  Synthetic sequence.
SKREEIEKLLEDLKRDNKRVLDRLREVIKDNEDKNEKAVRDARELLERLKRELEEGNLDERLRDVVRRLLTELEEILKELEETLKRNNDEVRKLVDELRKTSRENLEKLRELVEKVREGTSDKTIRDAKRESEKKLEDIKKRIKEVEDKSRKTVEDIRRRIKEVDDKLRRTLEEVRRRDGDTEALKRLEEVAKELLKLIEEVLKENERSNREILRLIAELVKRNARVNEELLEIARR

SEQ ID NO: 26942 - protein, 237 aa, Artificial Sequence; identical to SEQ ID NO: 26941
  Synthetic sequence.

SEQ ID NO: 26943 - protein, 237 aa, Artificial Sequence
  Synthetic sequence.
EKDDRIREKVKEIERRNDKALDDIRRRVEEIKRENDEVLDRIRKELEDLKKEVEEVAKRTGRVDVLEDAKRALEELLRLIEEILRRSKEVLKRLLELIERALRESKRVLRELIKVIERRRDDKDLEDILRRHEEIVRKIVRELEKILKEHRDIVKKVVEELRKILEDLERRIREKGVDEELKKLLDKLLEDLRRIVKKLEELLKKNDDELRKIVKEVKDLLKRNHDELERIVREARR

SEQ ID NO: 26944 - protein, 237 aa, Artificial Sequence; identical to SEQ ID NO: 26943
  Synthetic sequence.

SEQ ID NO: 26945 - protein, 237 aa, Artificial Sequence
  Synthetic sequence.
SKEEKIERDVDEIRKENEEVLRRIRKKVRDIERENDEILRKIEEDLRRIEKDLERVAKERGRRDVLERLRELARELLELIRKVLEDSKKMLRDVIKLIEEILRLSIRVLDELLEVIRRKEDEDRLRKILEDHEREIRRVARELDRLLREHREIVKEAARRMEELLERIKKDIDERGVDEDLRELLRKVLESLRRIVERVDRTLKDNDRKIEEIVRELKELLKKNNDALRKIVEDAKR

SEQ ID NO: 26946 - protein, 237 aa, Artificial Sequence; identical to SEQ ID NO: 26945
  Synthetic sequence.

SEQ ID NO: 26947 - protein, 237 aa, Artificial Sequence
  Synthetic sequence.
SREEVFELLLDVLRKIVELIKDLAKKNIDVLKKLMELIDELVKINEKSLEDLLRLIREGRDERDIDRLIRENKKKNEEIVERLRRLLKELEERNRKILKEIEELIRELEKELRKKVRGEEVERLLEEIRRVLKELLEKLERESREVLRKAEEILRALERLSERVLKILRDLLDLRRRNERDEKELEDEARRLKKEYRDEVERLKKEIREIIERYKDALRKLEREIEDITRRLKERAD

SEQ ID NO: 26948 - protein, 237 aa, Artificial Sequence; identical to SEQ ID NO: 26947
  Synthetic sequence.

SEQ ID NO: 26949 - protein, 238 aa, Artificial Sequence
  Synthetic sequence.
SKLEDLLRRAEELLKDIVRANERLLEEIRKLLKEIVKANEDLLRKVKRLLEEAVEMAIRERGDKGEELDKIKEDLKRVIEKSRRDARRIEEKLKEVIRESRERLKALREELKRVEEMVRRGELDEDTVLRELEKIIRKLLRVHEDSLEKLIRLIEELNEVDKESLRTLVKLIERLERDIKLREEIVTRVRKKVEELKEEVKRINDEVRKKVRDLEETSKRILERVEDLVRELKERARR

SEQ ID NO: 26950 - protein, 238 aa, Artificial Sequence; identical to SEQ ID NO: 26949
  Synthetic sequence.

SEQ ID NO: 26951 - protein, 238 aa, Artificial Sequence
  Synthetic sequence.
SKEDKARELEKRLRDNLKKLEEVVRELAEVLKRNLEKLRRLAEELLRALKRLLDKLRAGGLPKDELEDLRREVEDVLRRLKDLLRKLKKANDESLTRLEELLRRAEEENRRVLTTLRELLRNNGDDRDLARLVARLVEANNRALEELLRLVAKNVEDNNRVLEELLRLVKELAKRLLARIRDEDLVRDIRRELKELEERARKILRDDERDLRALEKRIRDIIREDREELERLKERARK

SEQ ID NO: 26952 - protein, 238 aa, Artificial Sequence; identical to SEQ ID NO: 26951
  Synthetic sequence.

SEQ ID NO: 26953 - protein, 243 aa, Artificial Sequence
  Synthetic sequence.
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDAEKVSEEDLVEMLKRLIDELRKVLEDVIRVSKELVERLLRALREHLETNKRLVKELLDALRKTTGDDEEIKRLKEELERRHRRLEEEVERVARELEKRHRDLERDIRRVAEELKKLLKKLRDDRR

SEQ ID NO: 26954 - protein, 243 aa, Artificial Sequence; identical to SEQ ID NO: 26953
  Synthetic sequence.

SEQ ID NO: 26955 - protein, 228 aa, Artificial Sequence
  Synthetic sequence.
REKEELSEEIRRRLDELRKLLEEYEEEVKRLLTRLRDKLRRYKEEVERLLRKLKEDNKVDEEVLKLLEDLLKTNLDILEEILRLLEEIIRRNLDILRRLLKLLEELIKEVEKRGGGTEEVKRRAEDVKRKIEELDRRSDEEIKRLEKRIRELNTDSKRRAEEVLRRIEKKGVPKEAVDLVRDVLRRVEKVNRELLELIKEVADRVRERNKELVELIDRLLERLKRADK

SEQ ID NO: 26956 - protein, 228 aa, Artificial Sequence; identical to SEQ ID NO: 26955
  Synthetic sequence.

SEQ ID NO: 26957 - protein, 236 aa, Artificial Sequence
  Synthetic sequence.
SEEETVERLLEEARKRHEEIIKKAKELLDRAREEHERIIREAEKLLEEIKKRVDELVRDGQPAEEVLRDLERVVEEILEVLRRLLDANRRVVDDVLRVLEELLRVNEEVNRRIIETIRLPEEVVEELKEENKRLRDRLDKLVKDLKKTNKEIEDKLRKLAEELKEELERIADRIRKTGTDRKTLLREIEKLLKTLEDILRDLLRLVEKTLKELEEILKDLVDKARENLKRLRERIR

SEQ ID NO: 26958 - protein, 236 aa, Artificial Sequence; identical to SEQ ID NO: 26957
  Synthetic sequence.

SEQ ID NO: 26959 - protein, 234 aa, Artificial Sequence
  Synthetic sequence.
SKEEEIVKEVEKIVEKLLEVNRRALERIEEIVRKNLKVNRELVEEIERIVEELIRTGDVDERVKRELRRRLEKVKEDSERVLKKLEEDLRRVKRRSEDTLRRLREELKRLKEELRDGDRSGDELEEALKKILKKSEEHVRELEEIVRRLLEKSREHLEELVRIAKRLLDEARKRKNVPEEMLRRVLKKIEEVIRRAREEHEKSTRELEEVIKELKKRHEDVTREAKKVIDDLKR

SEQ ID NO: 26960 - protein, 234 aa, Artificial Sequence; identical to SEQ ID NO: 26959
  Synthetic sequence.

SEQ ID NO: 26961 - protein, 239 aa, Artificial Sequence
  Synthetic sequence.
SEKEELKRLLDKLLKELKRLSDELKKTIDKILKILKEVSEEVKRTADELLDAIRRGGVDEEVLREIKREIEEIEKKLRKVNKEIEDEIREIKKKLDEVDDKITKEVEKIKKKLDDDRVDRKEVIKALKEILKEHADVFEDVLRRLKEIIKRHRDVVKEVLEELRKILEKVAEVLKRQGRREDELRKVEEDLKRLEDKLKKLLEDYEKKVRELEETLDDLLRKYEETLRRLEKELEEEER

SEQ ID NO: 26962 - protein, 239 aa, Artificial Sequence; identical to SEQ ID NO: 26961
  Synthetic sequence.

SEQ ID NO: 26963 - protein, 234 aa, Artificial Sequence
  Synthetic sequence.
SRVERLEKLLEEHKRLVEDLIRLLDELAKKHDEDVRRLIERLKELAERLKRLLERSGVEEELLKRVDEAIKRIEDKLRRLEEHIKRVIDDIRRRLEELREHSDRLIEEIRDRLRKRDDEEVLRTIIELLRRNMERVLRLIEEILKLLEENLEVVKRLLEDVLRILKRIAEEIESRLTDKRDVDRIREEIKKLIEDVRREIKRVEDKHKKDIDRVKEKLDRVRDRHEKMAEDSKR

SEQ ID NO: 26964 - protein, 234 aa, Artificial Sequence; identical to SEQ ID NO: 26963
  Synthetic sequence.

SEQ ID NO: 26965 - protein, 241 aa, Artificial Sequence
  Synthetic sequence.
REKEELLRLLKEIAERILDILRKALELLDRVVELDNRTSKELLELSAELVKRILEAVRDGKPEEEIRKTLERVKKESRKIVEKNKRLNEEVLKELEKLVDELRKLLEDIKRKLDELNVPDEVRKVLEDLARLLKEVIDLLRRLLEENSRVSEEIVKLNEEALKTLEELVKRLVDLERKGTSEEEKKRLLDDLRRILREYEERVKKLNDEHKKLEKEIKDKVKRILDEIRRTLDKILKELRK

SEQ ID NO: 26966 - protein, 241 aa, Artificial Sequence; identical to SEQ ID NO: 26965
  Synthetic sequence.

SEQ ID NO: 26967 - protein, 244 aa, Artificial Sequence
  Synthetic sequence.
KDEERLVKKIRDSLRKYEDLLRKLVERIRDLLRRYEEELRKLLTEIEKTLEDVRDVLRRKNVDERAKEVAKRLVEAVKRLIEIVKRILEKTKRVVKKLEDLLRRAAELNRDVVEKILEIIKRKGPEDDFRRIVRRLEELHREVEDAVRKLVEDLKRLHREVVEELADIIRKLDKLLKEVERDIDLGDLLEMLRRLVERLKRLIERVLKLNRELVKKLLELLEEALRRNRRLVEDILKIADEARK

SEQ ID NO: 26968 - protein, 244 aa, Artificial Sequence; identical to SEQ ID NO: 26967
  Synthetic sequence.

SEQ ID NO: 26969 - protein, 236 aa, Artificial Sequence
  Synthetic sequence.
SDEDRKRKKLEDVERRLEKLLREYEEKVRRVLEELRRLLEENKRHVEELEKRLRDRAKKPNDDEVLERAVREVRKHLKDNVETDRKLLEDLKRALEESVRLVEEVLKILKELIDELKSKVPGEEAEKLEDDLRRVVETVRRLLEESKRKLEKVIREVEELNRELKELVDRVADEIRRKRLLEEALERLRRLLEELLRINERIIELIRELLEDNRRILEEILKLIKDLLRRAERIVD

SEQ ID NO: 26970 - protein, 236 aa, Artificial Sequence; identical to SEQ ID NO: 26969
  Synthetic sequence.

SEQ ID NO: 26971 - protein, 242 aa, Artificial Sequence
  Synthetic sequence.
SEEEDLEREKRRLDKYSEDDRRRAEKVLRELEEEVKKSRKRLEDAKRRLDEEVRRNEKLEEEVLRLLKELVKKVTEIHERSLDLLRRAAEKVIRINERSHRELKRIVEEVIRIKRRNGSEEELDKLIRDLRKSLDDVRKTSEKLVKDILEELKRILDESKTLADKLRRDLEKIVEDIDRRNLPEEVLRILKTLVKELEDILRELLKINEDLVRRLERILRELLKSNDNLVKELEKLLEKARR

SEQ ID NO: 26972 - protein, 242 aa, Artificial Sequence; identical to SEQ ID NO: 26971
  Synthetic sequence.

SEQ ID NO: 26973 - protein, 246 aa, Artificial Sequence
  Synthetic sequence.
EKKERIREALERAVRTLEKLLEDDKRELDKARREVRELLRRDKEELDKVVERVERELDRARERLDEDIERMVREVLELLKKHLDEVRRAVDTVLRLLKTHLDIIREIIKRLIDKIRDLLRLVARDGTREKDLKKVEDEVRELVEKLRRDSEKVEEDLRRTAKRVRDLNEEVRRRLDKKRKDVERKPTPRKLEEILRLLEEALRRNSETLEEILRKLEEILKRNRKTLEDLLKLVKEILDEIRERLR

SEQ ID NO: 26974 - protein, 246 aa, Artificial Sequence; identical to SEQ ID NO: 26973
  Synthetic sequence.

SEQ ID NO: 26975 - protein, 247 aa, Artificial Sequence
  Synthetic sequence.
SLTERVLDLARDLIRILLEIHKRALKLIAELVKKLLKIHEDVLKLSEELVEELLEIVARRLPREDLLRALKELLEKIEDVVRDIERRHRDLLREAEEVVEKLKREHEEVKERIERAVKKLAEDGVDKDKLKELVDVLEEILRLSKTTLEELVKALRDVIRKSLEALKENLRILRKIIRELEELERVDEDTLRRVLERIREEVERVKEKHRRLLEELKKLLEELRKRSKDLLEDIKRKVRELEEKTRR

SEQ ID NO: 26976 - protein, 247 aa, Artificial Sequence; identical to SEQ ID NO: 26975
  Synthetic sequence.

SEQ ID NO: 26977 - protein, 237 aa, Artificial Sequence
  Synthetic sequence.
REDEELTKRVEKILRDAERLVRKLHRENREILKTLKRLVEELEKENRKVLKDAEDLVRKERESKEKLLKLAEDLVKRNEEALRELVRLAEELVKRNVRVLEELLKLLTDLLRELKDALRRAGRRREDLDRRIDEARKRIRRELEELRKRHEELLRELKKRVKELADEHRELLDRLRKRDEDARELLKELKRIVKKSLDELRKLLKKLEDIVRESNERLKEVLKKITDLIRKVLEDIR

SEQ ID NO: 26978 - protein, 237 aa, Artificial Sequence; identical to SEQ ID NO: 26977
  Synthetic sequence.

SEQ ID NO: 26979 - protein, 235 aa, Artificial Sequence
  Synthetic sequence.
SEEDKIAEELKETLKRYRDRLEEIRKELEDKLREYEKRLEDLARELEKKLRKLEARDVNVRELLKVLRDVVRAIEKLLRENLKVVEDVLRAVRRILEENLKVVEEILRRVLKILREVKDEERARREIEKIVRKLEEVDKKIEEDVRELKRRLEEANKKLREDLKELKRELERVLRDRNVDEDVRRVVRELLRKLEDILRESEETNKETLEKIDEILKESERTNREVIRKLKETTD

SEQ ID NO: 26980 - protein, 235 aa, Artificial Sequence; identical to SEQ ID NO: 26979
  Synthetic sequence.

SEQ ID NO: 26981 - protein, 244 aa, Artificial Sequence
  Synthetic sequence.
SAEETLRRITEESKRVLEEITKKYEDLERESREVLRKLREDLDRIKRELEDVLTKGKDDKDEVLTVLEKVLDELLKLHRENLRVIKELLRKVLEVDRENLEVLKRLLEKARDLLRRSGRDEKDLKKLEDELRKVKEELEKKHEKSKRDIEDLERELDKVTEEVERLLRKLKEELRRAAENSDEDRERLARLLKKLADKLIRVLEEILKINEELNRKIIKFARENLERNRRVNKKVIEVLREAAR

SEQ ID NO: 26982 - protein, 244 aa, Artificial Sequence; identical to SEQ ID NO: 26981
  Synthetic sequence.

SEQ ID NO: 26983 - protein, 238 aa, Artificial Sequence
  Synthetic sequence.
SEDEKLKKEVDDVLERAKRLLDRLREANEDVLRKAKEDLDRLLKSNREILEELRKIKGLDEIEKIVRELLRENHEVLKRLVKLVKELLDLNLKALKDLMKLVEELIERLKRALRKKVPEEKLRKLDEEVRRIEEKLKKALEESKRIVDEIRRRLKEIEDKSRKIARDIEKELKDTKRAGPLEERVLERLLKALKEHSDELKKVVEELLKLLEEHLREVEKLVRELLADLKRLLDKTRK

SEQ ID NO: 26984 - protein, 238 aa, Artificial Sequence; identical to SEQ ID NO: 26983
  Synthetic sequence.

SEQ ID NO: 26985 - protein, 246 aa, Artificial Sequence
  Synthetic sequence.
SKIEELLTKLAELLKEVIDELRKNLKRLEETVDENLKTMEDLLRKLEEVVREVLDIATKKNPSEEAKRKIDALRKKVEDLVKRIKDILEKDKRDLEKVVRDSEELLRELERKVREVLEEVKKIVRDVKDKDELVKRILDLLKELLDDVKRVIKEHLRLVREVLERNKRSLDELVKIIRELLKAIKEVGLVDDEVRKRLDERAERLEKEVEEVKKENDERAKRSAEEVKKLLDKLDEALRRLEEEVR

SEQ ID NO: 26986 - protein, 246 aa, Artificial Sequence; identical to SEQ ID NO: 26985
  Synthetic sequence.

SEQ ID NO: 26987 - protein, 240 aa, Artificial Sequence
  Synthetic sequence.
SEDDELIKKIKKLAEEIIDEIRKLIEKSKEILKRLLDELRKLIEKSKKLLKETLDKLRKDKREAREDLERVETVIKRAAEEHDRLLKEIDDALKRLEEEHEKLLTDVREVLKEVKKELDELKDKNADRTELLDVLRKALEEAKKVLERLLKLNREAIETLERVLRKLLKLHRDVLARIEEDGLDEEALKELEKKTRDLEDEIRKVKDDVKRRHDELKEEIERVLDELRKVLKRLEDEARK

SEQ ID NO: 26988 - protein, 240 aa, Artificial Sequence; identical to SEQ ID NO: 26987
  Synthetic sequence.

SEQ ID NO: 26989 - protein, 250 aa, Artificial Sequence
  Synthetic sequence.
KTEEILKRVKEILDELAKELRDIIRESLRTIEELLDELRRILEESERTLEELVKTIKDEVKDKEELLRRLKRLLEDLRRKHEELLKRLKEAVDEHRDRLRKILEELERVLKELRKRIEELRRSLDRIREKDVLRKLEEVLRKALEILERLLKKIRESARELLKIIEEVLDRNIKVMEEALKTIKELLKDGPDEVKRRLEEKERRIRTRYEELRRRLRKRVKDYEDKLREIEKKVRRDAERIEEELERAKK

SEQ ID NO: 26990 - protein, 250 aa, Artificial Sequence; identical to SEQ ID NO: 26989
  Synthetic sequence.

SEQ ID NO: 26991 - protein, 239 aa, Artificial Sequence
  Synthetic sequence.
EELEDVLRRIEEVLREIIRLLEEHHDMVRRAVERIKRLLEDHHKKVEDILREIKRRIDKEDVKRTLDDILRRNNETLKRLKEELDRLLKENEDRLRKVTKDLKRLLDKAKELVDRIDSEEVLRRLAEIVERILRTVRKVLRDSIRILERLLRVAREALERSIKSLREILDTVEKALKDGPEKVKKELKDLARKAEKLSEDVRRELEETVKDLRRKSKEVEDRLDKLTEEIRRTLEEKRR

SEQ ID NO: 26992 - protein, 239 aa, Artificial Sequence; identical to SEQ ID NO: 26991
  Synthetic sequence.

SEQ ID NO: 26993 - protein, 231 aa, Artificial Sequence
  Synthetic sequence.
KDEERLTKTAKESLDHNKELLDRIRKKSKEVLDHNKELLDRIREEIKRLLEELDRLKRENRPKERIVEILRKILRTLEELLKRLIESLEENLRVLAKLLEDLIRSLRRNVELIAKDLEEDDELKKLEKEYREIERELRERLKTLEKEYRDLIKKLRESLEKLKRELEKLERDGVEVEEVIKEVKKMLERALEELREVNDRDRRANERALRILEALNEEDKRATKRVLERKK

SEQ ID NO: 26994 - protein, 231 aa, Artificial Sequence; identical to SEQ ID NO: 26993
  Synthetic sequence.

SEQ ID NO: 26995 - protein, 247 aa, Artificial Sequence
  Synthetic sequence.
REKEELLKLIKRVIELLKRVLEEHLRLVEDVIRRLKELLDSNEKIVREVIEDLKRLLDEVRDDKRRLDRIKEKLEEVLERYKRRLEEIKRDLERMLEDYKRELKRIEEDLRRVLEEVERIATRNEKPMEFLIDKLRKILERALRELDKLSKKLDELLKKVLEELEKSNREIDKLLKDVLRRVEEAGAEEDLLRKAKKVITEVREKLKRNLEDVRRVIEDVKRKSRRILEEARRLIEEVERELEKIRK

SEQ ID NO: 26996 - protein, 247 aa, Artificial Sequence; identical to SEQ ID NO: 26995
  Synthetic sequence.

SEQ ID NO: 26997 - protein, 243 aa, Artificial Sequence
  Synthetic sequence.
SKVERILRLIEELLRLLREALRKIHRINEELIRTLEEVLREIHRINEDLNRKLREATGRNDDLDRADTESEKLNRDLRRRNEEVLKRLRESNKRLKEENDRVDKKIKKLLEDLERIVKDRPEALEELVKILEEIIRDIERLLRKNREVHEENIRLIEELLKENIEAHERDLKLIEDLIRRENLPEELKDRVREELDRSRKKLRKLEEEMRRKLKRSREELKKLEEDLRRELKKLREELERIRR

SEQ ID NO: 26998 - protein, 243 aa, Artificial Sequence; identical to SEQ ID NO: 26997
  Synthetic sequence.

SEQ ID NO: 26999 - protein, 236 aa, Artificial Sequence
  Synthetic sequence.
SRKERIKRALEEHIRKLKEITDEVRKTNEELLELTRRILEEAKKANEELVKKIREALDKVKELEEEIRKLIEESERIVEELEERSKELLKRSREEVEEWRRRSEELLRRLEKILRDVKDEKELVERAVKILRDDSRIAKEILRRNLRLIEENLERLKEIIERNLDLLRRLLELLKRAGVDEEALKELEEKLDRYRRKLEDLLRKYAKKLEDYKRKVKKLEEENEELLKRIEKEMEK

SEQ ID NO: 27000 - protein, 236 aa, Artificial Sequence; identical to SEQ ID NO: 26999
  Synthetic sequence.

SEQ ID NO: 27001 - protein, 226 aa, Artificial Sequence
  Synthetic sequence.
SEKEELEKRLRKKLEEIKELVERYKRRLEELLRRHREELKEIEKRLEDLERKIEELDVPERVKKLLRDLIRVLREWLRRSHDLLRRLLEVSKKALEDILRLLEKLLKEIKDLEDEDRLEERIDKVLKDLKRIDDRVREMVKEVLERDDRLARDVKKKVEEVLRELEEAGVSEEVKKIIEELLRLAEEVLRRNKRLIEALLELHEDEFRKVEEIIKELSEEAKRASK

SEQ ID NO: 27002 - protein, 226 aa, Artificial Sequence; identical to SEQ ID NO: 27001
  Synthetic sequence.

SEQ ID NO: 27003 - protein, 238 aa, Artificial Sequence
  Synthetic sequence.
REKEKIREALETNLRLLEELIKRLKEILDTHNELLRRVIETLERLLKELLELLEEAGLEEEVLREVKRLVDELRKEARRVLDEHEKLVRKIKKEAEDVKRESEEIIKEVEDKLEKLDREELLERVRRVLKKSDDLIAELVRRALKILEELTRLLAELLKKVVEILRRIVELVERVLTKKGAPKEDLERLRRKVEELEDRLRRLLEKLKRDSDELMRELERILDRYRRESEELDRRLAE

SEQ ID NO: 27004 - protein, 238 aa, Artificial Sequence; identical to SEQ ID NO: 27003
  Synthetic sequence.

SEQ ID NO: 27005 - protein, 232 aa, Artificial Sequence
  Synthetic sequence.
SELERLRKILDDLRKKVERVAEEHKRANDKLAEEIRRVLKTHREMNERAIEEVKRTVGDDERIREVLKKVLKESEELLREVEELLRRILERSKDLLRELKEILDRVLREVEELLKRNTDSREALKLLEKLLRMLLEVSKRDNRLLEELLKLLRDISKRDHEVLKKLLDEIRRTNTDLREVDKRLRELLEEHKKLVDDLDKRARKVHKEHKDKVDKLREELEKTLRDIKRETD

SEQ ID NO: 27006 - protein, 232 aa, Artificial Sequence; identical to SEQ ID NO: 27005
  Synthetic sequence.

SEQ ID NO: 27007 - protein, 246 aa, Artificial Sequence
  Synthetic sequence.
DSDEIVKTLLEKLRRILKEVEEIARENHKRDRDANREINKLVEDIARRLEEVAERLREVIDERVLKKLKELLDRLREDLKRVDTENEELARRDEKRLEDVIKKIEELLRDLEKKLEEVKRRGEPREDLLRKALEVLKRIVELIDKLIKDHEKSLRDSVELNLRLLRRILEVVERVVELLERVLQGLDEKDLRRLRKDIERLKEEVKRALDELRKKYKKIEDDNRRLVERIRRELKKILDELDEKRQ

SEQ ID NO: 27008 - protein, 246 aa, Artificial Sequence; identical to SEQ ID NO: 27007
  Synthetic sequence.

SEQ ID NO: 27009 - protein, 241 aa, Artificial Sequence
  Synthetic sequence.
SEIEKVLEINRRVLKELERIVKKVLDIDKEAAELLRDIIRRVLEIIKKVIDDIIRTRGEQEDVRRVEDELRRTIKKLKELLDEYEEETRKLEEDLRRELEEVKKRSEEVEERAKSGRDKRDIDDLIRELHRLDRELVKRLRDRIDEVVRRNEELVKRLEDEIRRLERDLERLLREVLRRTKDKDLEEKLRRVLEELKRLVDDLRRLIDEIKKRYERMVEELKKEIERVLRENEEAVKDLER

SEQ ID NO: 27010 - protein, 241 aa, Artificial Sequence; identical to SEQ ID NO: 27009
  Synthetic sequence.

SEQ ID NO: 27011 - protein, 243 aa, Artificial Sequence
  Synthetic sequence.
SEEEELEKIAREVLRELKEILEELDDIYRRVTDRLRKLLERLKKEYEEVKKELEDLKRRKADVKDLLRVLRRLVKVDMEVLDKLLEIVRELSEADKDILRRILEVVEKAVKALKDVLDRAGEPERDVKKKKDDIDKKLEELRRELEDYKRRNDERLKRLEEKIEKYKRDSRKILEDIEREVKRDGPSEELVDRLIKLLDENLKRSEEVIREIIELARKNAEDSRRVIKKIIELLREMLKDARR

SEQ ID NO: 27012 - protein, 243 aa, Artificial Sequence; identical to SEQ ID NO: 27011
  Synthetic sequence.

SEQ ID NO: 27013 - protein, 249 aa, Artificial Sequence
  Synthetic sequence.
DSERELEKVLKDAKEKLDRSLEEVKKVTRETEKRIEEIDKEVKEVLEEADRRVKKIETDKERGDEERLARELTRVVRDIVRRLKDLARKLLEVVRRNAEMNHRINRKNNKVLRDIVRRLEEVMRRRGLDEKRVRELIERLRRLLKELEKEDRRINEEYKRVLREIERKVREVSKTLDKLLRELEERLKKEGLDERLIREIKRIIERVIEILKDIAKEILDLDRESVRLDTEVLKKLLDIIREVVKEAKK

SEQ ID NO: 27014 - protein, 249 aa, Artificial Sequence; identical to SEQ ID NO: 27013
  Synthetic sequence.

SEQ ID NO: 27015 - protein, 249 aa, Artificial Sequence
  Synthetic sequence.
DEEREVRKVLRRAEELLRRSLKKAEEVTRETRKRIKELLDELRKVLERAERELRRIRREKERGDEKKLADELEKVVREIVKRLEEILRKLLEVIRTNMRRNHEINRENLEIVREIVEELKRILEERGLPREDLERLVRKLEDLLRRNEKKDKDINRRYKELVDRLEELVKDITRRLRELLERLKKRIDETGLDDRLIEEIKRILEEIIKLIADLARRVLKIDEESVKLDEDNLREVLKILEDVVRDSER

SEQ ID NO: 27016 - protein, 249 aa, Artificial Sequence; identical to SEQ ID NO: 27015
  Synthetic sequence.

SEQ ID NO: 27017 - protein, 235 aa, Artificial Sequence
  Synthetic sequence.
SEEEEIKKDLERLIDKLRRTSKRLIDDYRRVLEELERTIKRLLEELEELIDELRRRGSLEEKILKVVEDLLRVLKKLLRELLELIERNLELIKRLNEELLRVVEKILKVLAERSTADEDLTRVLKELKEVLDDLVKKHRDSLEELKRVVKRLKDELEKVLRDAKRVLDELKRDGVSEKVERALERILELLKRVIEELERLAEEVLRLSKRVAEENKKLLEEILRILEEIIRRAKK

SEQ ID NO: 27018 - protein, 235 aa, Artificial Sequence; identical to SEQ ID NO: 27017
  Synthetic sequence.

SEQ ID NO: 27019 - protein, 248 aa, Artificial Sequence
  Synthetic sequence.
SKEEELEKLVRKVEEDLKRLEEESERIKKEIKDTLRKIRKRSEDLKRKVKELLRRLEEEARRVRLEEAIKIIKEILDELAKVNEDIIRIIKELLKRLVDTNRRVIETIDRILKKLVDDLRRANLPEDKLREVERELRELKKELEEIVRESEKMLKELEDKLREIVRESRELLEKLRRDLKRIKDGNLRVDEALEMLKRLLDKALKVHEDVLRKLVELVDEVLKVHEESLRKLLTLAKKVLEVLRKITK

SEQ ID NO: 27020 - protein, 248 aa, Artificial Sequence; identical to SEQ ID NO: 27019
  Synthetic sequence.

SEQ ID NO: 27021 - protein, 244 aa, Artificial Sequence
  Synthetic sequence.
DDERRKLEDLERMVEELKRKSDKLLKEIREEVERLERETRKLLEELKRKVDELREDLRRNPEDRVLRKLVKLLEDILDKVRKLLKENLDLLKRLLDIIEKLLRDNVRLLEELLRIVRELMKTKDEEKLTRKLEKALKEVRDAARETRERLKEAKKEVKTVADRNRKRLEELEEEVKRVLDEIRKEKGPSEDLEKAERLVKDILRLNEEHTKELEDVVRDLLRKLEKHTRDLEKLVKDALDKVKT

SEQ ID NO: 27022 - protein, 244 aa, Artificial Sequence; identical to SEQ ID NO: 27021
  Synthetic sequence.

SEQ ID NO: 27023 - protein, 246 aa, Artificial Sequence
  Synthetic sequence.
SEKEELLKRLEDVLRRIKERLDELRRRYKKALDELREESKRLIEKLDKVLREIEELIKRKDRDLKDIVEAIKRLNDEHLETLKEIVKKIMRIDEEVLKKLEDIAREIKEELDRILKTLADEGLPEKKLEDIARLVTEIKEELDRILEKIRKDSTDSNKELKDIIDEVRKLHERLKRELERLAREEKSEEILRLLLELLEESIRVAREVNRLLLRLLEKNKELVEEVLKRLLDLLKKIIDIVREVIT

SEQ ID NO: 27024 - protein, 246 aa, Artificial Sequence; identical to SEQ ID NO: 27023
  Synthetic sequence.

SEQ ID NO: 27025 - protein, 244 aa, Artificial Sequence
  Synthetic sequence.
SKIDEALKKLRKILEDAIKLNKELNDTTREILKEIIKLNREVLEKIRRILKELVDLILKDLKDDEEAKKELKKVLEEVRRRLEEIKKETDRIVKEVEELNERNDREVKRAAEEVRRLLEEIKRSDRDEKELIKKLKEIVDRIREAHRRSVEELSEVVKRILDALKDTLRKLEDVVRKLLELARRIAGDTEELRRVVEKVRKELEDDKERYKRLEEEVRRLLEEMKRRSEDLERKVEEILRRLTE

SEQ ID NO: 27026 - protein, 244 aa, Artificial Sequence; identical to SEQ ID NO: 27025
  Synthetic sequence.

SEQ ID NO: 27027 - protein, 237 aa, Artificial Sequence
  Synthetic sequence.
SEKELLEDLRRKAKEVKDRHEELLRDLERTLKKLKDEHDKKLKDLRDELRRVEKKLDDKERTEALERVKEVLRKLLKLVEDLVRRNKEVIDKLLELVRELIERNKKVLEELLKLVEDLSRKRSEDVERVIRELREILRKLHETNKRILDELRRLLEELERENRKILEEAKRLLEELEKKVDDKELLKEVKDLLRKLEKVVRDSLELLKRLLEDIEKRVRDSNRELKRILDDIEKKAK

SEQ ID NO: 27028 - protein, 237 aa, Artificial Sequence; identical to SEQ ID NO: 27027
  Synthetic sequence.

SEQ ID NO: 27029 - protein, 235 aa, Artificial Sequence
  Synthetic sequence.
DKEEELLKKLEEVLKKAEDLIRESNKALKELLDEAVKIVEDSLRELERTLRDIERKVDKDEVIRRLRELVRELTERNKEALTRLREEFKRLHDENKKILDDLRKLVDELRERVKKTKDSETIIRLISKVLDDLLRLLDELVKRNTEALKKLIKLLEDLVRENKRVLERLVELVKRATGETEDLRETEKDLRRLSEEHKRLLEELRDKARRLTERHEKALKEIEDELRKIKDEARR

SEQ ID NO: 27030 - protein, 235 aa, Artificial Sequence; identical to SEQ ID NO: 27029
  Synthetic sequence.

SEQ ID NO: 27031 - protein, 239 aa, Artificial Sequence
  Synthetic sequence.
DEEEKIREDLERTLREYERELRRAKEELKETLKRYEEELREVKEDLDRTLEEVDDLLRRGELEDREAIRILRELLKKLEEIIRRSKEVLDKLIKDLEDISRRSIEVLEELVKKVRKDGLPEEVLRRIKDLIRRLRERNKEILDRIRKLIEELVERNKRALDRLRKLIKELEERVRRTDDKKTLLRDLKEALKTLIKLIREILEDNLRVLRRIIELIETLLEDNRRVLEEIIKLIEEATT

SEQ ID NO: 27032 - protein, 239 aa, Artificial Sequence; identical to SEQ ID NO: 27031
  Synthetic sequence.

SEQ ID NO: 27033 - protein, 238 aa, Artificial Sequence
  Synthetic sequence.
STKEEVERIVEELRRAHEKSLRDVKKILDDLAKIHDDSLEDARRIIEKLDRILEEIKDRDKSREVVETLTRLLEEIEREIRELVRKNRELLRRITERLKELVRRNEDVDRRVREKVERVPISEELLKLIEELSRTNRRVLEALERLARELLKTNERVLEELKKLLDRLLELVKRITDDGVEDDKLLEDVKEEIRKVKERIEDLLRRSRELLERLRKRLDDLLADSERKIDEVTKRTRK

SEQ ID NO: 27034 - protein, 238 aa, Artificial Sequence; identical to SEQ ID NO: 27033
  Synthetic sequence.

SEQ ID NO: 27035 - protein, 244 aa, Artificial Sequence
  Synthetic sequence.
DELEKVERLLEEIEKIIEDLIRRVEELVRRILEFNKTTLKRNEELVRELEKLVEETTGRTEELKKIVEKLEKLHREVKKKSDDLVKRAEELLKEVKERLKEIVKTIREELRKVKESDRDRKELLKLLAEILDKLLKLLKRIIEELLRILKELIKASKESLDDLKRINEELLRDIEDLIRKKIKEKKEVVRKLEEDLRRVRERSKKLVREHEKFLEDLEETIKEEKRRVDEELKRIKEEIKETRR

SEQ ID NO: 27036 - protein, 244 aa, Artificial Sequence; identical to SEQ ID NO: 27035
  Synthetic sequence.

SEQ ID NO: 27037 - protein, 242 aa, Artificial Sequence
  Synthetic sequence.
SEKERLMRLLDKLKDLNRRLVERIKELLDKALELHKKLVKELRELLERLKELVERAGVPEELLTRIDELIKKLEDEARKISKEVKRLIDELKKRLEDIHREVDRLIRELKETLKRVTDKDELLRRVKEVLERIARLSEELIREVKEVLEKIVELSRELLKRVLDVLRRIAELLEDALRKENVEEETVRRLREALKKLEDDLRKIERDAEREYKKLKDELEELTERYRREIRKLKEELKKDRK

SEQ ID NO: 27038 - protein, 242 aa, Artificial Sequence; identical to SEQ ID NO: 27037
  Synthetic sequence.

SEQ ID NO: 27039 - protein, 243 aa, Artificial Sequence
  Synthetic sequence.
SKREELKELLERLLKLDRDTLEELKRLLDELKKTNDDTLEILKRLLEEVLRVIRETGLPEDILRRAEELIRRLKKKLEEIVRRNEELIRRLREDLKRIHDEIRKLIEDLKRDLDRTKDERTILKLVKEVLERISDLNRKILDSVRRAIEKDVKSNEEILDLVREALERLAKLVEDAVREKIREDKDRVREIERRLEELRKRLEKVERDLRDRHRKVKKKLDDVIEKVKRRHDELRKELEDAER

SEQ ID NO: 27040 - protein, 243 aa, Artificial Sequence; identical to SEQ ID NO: 27039
  Synthetic sequence.

SEQ ID NO: 27041 - protein, 250 aa, Artificial Sequence
  Synthetic sequence.
KDEEEVEKEIRRLLEKVKDVLRRSLEELERLLREIKEVLEKLEREDEENIERIKRELERQLPSEDLLRVVEELIRSNVTLSKRALDEVKRLIRRLVDVSRRALEKAIELIREAVELLERALKRKGLPREEVKRLRDEIKKIEDRLKELLRRYEEEVEKIERRLEELIRRYETEVERIERRLEELRRANLDRETLIREIEKILRRLNELNRRLLREVERILERLLELHKRLLDELLRIAERLMRLVEEVKK

SEQ ID NO: 27042 - protein, 250 aa, Artificial Sequence; identical to SEQ ID NO: 27041
  Synthetic sequence.

SEQ ID NO: 27043 - protein, 247 aa, Artificial Sequence
  Synthetic sequence.
SEAEDLEELIKELAELLKDVIRKLEKINRRLVKILEDIIRRLKEISKEAEEELRKDTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVRKDKDEAERRRRELKDKLDRLREEHEEVKRRLEEELTRLRETHKKIEKELREALKRVRDRST

SEQ ID NO: 27044 - protein, 247 aa, Artificial Sequence; identical to SEQ ID NO: 27043
  Synthetic sequence.

SEQ ID NO: 27045 - protein, 242 aa, Artificial Sequence
  Synthetic sequence.
DEVEKLKKLLKELEELNREVVDTVKKLLDELVKLNRDVLREVRELLKKLIDALEKTGIDDTVRRRLEDIERELEKVLEDSERKLRRIKERLDEVVKESKERLERLREELDRLARSNLPREELLDAIARVLRKILKVHEDALRKIEKLLRDLLRIHRTSLREIERLLRELLEVIRDVLDKRNVDEELRRELKKLEEEIERALERIRRRSEETADRIRRTLEKLREKSERKRREIEDTLRKDRK

SEQ ID NO: 27046 - protein, 242 aa, Artificial Sequence; identical to SEQ ID NO: 27045
  Synthetic sequence.

SEQ ID NO: 27047 - protein, 249 aa, Artificial Sequence
  Synthetic sequence.
SLLEKVKKVIERLLEIHKKLLEELKRLIEKVLRITRENLEEVKRLIKRAVEILRRIAEEKDKDTVEKLIRDLERELEKVLDDSRRLAEELERELEKVLREWEEKSKRAMEELDEVIKRLIKEAGDRSEKLRIVEEIVKDLERADEDVIRKVKELLEEHLRLHRELNRLIKEVLDDLLRALRELAESRTREEEVTRKIEELRKKLTKLIRELEETLKEVKKRNEDALRRLEKESKDLAERVRRLIEELEK

SEQ ID NO: 27048 - protein, 249 aa, Artificial Sequence; identical to SEQ ID NO: 27047
  Synthetic sequence.

SEQ ID NO: 27049 - protein, 240 aa, Artificial Sequence
  Synthetic sequence.
SDKEEIKRRVEKTARDLETEHDKIKKRLEDTVRDIKRELDELLEKYERVLRKIEKTLREGDKDVTDLVDKLLETVKRLNEEVLRTVKKIADELRRLVEEVLRVLRESNETLARLLEEANVRDEVRERLEEVLRRTEEIIKTLEEIVKRLLDELRRLVEELRRISKKLKDELDKIKEKDKDEKRLIEEVVRLLRENLDVVRRILEALAKLIKELLEALEEVLRRNKELIRELLRVLDEALK

SEQ ID NO: 27050 - protein, 240 aa, Artificial Sequence; identical to SEQ ID NO: 27049
  Synthetic sequence.

SEQ ID NO: 27051 - protein, 248 aa, Artificial Sequence
  Synthetic sequence.
DEEERVKKLLTDLRRLLRKLHEESKKLLDELRKKLRELRRRSEEKLREVERRLREAEKKLPETRVLKLVADVVKKVLDAIRDLNRKLEEIIDEALKLLEELDDILRRVVEEALRLLKEIKDTKRDRKEVKKRVEDILKRLEELVKEYEDRVREIKKRLRRALEELRDEYRKIREDIERVLDELRKGGVPEELLRVLEELVRTLKKLLDENLKMVERLIRELEKVLDDHERKVRRLIEELLEVLDRDAK

SEQ ID NO: 27052 - protein, 248 aa, Artificial Sequence; identical to SEQ ID NO: 27051
  Synthetic sequence.

SEQ ID NO: 27053 - protein, 248 aa, Artificial Sequence
  Synthetic sequence.
DEDRIIEEIARLLEELLRELLELIKKLIETNRRLNEEHERAVRELARLLEELLDRLVKKVIEDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIKKEIERELEELRRMIKRLHEDLERKLKESEDELREIERRLEEKIRRLEEKLERKRR

SEQ ID NO: 27054 - protein, 248 aa, Artificial Sequence; identical to SEQ ID NO: 27053
  Synthetic sequence.

SEQ ID NO: 27055 - protein, 251 aa, Artificial Sequence
  Synthetic sequence.
STEEKLRELVKRLEELLRDLERLLRELEKSNRDLNETALRLVEESDKLLEELLEKLARNNVVDEELLRRARKELKRLIEENKKIAKEINDRTEKLVRELRTLLDRLREELKRLIEELKKLLKDGLPDEDLLRDVKRAVEEVLKILRDLLTKVEELDKRNVDLLRKWLEVNRKIVEDVLRILEELLKRDAREDKDTVKRLKEDLDKARKDHEKKLEDLERLLKRNEERLRKMKKELEDKVERLRRELEKKRK

SEQ ID NO: 27056 - protein, 251 aa, Artificial Sequence; identical to SEQ ID NO: 27055
  Synthetic sequence.

SEQ ID NO: 27057 - protein, 251 aa, Artificial Sequence
  Synthetic sequence.
DEEEKIRTTLDLLRKLLKVLREILEELIRSNKELNERLLRLVEDSDRLLEELLKKLEDDNVVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKRAREEEEKVRDTEKKLRDLREKHKEIAKELERLLRENRRRLEELKREAKKVLDELRKRLEDERR

SEQ ID NO: 27058 - protein, 251 aa, Artificial Sequence; identical to SEQ ID NO: 27057
  Synthetic sequence.

SEQ ID NO: 27059 - protein, 240 aa, Artificial Sequence
  Synthetic sequence.
SEKEEVEKRLKDLEEESERLLKEVRDTLKRLEEESKKLIDELRRKLEELRKEVKELVDRGRDVKDLARELLRLLEELLRDLKRVADESARRNEELVKELKRLIDESLKANTDLAEEIKRTDNTDERKLRELERVLEEYRRRIERLKEELDRVLEKWKTEIKKIKKELDDVLRKAEEEVEKNKTVDKALTKVVDDVLRVLERVIERLLRLNKESLKELERILEDLRRLNKKTLDVLREVTR

SEQ ID NO: 27060 - protein, 240 aa, Artificial Sequence; identical to SEQ ID NO: 27059
  Synthetic sequence.

SEQ ID NO: 27061 - protein, 240 aa, Artificial Sequence
  Synthetic sequence.
KEKEEVEKKLKEAEEEHRRLNREVEEDLKRAKRESERLLEEMEKKLDELEERVERLLREGRDVDDLIRELLKRVRDLVRELKKLIDESAKLVRELVKRLKKLADDNLELVRRLVKEIIDRINTTEDIIRELKKVLEKYEKRVREIKKRLDEVLKKWEDEIRKIKEDLDRVTKKIEDDVRKNRNVREVLEKLVRDALRTLREVLDRLRRLNEELLEVLRRVLRELERLTRELLKVLRDALK

SEQ ID NO: 27062 - protein, 240 aa, Artificial Sequence; identical to SEQ ID NO: 27061
  Synthetic sequence.

SEQ ID NO: 27063 - protein, 250 aa, Artificial Sequence
  Synthetic sequence.
SEAEEVARRIKELVRELEKLLRDSEETIKRLIDKNRDLLRRIAETIDKLIKDLRDLLRRIKGEDLLEAIKRAIKTAIDVLDKLLKLDKTTLEELIRVLERNLEEIRRVVEELIEVLRELARRRRVSEEIKRRLEEKVKELRERLERARKRHKDAAKRLRDSARKLEEELRRLADELRKELEELERQGDVKDEDVRRALERVEKLLREILERLKRHSEELAELARRLLDENRRIIEEIIKLIEDILRELKR

SEQ ID NO: 27064 - protein, 250 aa, Artificial Sequence; identical to SEQ ID NO: 27063
  Synthetic sequence.

SEQ ID NO: 27065 - protein, 249 aa, Artificial Sequence
  Synthetic sequence.
DLERLVEELARLLKEALDTLARHSERLIKLAREILETLRRHSERIAELIERILRELMERRGRTEDIERVKKRVEDIIEKNKELLRRIKRRIEELAKKNRKLLDEIRRRLEELIKRLEELLREGRPEEEALRLLAEMVRRALEVLKELLRRDAETVEELLRVLKELLELNERTIRELETILDELVKRAGLPEELKKKLEDISREIKKSLEEVEERLRRISDDVRRSLEELKRILDEIEREIERRLREAKR

SEQ ID NO: 27066 - protein, 249 aa, Artificial Sequence; identical to SEQ ID NO: 27065
  Synthetic sequence.

SEQ ID NO: 27067 - protein, 246 aa, Artificial Sequence
  Synthetic sequence.
SDEERLRKEIRDRVEELRKRLDDTEEEYDKRIRDLRRKIKEVEDRYREKIKRLEEKLRRGELSTELLLEAIARTSEEVNRILEELLREIADLSREVLEKLRRLAKELEDLVEEILRKLLARRDTERIREIVRKLRELVDEVRKRLEDIIRENEELLKKAEEDLKRIVEENEKLIRDAADRIRKIKDKDTVLRILKELMDRDEEILRRILKLIKELLDESKKTVRRVLELLKELLRKILKLVEEITR

SEQ ID NO: 27068 - protein, 246 aa, Artificial Sequence; identical to SEQ ID NO: 27067
  Synthetic sequence.

SEQ ID NO: 27069 - protein, 237 aa, Artificial Sequence
  Synthetic sequence.
SKKEILKEVLRRILKLIRELIETIKKVLKRSLDLNKELIDINKEALDRILKLLTDIGLPEDVLEEIKRAVEKLKKRYEELLKKYKEDLERIKRRLEKLKEEIERKVKKLEELVDTISLEEVLERIDKLVEDVLRTVEEVLEELRKLNKESLDTSREMLRRIKELVKRVIEELERAGIDKRRLKKLADELKEILDRLREKNKEIADRAKELHDEVRERLKEIAKRLKDVLRDARERVR

SEQ ID NO: 27070 - protein, 237 aa, Artificial Sequence; identical to SEQ ID NO: 27069
  Synthetic sequence.

SEQ ID NO: 27071 - protein, 238 aa, Artificial Sequence
  Synthetic sequence.
REMEEVLKRNLDAARRVLETLKRILDRLKELNERSLRSLRDILRELLDIAREVLDLRRAGSSEELKRRTEEKIKKLVKEIDERLEDLLRRYEEEVKKIEETLERLLREYEKLLKKIREEMGDEDEKVKKILEVLERSKKIIKELLEALKKVAKDSLRLNRELVKVIKRVIEEIRRLIREQDDIEKVRKDVEDLAKELEDRLRDVERESRRLLEELRETLERALRRVKELHDELREAIK

SEQ ID NO: 27072 - protein, 238 aa, Artificial Sequence; identical to SEQ ID NO: 27071
  Synthetic sequence.

SEQ ID NO: 27073 - protein, 237 aa, Artificial Sequence
  Synthetic sequence.
SRKEELLRILRRILEIAEEIIRDLKKWLDDDRELVREILELIKRLNEDNNRLIREAGLREEVLKELEDRSEDLKRKLEKLREDYRRELKRIEDKLEELKERLRKVVEDLERLIEKMDDKEVLDELRRLIEEAVRALEEVLKEILELSKTVIERLKDLLEEDKKIVKKVFDMLRRDDKREDELRRLEEALKESKRLVEEVLKRIEDVLRESKKLADEIRKKIEDLVRELEEELERVAR

SEQ ID NO: 27074 - protein, 237 aa, Artificial Sequence; identical to SEQ ID NO: 27073
  Synthetic sequence.

SEQ ID NO: 27075 - protein, 244 aa, Artificial Sequence
  Synthetic sequence.
SKEEKKKELEKKAREIKRRLEENKREYKEKVDRLKEELRRLLEEIREKVKRLEERIRRAIDKEEVVRLLKTILEELLKILEEVLEEIDRLVDENAKAHKRLLDVLKKILEDLLRILEDVERRDKSRELEETVERRIKRLEEKIRKVEEEYRRVVETLKREYKKILDKLEKLAEELKRKIEEVRKRNVLKDLVKELEDVLKELLDLLREILKTVKRVNEDSVRSAEKLIEDLERMIRELLKEARK

SEQ ID NO: 27076 - protein, 244 aa, Artificial Sequence; identical to SEQ ID NO: 27075
  Synthetic sequence.

SEQ ID NO: 27077 - protein, 234 aa, Artificial Sequence
  Synthetic sequence.
DERERIEEDLKRLRDTLDTKEEESRRRIRELEEDLKRKIEESRRRIEKLKRRMEEDGAPGELVEILERAERANERNLKLIAAILDLIKKANEETLREIRRILDEIERVIRELERLDRREDEVRKRLRDILRKIREEIKKIERRNDKVLRDIKELIDRIKTHLKKVLDDVKRLLDEIEPSEILDRLRKVLEELARRDRKILEDLERAVRELDKLDRDILRTLLRVAEELLRRREK

SEQ ID NO: 27078 - protein, 234 aa, Artificial Sequence; identical to SEQ ID NO: 27077
  Synthetic sequence.

SEQ ID NO: 27079 - protein, 252 aa, Artificial Sequence
  Synthetic sequence.
DKLEEILKLLKEVIKTLLRLSEDLNRLNRELVRTVLELLKRVVELLKRVLEEVRKKVRDANTVPDEVIERVARELDRLLKELEDDIRRVAKELEEVHRENEKLLRDVVRDLERLLERLKRELDRNLPEKDLLKTLEDVLRELLKIIARLVELNKRSNRRSTEIIDRIVKSLERVIEELLKIIDKLAKALDDRRDKVERDVRRIKEKIKRILDDLRRRVEELKKKNKEDLEKYDEDIRRLEEEIKRLLEEARR

SEQ ID NO: 27080 - protein, 252 aa, Artificial Sequence; identical to SEQ ID NO: 27079
  Synthetic sequence.

SEQ ID NO: 27081 - protein, 235 aa, Artificial Sequence
  Synthetic sequence.
REEKELLDEIRKRVKESEDRLEKLLRDYEKELRRLEKELRDLKRRIEEKLEELRRRNLDFKELLKTLEDLLREVLEVARRVVETLKELNRRVLEVVREDIERNERLLRRVLDTLRRKGVDERRIKDLERLIRESLKKAEEVLREAAEKSREIVDEIREVLKRADEALKRIIKKIRETRGKDALSRLLEELLRVVDDLIRVLKELIDKSRKVIEELLELLKRINEENLKVLAEIIK

SEQ ID NO: 27082 - protein, 235 aa, Artificial Sequence; identical to SEQ ID NO: 27081
  Synthetic sequence.

SEQ ID NO: 27083 - protein, 242 aa, Artificial Sequence
  Synthetic sequence.
SRKEKLLKESEEEVRRLRRTLEELLRKYREVLERLRKELREIEERVRDVVRRLKEVLDRKELDIDTIIKEVEDLLKTVLDRLRELLDKIRRLTKEAIEVVREIIERIVRHAERVKDELRKEGADKRKLDRVDRLIKENTRHLKEILDRIEDLVRRSEKKLRDIIREVRRLIEELRKKAEEIKKDPDERLVKTLIEDVERVIKRILELITRVAEDNERVLERIIRELTDNLERHLKIVREIVK

SEQ ID NO: 27084 - protein, 242 aa, Artificial Sequence; identical to SEQ ID NO: 27083
  Synthetic sequence.

SEQ ID NO: 27085 - protein, 234 aa, Artificial Sequence
  Synthetic sequence.
SEKEKLREIIKRHLRSVEEVLRLLAKILKDLTDASEENLRLLKELLRRLLEVIRKLVEDVKLDEKILRELEEDIRRLEEELDRLTKELRRKNREALERLRKLVEELRRKHERLERELKDIDKEDILRILADLSRKLKETVEEVLKYLRDHLKEDEDITRRVLDVLRKIVKKIEERARDEDALRKLKKKLEEIEKTVKDSIDKLRELLEELERRVRKIAEENKRLLEELVREVKK

SEQ ID NO: 27086 - protein, 234 aa, Artificial Sequence; identical to SEQ ID NO: 27085
  Synthetic sequence.

SEQ ID NO: 27087 - protein, 235 aa, Artificial Sequence
  Synthetic sequence.
KDEERLEDELRELTERMREKLKEHEERVRELSKEVKRKAEDSEEKLKKDLKEVEDTLRKKSEVDERALRLLRDILRKLIKLHRDVLERLKRILEELEKLDREVIEKHERSIKRLIEVTKRVRDRETARELLKRLLEDNRRALEEHKRELDKILKKLEEVLRDARRRHDDLLRELRENPVTEELLERIERIIRTSKKLLTEALEIIREIIKRSKDSNRDLHRDLEAILRRIEEAKK

SEQ ID NO: 27088 - protein, 235 aa, Artificial Sequence; identical to SEQ ID NO: 27087
  Synthetic sequence.

SEQ ID NO: 27089 - protein, 243 aa, Artificial Sequence
  Synthetic sequence.
SDEERLVAELERLIEISLRILEELLEVLRRLVEESLRLLEELVKVAEEIIERLLRLLEETVKDEDRLREIKEELRKLKEKIKRLVDEVREEHRDLLRKIEDLARRVRKKHKELKDKAKEVTKKVRGRERVLKRLSELVKELEDIHKDVLRELKELIDRLLTINKRVLERIDRLLKELLDLVRRDTGDSERLKKTADEIKKRLDKVRKDSDDLAEEIKRILKRVEDESRDTARKVKKVLEDAKR

SEQ ID NO: 27090 - protein, 243 aa, Artificial Sequence; identical to SEQ ID NO: 27089
  Synthetic sequence.

SEQ ID NO: 27091 - protein, 235 aa, Artificial Sequence
  Synthetic sequence.
SKEDEVLERLKRAIERSIKIVEEIVKRNVETNERSERILRELAETLRRVLDTIRKLLEDKVDEDTLREILERLRRELKELMDKSREELKRNEETLRKLEDESRKEIKTLRDLIKKRIEELEEVKRVVEELIRVHEKVLEDSKDSNRKSVKVHREALKAAEDLLRELDRVLEVATRGDISEEELKRRLEEIERKLKEVLDRLKKKHDDDNKENKDVLDEVRKRHKELLDKLREKRK

SEQ ID NO: 27092 - protein, 235 aa, Artificial Sequence; identical to SEQ ID NO: 27091
  Synthetic sequence.

SEQ ID NO: 27093 - protein, 236 aa, Artificial Sequence
  Synthetic sequence.
DEEEKVLRILEELLKEHKRVLEELLELVRRIIERHKEVLKRVLKLVEDLIRRIKEANREGRELVKKLEELLRELEEALKRSEDELRKILKELEDLIRKSLRDLERLLKELEDIIRENRDEKDLRRVITEVLKRVEKIHRRVLKEIKKVLKKLLDNHRKALEEIARVLKRLAEIVREANLPEEAAKEVEKRLEEVKTDLRRLARESEETLRRVEERLEELKERSERELKRVEEEIRR

SEQ ID NO: 27094 - protein, 236 aa, Artificial Sequence; identical to SEQ ID NO: 27093
  Synthetic sequence.

SEQ ID NO: 27095 - protein, 231 aa, Artificial Sequence
  Synthetic sequence.
SEEEELKRILDENHESLKDLLREIKEILRANHETVKKLLETIKEILDTVLKILRDVGLPEDVLRELEKLVRDIKRKLEEALKRHEEKLRRITKELEDMKRRHEEDLRRIREALKRGEIDKDAIADLLRKSLEIVRAILEKIKKVLEESHKTLRDIVRDIEKVLEDLLDMLREARVPEELLETLKRLIRELVKRLEKILDDDRKLIDRLVRRLEEILKEDKRRIEEALERLR

SEQ ID NO: 27096 - protein, 231 aa, Artificial Sequence; identical to SEQ ID NO: 27095
  Synthetic sequence.

SEQ ID NO: 27097 - protein, 244 aa, Artificial Sequence
  Synthetic sequence.
SELERAEELIKKLLKLHEDVLRRLTEVDDELLEIHDRVLKRLKEVDDELLKLIRDMLRRANISEDLVREVEERLKTLEKRSRDKKRENEKKLRELKKKSEKLRRESRKLLEELRKKVEELRNVDKKDVEKLIKEIVEVHRRMLEKWLRLNEEIAKVHEDSVRDWLKANEEIARTIEEILRRVLRGDEEAKDIREKLERLLRKSEELVRKSLKELKELLDKSKKLLEDSKRRLEEILKEIKDDSR

SEQ ID NO: 27098 - protein, 244 aa, Artificial Sequence; identical to SEQ ID NO: 27097
  Synthetic sequence.

SEQ ID NO: 27099 - protein, 237 aa, Artificial Sequence
  Synthetic sequence.
DEEDEVEKLIREAIELNKRILEEIKELIERIVRRNKEILREAKEAIERLIKIARDLTKDKSDEKTIEDVLREIRKRVKDLEDKLREANKRLKDDLDRLTRKLEDLHRRLKEKVDRTVEKDKDGQELKRVLDEILDVDRETIKELEDILREIHRIDKETIDRLLEILERILRALEEIAREKDEEKLERIARELKKLLEEVERRSRKAIEDLKRELKRVMDRSREAERKLRELLKETKR

SEQ ID NO: 27100 - protein, 237 aa, Artificial Sequence; identical to SEQ ID NO: 27099
  Synthetic sequence.

SEQ ID NO: 27101 - protein, 243 aa, Artificial Sequence
  Synthetic sequence.
SEDEVLKKIEDELREVEKKLEDVLREIKRRHDELKKRLDEKLERLRRRHEELKEALDRGEVDIETVRRVVEENVRTDKRILEEAKKVVEENARTDKKLNDEVRELLKRLVDKLRKTVRSDETKLRDLDRVLEKLKKDLKRVIEETRRVLEEVKEALDRILRESERVLREVEKRLEEIKRSPKREEEVKRDLKRILDRLLEVNTKSIEDLKRILDKLLEVNRRNVDEIRRILDELRKVIERVTK

SEQ ID NO: 27102 - protein, 243 aa, Artificial Sequence; identical to SEQ ID NO: 27101
  Synthetic sequence.

SEQ ID NO: 27103 - protein, 235 aa, Artificial Sequence
  Synthetic sequence.
DETERVKEVLDRSLKLNEDLLRKIDEILKRLFEINKEVIDIIRELLERLVRIAREVLEKNNVPEDKKRELEKILKDVEDELRKYEEELKKKLEDVERRLREYLKRLKETLDRAREILRDTGARREVVKKLIDDSLELVKRLLEEVADDIRESLKRLEDLLRRARRLAEELERLLRELNVREEVEKRIKKLLDDLEKVAREIRKKHKELLEELEKVAREVMDAHRRLLEDLKRTDD

SEQ ID NO: 27104 - protein, 235 aa, Artificial Sequence; identical to SEQ ID NO: 27103
  Synthetic sequence.

SEQ ID NO: 27105 - protein, 244 aa, Artificial Sequence
  Synthetic sequence.
SLKEIVKEIIDRASELLKRLLERSEDSLRTASELLRKILEDSRRSLRTIARLLEELLRTDGPEEELERAARRVKEELERLHKEIRDVIEEIKKTLKKLNEDLREAIERVKRELERLLKELEDSGVPRELLELVKRVVELMAELLDRLLKLNEKILRDIMKILDEILDLNREILRLVKEIIELIRRDGPDREIEKEIRRILEELKRKHDEIEKKIRELEREIKRKHEELEDRIRKIERDLDRRTK

SEQ ID NO: 27106 - protein, 244 aa, Artificial Sequence; identical to SEQ ID NO: 27105
  Synthetic sequence.

SEQ ID NO: 27107 - protein, 244 aa, Artificial Sequence
  Synthetic sequence.
SLRELVEKILRDAAKLIERLLKLSEEVLKRIEELLEELLRLSERSLRELLRLLEELLRSTGPEEELERLADRVRREIDKLNKEVRDALERVKEELKRLHDEVDKVIKEVKETLKELLKRLKEKGIPKDLLKLIEDVLRLVMTILDEIKELNERLLRLIEEIIDRLLELNNRLLEEIKRIIKRIRETGPDKDIKKELDDIVRDVKRKHDKLREELKKIVEDAERAHRDIDRKIREILKELKERTD

SEQ ID NO: 27108 - protein, 244 aa, Artificial Sequence; identical to SEQ ID NO: 27107
  Synthetic sequence.

SEQ ID NO: 27109 - protein, 241 aa, Artificial Sequence
  Synthetic sequence.
REEELRKKIEDELRDLKRKLEDLLRRYEEKLREAEKKLKDLLRRYEERVREIKKELSRNSDEEVVKEIIERLRRSNKELEEMIRELIKILEEASKELEDLVREILEAIRRILKELRDAGALKEKVERDAKKLLDDLRELLERILRESRRLIEELKELLKEVKRRSEELIRTLKEVLDRVKGEDELLRVLEKVIEDNLRIVEELIRRLEEVLKRHEDLVRTLLDLLKRVLEAVKKLLDEAVT

SEQ ID NO: 27110 - protein, 241 aa, Artificial Sequence; identical to SEQ ID NO: 27109
  Synthetic sequence.

SEQ ID NO: 27111 - protein, 242 aa, Artificial Sequence
  Synthetic sequence.
SSEELLKRIVDEDERVLEEWRRVLEEIKDLSKRVVDLLDKVLKEIEKIVDEVTRRLERDGTDDKKKIRDLVEEIKDIIRRAREKLRRIVKENEEILEEAKRRLDKIAEDNRRTLEKVRKELEETKEEREVKRILERVLREAEDSHRRAVELLEELLDRSRRTIEEAIRLIKELLDRILELLKRLGLPKDLLETIKKRVEEIRRTLEKIKRDYDKAIEEIRRKLERKLEEYKEVIDDLRRKTK

SEQ ID NO: 27112 - protein, 242 aa, Artificial Sequence; identical to SEQ ID NO: 27111
  Synthetic sequence.

SEQ ID NO: 27113 - protein, 234 aa, Artificial Sequence
  Synthetic sequence.
SSDELLEEIIKEIARLIEELLEILRENLERSEESLRRVLRAIDDNLRRVERLIEALARGEKREDDVVRDVDDSNKKLEDTLREVVKENEKSNEELKRRLEEVVERVRRLLTELRKREEDEKLEDVLRLVEELLRRLDEILKEHEEDNKRLLDLLRDIVRRHKEEVKRALEVARRKEEPKKAMDEELEKIRRDHERLKKEIEDRLRELKDKHRRAFEELKKMLDDIKRKVDEAKR

SEQ ID NO: 27114 - protein, 234 aa, Artificial Sequence; identical to SEQ ID NO: 27113
  Synthetic sequence.

SEQ ID NO: 27115 - protein, 247 aa, Artificial Sequence
  Synthetic sequence.
DEEEILREILRVAEELSRLNEEVNKRVLEVLERLSRMNEKLLKEVKDVVDRLIELRRRKDLRERELEEELRKLIEELERRLEELERAHRKLVDELRKLLETLKRRHEELARRLRKLLKDVVDEKKRELEEIKRIVEDIERALEESLRISEEIVRTILKALKESLDRIDRVVKEILRLLKELKDSDRDDKEVKRRIEKALRDIEELIERILRRNEEVKREIERLDEENRRRNKEALERIRRLIEETKR

SEQ ID NO: 27116 - protein, 247 aa, Artificial Sequence; identical to SEQ ID NO: 27115
  Synthetic sequence.

SEQ ID NO: 27117 - protein, 247 aa, Artificial Sequence
  Synthetic sequence.
KDEEELKRRVEKVIRDLERKLKDLEEDHRRVLEELKRELEETKRRLDKVIEEIERVLRRNEKPEDFALEEIRRLIEESIKTLRDLLRKLIKLNEDIARALKEIADEIRKLIEEIVKELRKKERDEDKLRKLEEDLKRLLDKVEKVLRDVEKELTDHNRDAKRAIRELEERYEEIEKEIERLRREVRGKERLIRVLEEILRLVLRLHEEVVRLVRRLLEESHRILRKIVELLREILEDLKKILDDIRR

SEQ ID NO: 27118 - protein, 247 aa, Artificial Sequence; identical to SEQ ID NO: 27117
  Synthetic sequence.

SEQ ID NO: 27119 - protein, 233 aa, Artificial Sequence
  Synthetic sequence.
DEEDEIRKRLKELLDDVKRRLDELRRESERLLKEVDDLLRESKKRLEDEKKKLEERGLSEEVKKVLKELERVHDENLKLIRDWLEKHVRINETLLKLIAELLKILEDVMDELTKDRTTKERVERLLRTLEEVLKEVADRIRKLSKKDKEDLDDILRRSKESNERLREVIKRLAEKGVDKEVLERLEKIVRRNEEVNDEVRELVTRLNETSNRAARELLELAKRIIEEIKKAVK

SEQ ID NO: 27120 - protein, 233 aa, Artificial Sequence; identical to SEQ ID NO: 27119
  Synthetic sequence.

SEQ ID NO: 27121 - protein, 235 aa, Artificial Sequence
  Synthetic sequence.
SKLETIKELLERLHELNERAVRELKKTLEDLHRDNARLIEELIRKNERLLEALREKVRDERLLTELTKLNEESIKRLEDILKKNRDLLERIKEDLDRLLKKNEELLRDIKRRLDETNSREEELIRVAEEVLRRDKKSHEELLKIAAEVIKRDKESHDELLKVHRENLELIERVLKESGLSEDADRDVKRLKEESEELLRRSKKRADDLKREVERLLEESRRRLDELLKELKDRSK

SEQ ID NO: 27122 - protein, 235 aa, Artificial Sequence; identical to SEQ ID NO: 27121
  Synthetic sequence.

SEQ ID NO: 27123 - protein, 245 aa, Artificial Sequence
  Synthetic sequence.
SRLEEIKKLLEKVMELIRRIAEELLRINEKVLEVLERIVRTILRLNEEHLKDVRDIARKLKLSDEILRRAEEIVKRSKEELKRLLEEAREIVKKSKRKLEELLKRIEEVVRDAKRKLDENKDSDERTLLEILKRILEELRKLIEELLRIHEESLRRIAKILERILRLNDKSLRDLERIVREAVRERNDDSTEIRKRLKELRDKNEELKKKVEEMIRRLEEESKKTKKRVEEILKRIEEEVREKAR

SEQ ID NO: 27124 - protein, 245 aa, Artificial Sequence; identical to SEQ ID NO: 27123
  Synthetic sequence.

SEQ ID NO: 27125 - protein, 237 aa, Artificial Sequence
  Synthetic sequence.
SREETLRERIERIKRKSEEDVERIKRTLDREREENEETVRRIKETVDRLREEVERELKDDKSLEEIIRRLTELLKKLLEVHEDALRRLDELVERVLRVHEEVLEELKRLLELLEAGLDRKDVRKRLKDILERVRRLHEKLKEELKRILDEYEKKLRELLKELKDILKDAEELLKSQPKSRELDRVEEIIRRIVKKLEEILRDLKRRAEDHIRRLTELIERSLKIVRDLAEDIRRAIE

SEQ ID NO: 27126 - protein, 237 aa, Artificial Sequence; identical to SEQ ID NO: 27125
  Synthetic sequence.

SEQ ID NO: 27127 - protein, 238 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 27128 - protein, 238 aa, Artificial Sequence; identical to SEQ ID NO: 27127
  Synthetic sequence.

SEQ ID NO: 27129 - protein, 238 aa, Artificial Sequence
  Synthetic sequence.
TEKELLEELEEDVKRVIEELERLLREWKEELRRVLEESERLLRELRERNKRELEDIRRIKEDEALRERLKRLLETNDEVNKRHLKLIEELLRRIKEVNRRLLEEIRKLLEKLKEVLDRAGLDEEAKERLERILREVEADLRRYEKELEDLLDKVKKELERTREDSKRLVDEAKKLLEKNKLDLEEVTRILERNLKELERNLRDLDRTVKTNERLLRELLKKLRDIVRTILELLERKTK

SEQ ID NO: 27130 - protein, 238 aa, Artificial Sequence; identical to SEQ ID NO: 27129
  Synthetic sequence.

SEQ ID NO: 27131 - protein, 236 aa, Artificial Sequence
  Synthetic sequence.
SEKEDVRRKLEEDREKHERDLRRIEEELRRTIEESERRLKEVKKRLKELIDDVRRRDSDDRTLLEKIIRDVEKLVRELVEDNRRAIEKVKRLLEEIVKTHRDNIENVRRLLEEKGVPEEVREELRRIVEESERVVRRIEEELEKIVKDSEDAVREIEEDLERVLEKAKRLAEKLKDKEELKKAVETILEELVRIADKLIDIHREILEKLLRVAEKLLEVSRRALDKLKKLIDKTDK

SEQ ID NO: 27132 - protein, 236 aa, Artificial Sequence; identical to SEQ ID NO: 27131
  Synthetic sequence.

SEQ ID NO: 27133 - protein, 231 aa, Artificial Sequence
  Synthetic sequence.
DKAEVLREALKLLKDLLEELIKIHEESLKRILDLIDTLVKVHEDALRKLKELLERSGLDERELRKVERMATESLRTIRKLKEELRDLARRSLEKLREDLKRVDDTLRKVEEKVRRTGPSEELIEELIRTIEKLLKEIVRINEEVLKAVRELLKTLLKLSEDVVRRIEEILRKRNVPEEIDRELKRVVEELRRLHEEIKERLDDVARRSEEELRRIIKKLKEVVKEIRKKLK

SEQ ID NO: 27134 - protein, 231 aa, Artificial Sequence; identical to SEQ ID NO: 27133
  Synthetic sequence.

SEQ ID NO: 27135 - protein, 235 aa, Artificial Sequence
  Synthetic sequence.
REKEEIERTLEELKRILDELVKDDKKSLDRLREIMERSVRIAEETLRKLRETLELKARGEVDEDKLRELAKRLRDDLRRVSREHDEVRKRLKEEHDRLEKKIRDAERRLKTRLDELVKEKGRRIRELEEVLTEASRLLKEILDVNKEILDRAEELLRRNEKVIEEILRAVITLIRRDDDKDEVLKRLDDLIKEWRDVLEKLLRDLRELLERSKKRLRKVREDLKRLLEELERRAD

SEQ ID NO: 27136 - protein, 235 aa, Artificial Sequence; identical to SEQ ID NO: 27135
  Synthetic sequence.

SEQ ID NO: 27137 - protein, 236 aa, Artificial Sequence
  Synthetic sequence.
STREKAKKVLDTLRRDNEDMKRVVEKILRALKRTNERAEKLAREITEEIKRILKEVRVDRELLKEIEDTLKRVLEEIKRLLDESKKLLEDVEREIREILKTSEELLERIEREIETVNRDEKTLKEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 27138 - protein, 236 aa, Artificial Sequence; identical to SEQ ID NO: 27137
  Synthetic sequence.

SEQ ID NO: 27139 - protein, 247 aa, Artificial Sequence
  Synthetic sequence.
DKERVLEDVKRRAKELEELLKEVEDRYEEDLRRIEETLKDTERRYREKLEKIKEELKRTVRRREVLEVIKELLKKLEDNIRELLDAIREALERLRRINKRILDILRRAIEEIKKILDEISRVDEKRELKKIKEEIDKLVDEIRRRLEELEKESEKVVKELEDKLRESVKRSEEIAKEVTDDLRRKNVDEKIKRIVEKIIKEHRDVLERLKRIIEEITRSDRESLERLKEILKELIRILKELADRERK

SEQ ID NO: 27140 - protein, 247 aa, Artificial Sequence; identical to SEQ ID NO: 27139
  Synthetic sequence.

SEQ ID NO: 27141 - protein, 242 aa, Artificial Sequence
  Synthetic sequence.
KSEDVVRELIKLHRELNDKARKVIETILERNRELVETAERVIRRLIKLLEDALRILKKSSTDEDEVRRAEELVRTLKEKAKRVLEEIRKLSKELEEKIRKVLEEINKLSEDLERKIEELTRKVRGEERLLEALTELLKDSIDILRTVLDLLRKLLETSLRILERVLELLKELLDDIREILRRLRLEEEELRRLEEEIRDIVRRLRKRVEEYRKELEDLEKELADEVKKYEDEVKRIREELRK

SEQ ID NO: 27142 - protein, 242 aa, Artificial Sequence; identical to SEQ ID NO: 27141
  Synthetic sequence.

SEQ ID NO: 27143 - protein, 234 aa, Artificial Sequence
  Synthetic sequence.
STEELLREIEEIIRRILEIADKTSKEWADLIKRILELIKRNLEELRKLVREVLEEVRKEGTSDRRVEEDLKRLLERYRRELEKLKEELKKVLDEHKKELKRLKDKLKRLLEELRKRVDDQDKTVLEEVLKEIADVVREITEVNKELARIIEELVKKIAKLSEEVLKTVEELIEELLEDKDTIDKLRKRLKEIKDRTKELLDRIREEIRELRERNKEIVKDIERRLRELKDRIRK

SEQ ID NO: 27144 - protein, 234 aa, Artificial Sequence; identical to SEQ ID NO: 27143
  Synthetic sequence.

SEQ ID NO: 27145 - protein, 243 aa, Artificial Sequence
  Synthetic sequence.
SKKELVREVVKELHELNKDVLRVLTEIVERVKELDKRVLEVLRRIVEEVERLAKEAGLDEDELRKLIEELRRLLKRIEDEVKRLNDELDKKLEELRKESEDLNRELEKTLRDDERKDSREDRVVRDIARILKTVLERNLRKIEEAARILMEYIERVKDLWRRAAELLKEILRRLLKLLKDKVTDKDRLREIEERVRKILEEIDKLLDDLRKAYDRILERIERLVRELSRKHKEVADKITELVK

SEQ ID NO: 27146 - protein, 243 aa, Artificial Sequence; identical to SEQ ID NO: 27145
  Synthetic sequence.

SEQ ID NO: 27147 - protein, 237 aa, Artificial Sequence
  Synthetic sequence.
SEDERVTRLKEELERLLDELRKRYEKLREEIRRVLEDLKKKYDELKEELDKMLRDLERRGKVSEEVLKVLRDVAARIEENLRRNLRLVAEIVRKLEELMKRNLDAIRELIEDVKRLLEIARRVKDERELKRIIEEIRKKIEKLLRESDKEVKDVDRDIKRALEESKKTNEKLLRDIERAGIDEELLRELERVSREDERLVKEAADELRRILDTDRKLLKEVVDTLERVLRRILKETR

SEQ ID NO: 27148 - protein, 237 aa, Artificial Sequence; identical to SEQ ID NO: 27147
  Synthetic sequence.

SEQ ID NO: 27149 - protein, 243 aa, Artificial Sequence
  Synthetic sequence.
SEEERVEELLRRIEKLLKESEEDVERLKKRHEEENRRLKEEVKRLMDELREILRRLEEETGEDRLVDILREIARRLEELLKRILELHDRSARILEELLERDLELLKEIVTEAKRVLEIIKRDGPTEEVKKELERLKKRVDEILKRSKDEVRKWKKAVEDAIRELRKLLKEVKDRVKELIERQRRDKDVDKLVEVLDRVLRRVRELLEELAETNRESIRRYERLSEKNAELVTEIIERLRRTVK

SEQ ID NO: 27150 - protein, 243 aa, Artificial Sequence; identical to SEQ ID NO: 27149
  Synthetic sequence.

SEQ ID NO: 27151 - protein, 247 aa, Artificial Sequence
  Synthetic sequence.
SKMEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLRERREQPNDEKRVEKIKRDLEKKARRVREENERIKRDLKRTADESRKRLEKLLEDLKRELDRLREDLDRARKDIDERVEELIERLIRIIERLLREVIKSHEKLVRTIERLIEESIRVNEELLEVIERLLDRARK

SEQ ID NO: 27152 - protein, 247 aa, Artificial Sequence; identical to SEQ ID NO: 27151
  Synthetic sequence.

SEQ ID NO: 27153 - protein, 243 aa, Artificial Sequence
  Synthetic sequence.
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSQPLDRKKVLEVLDELVTIIAKLLDENIKVLEEVIRVIAELLERLLDSHRRLIDIIAKLLEELRPEDKDLLTELEKKLRKLKRDSEKVVDDLKKELERIKREVKRLIEENRRTLKDIKRAVDEARK

SEQ ID NO: 27154 - protein, 243 aa, Artificial Sequence; identical to SEQ ID NO: 27153
  Synthetic sequence.

SEQ ID NO: 27155 - protein, 245 aa, Artificial Sequence
  Synthetic sequence.
DEDELVEEIERRLREIEKRLRDVMEESKRRLEEILRELKRIIDESRKRLDDLRRRLKDVSEEILRIVEEIIKINEDNLRNARRILEEIIRNNEDLLRKIEELLKEIIKIVRELLKLLKKDGTLDDRILKEVKERADRLRERLKRIEKKHKEDADKIREDLERDERKHEEDAKRIREELDRLRKDIDERIEKILEEILRLSRESLRKLKKILEELLKVSEDSLRDLIRILEDLLRLLKDLLEKLKK

SEQ ID NO: 27156 - protein, 245 aa, Artificial Sequence; identical to SEQ ID NO: 27155
  Synthetic sequence.

SEQ ID NO: 27157 - protein, 235 aa, Artificial Sequence
  Synthetic sequence.
SEDEELEDLKRKLRRALERYEDRLREIKRRLDEKLKEIKRDYDRLKKELDDLLREIERRGVKDELLERALELIKRLLDKSLRLIEEVLRELKRLLDTDLDILRRILEEVARLIDEVRSGSRPGEELVREIKKVLDKVKEDSERNVREIERVLEEVEKRSREIVREAEEVLKEVEDRIGRDEVVKELLDLVREIIKRLKEIHEEILRLIETVLEDLERANRRLLDLARKILEDARK

SEQ ID NO: 27158 - protein, 235 aa, Artificial Sequence; identical to SEQ ID NO: 27157
  Synthetic sequence.

SEQ ID NO: 27159 - protein, 242 aa, Artificial Sequence
  Synthetic sequence.
SKEEKLEDLIRRIKERLEEALRRNKKTADEIRKELKKATDRNRKRAKELRERLREVLRRTKEDKVIKELERVLEEVLRKLERSLEELRKLLDKILKKSEENAKEIKDVLDRILERLRKREEDEESMKRILEDLKRRLEEMAERSRKKIKDLEKEIEDILRRLEELHRKIKRELEELLKRITDETGPSEVVEELLRLLEELLEHNREVIEKLVDLIRELLRHDKEVTEEILRLIEELLKEVEK

SEQ ID NO: 27160 - protein, 242 aa, Artificial Sequence; identical to SEQ ID NO: 27159
  Synthetic sequence.

SEQ ID NO: 27161 - protein, 239 aa, Artificial Sequence
  Synthetic sequence.
SERELIERWLELHKEILRLIRELVERLLKLHREILDTIKKLIRELLELLEDIARKLNLDKEAKDELREIKKRVEDKLEKLERESRKVEEDLKRKLKELTDESDTVEKRVRDVVRRNTQRREEIAEELLRLDRKLLKAVEELLKEILDLNKKLLDDVRRILEETRRVLEKLLDRVRRRERTDDERRTLTELLKRMEDILEKVERTLKKLLDDSKRMAEEVKKTLKELLERSEKVAEDVRK

SEQ ID NO: 27162 - protein, 239 aa, Artificial Sequence; identical to SEQ ID NO: 27161
  Synthetic sequence.

SEQ ID NO: 27163 - protein, 233 aa, Artificial Sequence
  Synthetic sequence.
SEDELIRRIREELKRLEKEHEDMVRELEKKHKKLKEELDRAIEEIERRLRELKERVEREGNGLEVLKKVLDALRKLLEDLREILKRLVDANRELIKENHKILKKLVELLERLLKLLKDGVPREEIRKEIKKISDDIRRLHRDLERRSKKLDDDLKKELDEIKKRAEDLLRKLKEDGLDDELVKEIKRLLEELLRLLERLVRSSRRLNEELLRLSEKLIRDAERLARELLEAAR

SEQ ID NO: 27164 - protein, 233 aa, Artificial Sequence; identical to SEQ ID NO: 27163
  Synthetic sequence.

SEQ ID NO: 27165 - protein, 241 aa, Artificial Sequence
  Synthetic sequence.
KKEEDLRREVEEVKEEIRELIERSRESVRRILKEIKDLIRKSKESIDKILEDLKRKNLDETLIRAVEKLLRENLELLKKLLETVKELLERNEELLKRLVEEAERILEELLEVARRREDEKALERVVREVEKELKRLDDELKKALKDSEEELKRLEDELRRAKEENEKTLKKLRDDLRREGRDEEVLRVVEELLKLLKEHLEENVRILRRILELLRRHHDTNRKIVKRILELLRRVLESIRK

SEQ ID NO: 27166 - protein, 241 aa, Artificial Sequence; identical to SEQ ID NO: 27165
  Synthetic sequence.

SEQ ID NO: 27167 - protein, 241 aa, Artificial Sequence
  Synthetic sequence.
SVEEILRELLRVLEEILKRIADINEKLLRVSRKIVEDLKRLLDEALRVLRRAVEEIEKEGRDEKEKEKMRRVLEKLTKEVEDLKKKIEDVLRETEELSRRLKEELKDILRRLAKAVEDIERRRLDKEKVKKLLEDILREIERVIRESLRLAEEDVRKLEEIIKEILDLIERAIRIVEEEAGRDERLREILEELERVLEKVMRDLRRILREYEEVLKEAREEYRKILEELRKVLKEVDDRLR

SEQ ID NO: 27168 - protein, 241 aa, Artificial Sequence; identical to SEQ ID NO: 27167
  Synthetic sequence.

SEQ ID NO: 27169 - protein, 243 aa, Artificial Sequence
  Synthetic sequence.
SELEKIDRLLEKVLRENKRALDELVRLLEELIKTNRDALEKLREINERNIERLREEVKDVSERVKEELKRVAEESRRLIKKLKEDSEKTVRELRKLIEELRKRSKETIDRLRELIKRVREKGRRDKEAVKRLVDIHRRNLELLEDVVRKLLKLHEENLRLLEEAVRRILELDKKVLDKLRKDLDKKVLEDLERHLEESKKTVERLVRELRKTHRKVEEDVKRLIEELRRLHEELRKRLEDDDR

SEQ ID NO: 27170 - protein, 243 aa, Artificial Sequence; identical to SEQ ID NO: 27169
  Synthetic sequence.

SEQ ID NO: 27171 - protein, 243 aa, Artificial Sequence
  Synthetic sequence.
REKEELIKLIRDILEKLREHSRTIVELLETILRVVREHSKRIEKLLRELLDILRRQTLRDEELRKMLEDVERDIRESLKRLEELLRDIKRRIDESLRELEERLKELEKRIEELARRANKDITTAKRLLDVLKTLLKLNKESIERLLKVLEKLLKDDAESIKRLLDVIRELLKELKDVEEKRRPEKEVEDLLRKAVEDIEKLIRENEKLLEDVLRTIRKLIRENEELLRDIVEKIKRLADEARK

SEQ ID NO: 27172 - protein, 243 aa, Artificial Sequence; identical to SEQ ID NO: 27171
  Synthetic sequence.

SEQ ID NO: 27173 - protein, 247 aa, Artificial Sequence
  Synthetic sequence.
SEEEEVKKVVDEIKKVLDELRKANEDSARRLREVLEELRKRNEESKKEVKDLLEELKRVKRDEELRRVAETLLDVNRRNLEINVKVLRELIRISEDNLRINDEVAKRILDLVRELLKELEKAGLSREEIEKRLRDLEKKVKELKERATKLHKELDDALKETKKRVKKMHDDVRKKVKELRELSKDKDTDTKVKELIEIVDELLEIDDRILEEIERTVRKVIDLNRKVLEDIEELVKEAIKVLEEIAK

SEQ ID NO: 27174 - protein, 247 aa, Artificial Sequence; identical to SEQ ID NO: 27173
  Synthetic sequence.

SEQ ID NO: 27175 - protein, 233 aa, Artificial Sequence
  Synthetic sequence.
DEEEELRELKERIERTIEKLKEDTKKLKKELEDRIRELKRKTKELLDDMKRLIKEVKDKGDRDEALEELAKVSEDNLRINDEVLEELVELAKRLLKLNVDVLDELRRLVEEILKARKDGKDRSDLERVVKELREILDKLRKDNERVVKRLKEVLDELRRRNEESVRRLEEILRDRNLNEDIIRLVRDLIRLNREHLRDLEEAVREIIKLLREHLERLERVVDRMIRELRKAAK

SEQ ID NO: 27176 - protein, 233 aa, Artificial Sequence; identical to SEQ ID NO: 27175
  Synthetic sequence.

SEQ ID NO: 27177 - protein, 241 aa, Artificial Sequence
  Synthetic sequence.
SEEEELDKLRRELEELAKESTREVKELLRELREMLERHKKRLKEIKDKLDEDIKREDSKKDMVEEAVKVLRDILRRHKEVVEELAKVLEKIAEILERLHRRNLKLNREILKRLRDDPRGERLREELDRLVRRLEESNDEIRKALEDLVRELRELLKRIEDDHRELARRLEELLKRIIDRDGRTDELERLKDLLRTLIKKLEDLLENLRRLVERVIESLRRLVEKDEEINKRTIKELRRAIE

SEQ ID NO: 27178 - protein, 241 aa, Artificial Sequence; identical to SEQ ID NO: 27177
  Synthetic sequence.

SEQ ID NO: 27179 - protein, 243 aa, Artificial Sequence
  Synthetic sequence.
DEERIVDKILKVIRESAEALRKIVEDVLRVLEELMRRHKKNVEELDTIVEDLLRKVRERVDKDELERLKREKEKDRERVREIVDKYRKVLEELKERLERVLEDYRRKLKEVEKKVKEIRDRKDEKDEKTVVDEIRKLVEELLTLDRKVLEDLRRLAEEALRKDREVSELLRDLLRRIEEKLTSTRVEEEVLREARRRIREVERHNKKVHDDARKRLRDLVEELKRLHRELEEKLRRIIEEIDR

SEQ ID NO: 27180 - protein, 243 aa, Artificial Sequence; identical to SEQ ID NO: 27179
  Synthetic sequence.

SEQ ID NO: 27181 - protein, 242 aa, Artificial Sequence
  Synthetic sequence.
SEDEKVRKLLRDLAEEIKRLLETYDRKLKEIAKRIEDTLREYRERLEELKRRLEELVRKKNKDMTVIEEIDKLVRETLRRLEEIIDRILKLVKENAKLLEDIARRILDLIKKLLEILEEGRDRKEVRKAVEDVLRDVEKKLKDLLKHTEDSVTRVERLLKELKDRTKKILDDIKRRLDEEAKVEELVREIRRTLETILRLNEELLKRIRDVLREIIELNREVIERLREILERLADLIRRRAE

SEQ ID NO: 27182 - protein, 242 aa, Artificial Sequence; identical to SEQ ID NO: 27181
  Synthetic sequence.

SEQ ID NO: 27183 - protein, 245 aa, Artificial Sequence
  Synthetic sequence.
SELEKLARLLEEILELLRELHRKTAEALKEILELLDRHLDDLRRAVKEILEDLDKDLEDERRRELEEKVERVKETLKELLERLRKRNEDVKRELERILRENEKRLEDVKKTLEDVLRRLADLVRRGKGEEELKRVLEELLKLVKEVLDVNRRSVERLLELARRLIEENEKVLRELLELVRRVLEELLRDDDKAKKVREKLEELLRRLKEKNDDLRRKLERLARELEKLHEEVKKRLKELEDEARR

SEQ ID NO: 27184 - protein, 245 aa, Artificial Sequence; identical to SEQ ID NO: 27183
  Synthetic sequence.

SEQ ID NO: 27185 - protein, 245 aa, Artificial Sequence
  Synthetic sequence.
RELEKLAEVLERIVRALETHLKLIADVLREILRLLDEHLKIIKKVVRDILRELDEVLRRRDDETLERTLERMKRRLEEVLDRLEKENERVKKELRERLERLARENEEVIERLKKLLDELRKARENGKDESVLRRVLEEVLRLVKELIDRNREVLEELLKLAETLLRINTDVLRKLLELVEEILRRLVDDSDTLEKLRRRLEDRRRKLKEANDRVREVLDRLRKELEEIDKRLEDVLKKLREDLER

SEQ ID NO: 27186 - protein, 245 aa, Artificial Sequence; identical to SEQ ID NO: 27185
  Synthetic sequence.

SEQ ID NO: 27187 - protein, 241 aa, Artificial Sequence
  Synthetic sequence.
SKKELLEEVVRRAIELLKRHLEKLKRILEEIVRLLEEHLEKVERVLEAILRLLDDLLRRVTDERLIRTLEDVKRRLREILERLADENRKAIKRLRDLLDKLEKRNKEAIERLEEILEELKRVRRDEELLRVLETLLKIIEDILRENTKVLEDLLRLVEEILERNLRVVEELLRLAREILTEIVTDKDKLKEIEDELRRLLEELRRLDKKIKDRLRELKKDLDEANRRIKETLKKLLREVEK

SEQ ID NO: 27188 - protein, 241 aa, Artificial Sequence; identical to SEQ ID NO: 27187
  Synthetic sequence.

SEQ ID NO: 27189 - protein, 238 aa, Artificial Sequence
  Synthetic sequence.
SDLEELEKLIRRLLKINEDLIRIIEDLIRKSLTLLKRIVDLIRELIREIEEIIRRTNIPKELVDEAREKIKRILDEVERLLRELKKRHREILEELRKNLERVRRELKKILDRLRDLKRKNAREEEIRKLIEELLKVHKESLDSIRRLIEKLLRVHETALRRLAELIRRLLEVLKEVLDKVPVSEEIRKRVRDLEEKVKKLLRDLEEESRRVAEKVEEDLKRVEEESRRTAREVEEKER

SEQ ID NO: 27190 - protein, 238 aa, Artificial Sequence; identical to SEQ ID NO: 27189
  Synthetic sequence.

SEQ ID NO: 27191 - protein, 244 aa, Artificial Sequence
  Synthetic sequence.
SKEERADELLKDLERKVDKLRREHEELLKELKRKVDELRKEHKKLLDTLREEVRRIEEKVKEEEELRKVIRELLELLERNVKKNIDVIETLLRLLEDLVRVNVKVLKEIVDELKKIVEAIKRGEDRSEVDRAIKRLEDILEKLARENKRVMDELRKLLRTLREENKRSIRALEELLERLRRRVKSEDVLREITRLLEKAKRIIEESLREITELVKEIEKIIKESLDAARRLLEEIKKILEELAR

SEQ ID NO: 27192 - protein, 244 aa, Artificial Sequence; identical to SEQ ID NO: 27191
  Synthetic sequence.

SEQ ID NO: 27193 - protein, 241 aa, Artificial Sequence
  Synthetic sequence.
SIEELARKLVKENRRLATEANKILKDIVKTNRDSIRKVREILKELVERLRDLIRKVRRDGDDDERKLEEIVRELEKRLEEIKRKLDKVVKESEDLIKEIEDKIRELDKRSEDKLREIEERLKDSGRESVEKVLTELLKVHEDHLRELIKVLDELLRLNDESVRKLKELVEELLRVAEDVVRKIKVDEDLKRELERAKRELERLLRELDEEHERMKKKVKDEIRRLKKESEEVKKEVKDTED

SEQ ID NO: 27194 - protein, 241 aa, Artificial Sequence; identical to SEQ ID NO: 27193
  Synthetic sequence.

SEQ ID NO: 27195 - protein, 239 aa, Artificial Sequence
  Synthetic sequence.
DEEEITRKLEETIRRLEEEIDKIIKDLLRMLEENNKEIKKVIEKVLETSRRILSALARNVSEEELDRILKEYKELLDRLRERSEELKKEDERLVRDIRRTLKELLDRLKELVDRLIEERGRTKLVELIDKLLKVLEEALREIKRVIDELNTVNRDANRRILEVLDKNLELVKRIIDLAKERRTEEVLREAEKRIRDSAEEVKRILEEHKERLRELVKKLERVKETVRKKIEELREEAKR

SEQ ID NO: 27196 - protein, 239 aa, Artificial Sequence; identical to SEQ ID NO: 27195
  Synthetic sequence.

SEQ ID NO: 27197 - protein, 232 aa, Artificial Sequence
  Synthetic sequence.
SELEKDLKDAEEIIKELEEINKRLLEEIRRIVERITKINRDLLETVKRLIEELIKEDSVDEKVVREIEEELRRIKEESKKVEKDIRELLRRITKKSEEVAKRLRELLEELRRANKPKDDLLREILEVLETALRMLEESLKELRRVLEELLKASKRTLEKVKEVLKRLLEKARKGVDEERLKEIEERIRRTEEDVKRKHDDVRRELDEEDDRYKRELDKVRKKLKEKADRIRD

SEQ ID NO: 27198 - protein, 232 aa, Artificial Sequence; identical to SEQ ID NO: 27197
  Synthetic sequence.

SEQ ID NO: 27199 - protein, 232 aa, Artificial Sequence
  Synthetic sequence.
SKLEDLLRKVEEIIKEIERINEELLKRVAEIVETLLRENKKLLEEIKEILKRLIEDGSVDEEVVRKLEREVTEIEKKSKKVADDIRRKLRKLIEESREVVRDIKRKLEELKRANKPKDDLLRDILRVIKRLLERSAEIVKRVEDVLEELLKLLKETLDELLEVLKRVLDEVRKNVDERKLDKIRKDLERVVREYEEKLKEVRKRLRELVERVKEKHKRIEEELRKTAKEVRD

SEQ ID NO: 27200 - protein, 232 aa, Artificial Sequence; identical to SEQ ID NO: 27199
  Synthetic sequence.

SEQ ID NO: 27201 - protein, 242 aa, Artificial Sequence
  Synthetic sequence.
SSKELVEKLKELIKDHLRVADEVIKKLEELIRRHLRKVEEIARRLEELIRELADELRRAGIDEKELDKIRKEIEKVLRELKRLLEELRRDHERVLKELEREVKRLRDDHRRILKELDDLLRRGLDKKELLERVRELAERLNKLVEDILRRVEELLRELSKKVKELLKRVERLLREILKLIRDAGGDRRRLDRLEEKVEKDLRKLARELEDVNRRLEEELRRLEKRSEDLNRRIREEIKKDAK

SEQ ID NO: 27202 - protein, 242 aa, Artificial Sequence; identical to SEQ ID NO: 27201
  Synthetic sequence.

SEQ ID NO: 27203 - protein, 238 aa, Artificial Sequence
  Synthetic sequence.
KDDEILRKLLEILERLLKLSEEVLRELLRLLEELLRLSKESLKRLSRLLEEALKTLVEEEGREDETLERLERELRRVERKYKEDLDDILRKAKRLLEEAERLHREIRDRLRKAAEKKDEGDRDELIRRIIRLVRELTKINDELLKRVEDILRELAKLNEELIRTIKELLDRLVEKLVRRERLKAVVDRIEKAIKKVTEDSRRLVKRIETELRELVKRSKDLAREVEKRLKEVVEEAKR

SEQ ID NO: 27204 - protein, 238 aa, Artificial Sequence; identical to SEQ ID NO: 27203
  Synthetic sequence.

SEQ ID NO: 27205 - protein, 242 aa, Artificial Sequence
  Synthetic sequence.
SDLERILDKVTKLAEDAKKLAKKSVDLHRDNIRRLKTTLKRILESLRKAIKRLKDALRRGPRSERVDTLIRRIDKLIKELEDEVREIERRIDELSRRLEEKYKEVIKRIDKLVKDLRDLARRGVDRKDLVREILRILREIIETLRRLDEEVLKVNEEILDLIEELVRSILKVLEEILRLLVEETGPSEELEELKRDLDRLFEKIRTDLKRLRDTNRKLFDDLRKEHEAVEDKVRRVAEELTK

SEQ ID NO: 27206 - protein, 242 aa, Artificial Sequence; identical to SEQ ID NO: 27205
  Synthetic sequence.

SEQ ID NO: 27207 - protein, 232 aa, Artificial Sequence
  Synthetic sequence.
SEEDLVREVLRAIKRILELLTTLSKENLEVVKRIIEDLERVARENLRVIEEIIKKINVDEEMKKELDKELKRLEDEHRKAIRELEELLEEHKRRLEEIRRRVDKELEDIKRANLPIEDLLKVIDDVVRKLLRLVKEDLESLRRIVRKLEELLKKNLKLLRDVLRKLEDIARKKNVDERIIEEIRRTATEVLKRNEAVVKKIRELIKRVTERNRKVLEEIKELVKRIKDELRR

SEQ ID NO: 27208 - protein, 232 aa, Artificial Sequence; identical to SEQ ID NO: 27207
  Synthetic sequence.

SEQ ID NO: 27209 - protein, 237 aa, Artificial Sequence
  Synthetic sequence.
DKEREIDDIAEKLRRKYKKLREDLDRIEEELRERYERLKRKLDELARRLTKKARDENSDKKAVEELEKMIKELLDRLRKLIEDNLRVVEEIIKLIRELIDRDVEVVEELLDILKKVRTEEMVERIERRIEELLKETERLLKEVLDRAKKLHRDSEELVERVERRIKELTDEIKRLIEENKVDERLEELLKEVVETLRRLLEELKRLSEEVLKKAKEVIDRIRRLSEEVVKSLRDAAK

SEQ ID NO: 27210 - protein, 237 aa, Artificial Sequence; identical to SEQ ID NO: 27209
  Synthetic sequence.

SEQ ID NO: 27211 - protein, 242 aa, Artificial Sequence
  Synthetic sequence.
SEEEELDKLLKEYERVVREIEEKLDRVKRDIERLVEEITRDLRRVLEEYRKVVEELAKDEGDTSEILDTDMKIVEDLLRLLKEILDKILKLIEDALRVLKEVLKRDTDIVRRIIEILRRGVSEKDLKEILDRWEEENKKLLEEIKKILDKVRDDVRKLVEEVRKALEDWKRTLEDLLRKEGQESDTARRIERLSREVIKKLEKALKELEDLVREVLRRLKEAVEEIHKLSRDVIKMLTDATR

SEQ ID NO: 27212 - protein, 242 aa, Artificial Sequence; identical to SEQ ID NO: 27211
  Synthetic sequence.

SEQ ID NO: 27213 - protein, 246 aa, Artificial Sequence
  Synthetic sequence.
DDEERLKKVKEEIEEKAKRLKEDLERALKRYEDIIKKLEDDNRKVLERIRRKVEELKKNRVTSKDIEKALREIIEEIKRLNRENVKEIRRLNEEVKELLDRILRALEEIIREITDLLDKSVKDEEKLRKIKEKLEKVLREIEKDVRDLKRKHDELLKRVDDISRKIEEDLDRVAEKIRRILSKPVDDELIRKALEELLRIAEEILRRDLRLLEENRRVVKESLDVLAELLERLLELLERILREVRK

SEQ ID NO: 27214 - protein, 246 aa, Artificial Sequence; identical to SEQ ID NO: 27213
  Synthetic sequence.

SEQ ID NO: 27215 - protein, 234 aa, Artificial Sequence
  Synthetic sequence.
SERDVLRELLERIKKLLETLIRIVEELVRRSEETIKRLAELNRRLIEEIRRIVEEVKKDVEEEILRDVERLLKELADETEKILREVKKRLDDNLKRLEEIVRDVERLLKELKEEVDRGDKSKEELVREILKVAEEILRKIEELVKHHLDLNRDILRLFTESAEKLEEILREVLRKLRLDEEVKKRVEELRREYRETLKRLRDESEKIAEELKRLLDELRRRLEELARELRERTK

SEQ ID NO: 27216 - protein, 234 aa, Artificial Sequence; identical to SEQ ID NO: 27215
  Synthetic sequence.

SEQ ID NO: 27217 - protein, 235 aa, Artificial Sequence
  Synthetic sequence.
TEEEIIKEIVKLLRDLARLHEEVDRTNKRLLDELVRLHREVDERLTRLAEDLIRLAEKGASDDEIRELLKRIADELERLKKELEEINKRHRDEVERLKEELRRLNEEIKRRVEELKKDLREEAVRILEEILEMLRRISEKNLRVNDKIHETIERISRTNLKVLDDILRALEELAKAKLDRKDLRKVVEELRRRIEELNRRHDKLAEDLRREIEELNKEHKRMLRELEKKIEDDRR

SEQ ID NO: 27218 - protein, 235 aa, Artificial Sequence; identical to SEQ ID NO: 27217
  Synthetic sequence.

SEQ ID NO: 27219 - protein, 240 aa, Artificial Sequence
  Synthetic sequence.
DAEEILKEIHEIDKRTIDEIRKILKKLLEADKKSIDDIRRILKKLLEIVKRLIDLLRRVRRDEEVKEVVKEVERRLRELREEVKRVVKDSEDKVKRLREDMDRVVEESERLARELREKLKKKRVPEDVLRLVEEIIKLNREVLKEVRELLEDIVRVNREVLREARELLEELARTLRKLLRDRSDDKTLKKILDELRRKVKETDDRLRKLHEDLKRKVKELIDRLERLNEDIARLLKETRD

SEQ ID NO: 27220 - protein, 240 aa, Artificial Sequence; identical to SEQ ID NO: 27219
  Synthetic sequence.

SEQ ID NO: 27221 - protein, 236 aa, Artificial Sequence
  Synthetic sequence.
KTEELLRELIKVLKETLDRLKRVLEKLAETNDKSLKELLKLLEELLKAIRDVLRRILDDKDVMRDVERRLREILERLREEIDRYREELKRLLDEVKKTLDEYEKRVREVLEEIKKRGLTDELIRKLAKENEELVREIERIIKENRDANEELLRRALEILKRLLDLLKRVLEEVVARRGRRVDEVVEELEKVARELADKLRRVLKESEDVVKRVKDELREVLDRSKKVLEELKKKRK

SEQ ID NO: 27222 - protein, 236 aa, Artificial Sequence; identical to SEQ ID NO: 27221
  Synthetic sequence.

SEQ ID NO: 27223 - protein, 241 aa, Artificial Sequence
  Synthetic sequence.
SKEELVKEIDELNKRVNDLLEELLRKSEKLHKEILELLERLLREIIKLLRRILEIVERRLEDETLKRVLEKLEETLRRLKKKVDEELKRLEDENRRLKEEMDRLLRKSREELERLREKVVRDRGREDEVLRRLLELHTEDLKHAREVLDEVLRLNKKALDLIRRILTEVLKLIKELLKLIEAGADEDELRRLLEDIERKIERLLRELKKESEEIRKRIRELLEDNRDKSRKIKKAIEELKK

SEQ ID NO: 27224 - protein, 241 aa, Artificial Sequence; identical to SEQ ID NO: 27223
  Synthetic sequence.

SEQ ID NO: 27225 - protein, 235 aa, Artificial Sequence
  Synthetic sequence.
KLEDAARIAAKAAEEWAEAHKRAAKINAEASEEWAKAHREAAKIAAEAAKRAADEARGDKDEDAKRAEDLARRAIEILEESAKRAKDAAEDDKRIAKESAERAERLARKAKELLKDLAKKKASADDAARLAKRVAEEAKRLDKEAADLSRDSARRAKELDKRALKLVRDAAREAKKAVDDEDALRVIEKAAEDAERAAKESLDVAERALRESEKAAKESLEVLERALRDAKRAAD

SEQ ID NO: 27226 - protein, 235 aa, Artificial Sequence; identical to SEQ ID NO: 27225
  Synthetic sequence.

SEQ ID NO: 27227 - protein, 242 aa, Artificial Sequence
  Synthetic sequence.
SALETAAKLAKEAADRWLEASKRAAELAKDAADKWLDASRRAAELAKKAAKEALDADKEDALERAARSLEEAAKEAIKLDEEAARRLAEAAKTAIKLDEDAARDLKRAADEAKRRLTEDRDAAREAEKLAKRAADAAKRHTDELRKLAERALRASKEHTEDLKKLADDALKAAEELKRLDDRDTDLKRRAAKAAEDIKKAADELLKKSEDAAREIKEAADKLLEDSKRAAEEIKRAADEITR

SEQ ID NO: 27228 - protein, 242 aa, Artificial Sequence; identical to SEQ ID NO: 27227
  Synthetic sequence.

SEQ ID NO: 27229 - protein, 238 aa, Artificial Sequence
  Synthetic sequence.
DEAEKLAKEAREAIKRYADASEKIAKEAREAIKKYLEASKRIAKELREALKELARRLTDRRALEAAKKAAKVVDDAAKKNEDAARRAAEVIDKAAEDNRRAAEEAARVIDEAADRARRISDKDTAAEVAARAAREAARIIEEASRISAEAAEEAAKILEDASRIAAEAAKRAADIAREALRDKDAVREADEAAERAREKLERLSREAKKAAKDAKDKLKRLSDEAKKVARRLIEELKR

SEQ ID NO: 27230 - protein, 238 aa, Artificial Sequence; identical to SEQ ID NO: 27229
  Synthetic sequence.

SEQ ID NO: 27231 - protein, 232 aa, Artificial Sequence
  Synthetic sequence.
SKDEKAIEALKRAADETRKAAEKSADAARRAAEKSEKAAREAAEALKRAVEEAARALGEENEAAREAKKAAEEAAKTIKEALERSKKAAKELIEENRKIAKRSERAARELARLLREKKEDSKEIVKKAEKAAKELEELWRRTSEEARRAAEELEKIWRELLKRLRDAAREAARRGVPEAVLRAAEKAIKAAEEAARANKKAADEAIRANEEAAEANKRAADKAIKAIRDAAR

SEQ ID NO: 27232 - protein, 232 aa, Artificial Sequence; identical to SEQ ID NO: 27231
  Synthetic sequence.

SEQ ID NO: 27233 - protein, 233 aa, Artificial Sequence
  Synthetic sequence.
DREDAARRVEKAAREIAEKNKKAARDIKELAKEAIKRTKEAAERVKRAAKRIAEAAEEGADEKTLLEEAKELAERAKRASEDLARKWEKIARDALRALEESARDVRRLAKEAKDALRRDGGIREAAEAIDRAVRKAEKTHKEAAEAIKRALEDARKANEDAARAIDDALRKLAEARDKDAVKRALEELARAAEEAARADAEAAKKLAEAAERAARANIKALRDLAKAAKDAAR

SEQ ID NO: 27234 - protein, 233 aa, Artificial Sequence; identical to SEQ ID NO: 27233
  Synthetic sequence.

SEQ ID NO: 27235 - protein, 245 aa, Artificial Sequence
  Synthetic sequence.
REEEAAREAAEAARRAAEIAIKANEEAARAAKRAAEISIKASEDAARAAEEAAKEAARSNDKNERAKKAADEVKREAERLAKENRDIARRVEEEARRILDESRRIAEEVKRRAEEILKLLRNGEPLEELAKRLIEILKRALEEDHRLARRAIDILRRALERNARLAREAIEILKKALEDAAREAQDEDALRRAKKAIEDAIKVLKEALDKSAKAIEEAIRVAKEANERSAKAIKDAIEVAERAAR

SEQ ID NO: 27236 - protein, 245 aa, Artificial Sequence; identical to SEQ ID NO: 27235
  Synthetic sequence.

SEQ ID NO: 27237 - protein, 243 aa, Artificial Sequence
  Synthetic sequence.
SEAETLVERLKRLSERDERAARRLVEELKRLAEEDKRAAEELARRLEELARRAEDVARANKDRDEAKKVVEDLEKEAEEIIRDYRRLLEELDREAEKVIEDYRRILDKLRRDAERVIEDAKRRLKDLEEAARAIKLAREAAKRAIDASKESADAAERAAKEAIKASKRSAELAEEAAREAIKALKDAAEEAAKRLRRAAEEALKINKRANEELERAAREALDLNRRANEDLEKAAEDALRTAK

SEQ ID NO: 27238 - protein, 243 aa, Artificial Sequence; identical to SEQ ID NO: 27237
  Synthetic sequence.

SEQ ID NO: 27239 - protein, 243 aa, Artificial Sequence
  Synthetic sequence.
REAEELVKRLKELAEKDRRAAKRLVEEAEKIIRRARELSKKTVKKLEDLIERAKRLADANKDRDEAKKAVEDLDKEAKEIADEHRKATDKIERDARELIKKYREILKRLEEEAKRVIDDARRRLKELEEAARAIELAEKAAREAIEASRRSAELLREAAEKAIRADREAAKLAEKAAKDLIRALKDAAEDAARRAEEAARRALKINEDAAREAERAAREALKINDEANKRLEEAARRALETAR

SEQ ID NO: 27240 - protein, 243 aa, Artificial Sequence; identical to SEQ ID NO: 27239
  Synthetic sequence.

SEQ ID NO: 27241 - protein, 240 aa, Artificial Sequence
  Synthetic sequence.
KELEEILKTVEDLVRRAKELLRRIHEINRESIEDIRRLLKEIHDTNKRSIEKVDELLKRKTSEETLERLVEEHKKLLEDLLRRLRRLVEEHEKKLDKLRKTIEKLVREVEELLRRAAERVDDERARRVLKEVLRVIREVVEILKRALELSLEVLRDVVRRIEEALRLSLEVLKRVVEVAKNKRDETEIRKILKESNDRLTEVIKEVEKVLRESDELLRDALKKIVDVLREVLKRLEDTVR

SEQ ID NO: 27242 - protein, 240 aa, Artificial Sequence; identical to SEQ ID NO: 27241
  Synthetic sequence.

SEQ ID NO: 27243 - protein, 247 aa, Artificial Sequence
  Synthetic sequence.
EKEKEIKDAEDEARKAAEESKRKIDKADEDAKKALEELERSIREADKDAKRALDEERREDRRAEEAIKKLRDLARRAKKIHRDNLEKIDEIARRLKKLIKEYIEKSEKIARELKKLIEDAARKERGSDALRLAKEALDLVDEAARRNEKAAREALETVDRAARRAKEAIKKSAEDVDRAAREAEKLARERREDAARIAAKAAKDALKANEEAARILARAAKEALKILEDATRILKEAADRALDILRK

SEQ ID NO: 27244 - protein, 247 aa, Artificial Sequence; identical to SEQ ID NO: 27243
  Synthetic sequence.

SEQ ID NO: 27245 - protein, 246 aa, Artificial Sequence
  Synthetic sequence.
SEVEEIEKVARRNLELIKRLLEKAERVAKKSLDLIKKAADDARRIAEETLKLIREAAEAGVEEKAAREALRAIEEAARRAEEAAKEALKANKEAADRAREAAKRALDATRKALEEARRLAKDRAEEAAEALARALKRTIEAAKEAVEALARAAKRSADAADRAVEALARALEEAIRAAKEASRTKEAEDLLREAAKRAEELIRRAEEAAKRLKEEWERLIRELKRALEEYAKEAKKLIKELEDRTR

SEQ ID NO: 27246 - protein, 246 aa, Artificial Sequence; identical to SEQ ID NO: 27245
  Synthetic sequence.

SEQ ID NO: 27247 - protein, 245 aa, Artificial Sequence
  Synthetic sequence.
SKREEAEKAARRAEKLAREAREAARRSLERAKDLARRHEKLSRELLEEAKRLAEEVKETAKKPTDERTAEELARKIIEALKKANEENRRSAEELIEALERNLREIEKLIRDAIEALRRAVEEARGEGKRKADELRRAAREAIEALKRALEEARKAHEEAIRAIEEALKKDSKAAKEAIDAVDEAAKRKAIDEALKALKRAADLSADANRRALEALEKAARLSARAAEEALEALRRAAELARRAAE

SEQ ID NO: 27248 - protein, 245 aa, Artificial Sequence; identical to SEQ ID NO: 27247
  Synthetic sequence.

SEQ ID NO: 27249 - protein, 237 aa, Artificial Sequence
  Synthetic sequence.
SAEDIIRESEKADKDALDEWRRLIKKLEDLIEELLKENERLIRKLEELIKKALEADKEERGSEEAKRLLEKLARAIEELEKEARDLNRRAAEAIKRLADEAKKIVEEYKKIIEEIKKKASDARDLARALDRSAEAHERAAEIAARAAKRALEAHSEAIKIAIRAAKEALDAARAAKRGEARGEEAAERAKRAADEAKKASDEAAKEAREAAERALRAAEEAAKEAEKANRDALRSAK

SEQ ID NO: 27250 - protein, 237 aa, Artificial Sequence; identical to SEQ ID NO: 27249
  Synthetic sequence.

SEQ ID NO: 27251 - protein, 251 aa, Artificial Sequence
  Synthetic sequence.
SEDEELAKEAKRAVEEAKKRLEDLLRRAEEAHRRAKKELDELARRAEEAHKKAKRDIDRDAKDDEAARALKEALDRHLEAVKKAAKALKEALDRNLDAVREAVEAAKKALDDALKAIEDASRRDRKEDAKRAAEEAAKALEEAAERAERAAEKATRALEEALKRAREASKEAAKALKEALKRARESNVEEEIVRRADELAKRAEELNRRLAEEADKIAKKAKDLNERLLREARDIARRAKELIKRLLDARR

SEQ ID NO: 27252 - protein, 251 aa, Artificial Sequence; identical to SEQ ID NO: 27251
  Synthetic sequence.

SEQ ID NO: 27253 - protein, 241 aa, Artificial Sequence
  Synthetic sequence.
SKAERVVDEARKTDEEVLREAEKVNRKVEEVIRRVLKRNEDVNREIARAIERVLRGGVEEKLVRELEKLNRDHHEKSKENIRNLEEVNKKHHEELKELADRNRRLNDKVLEDAKRDRREEEVRKLLEELKERSRDSIRKSRELLDRLREYLKRDIDRSEKVLRELEKRLRELIEKVRRKVDKEEVLRTAEEVVREALRLVTDAHRVNEEVIRDVLRLVERVHRVYEEVNRRNDELLKELTD

SEQ ID NO: 27254 - protein, 241 aa, Artificial Sequence; identical to SEQ ID NO: 27253
  Synthetic sequence.

SEQ ID NO: 27255 - protein, 232 aa, Artificial Sequence
  Synthetic sequence.
KDEERLREILKKYKEDSERILREVREILERYRRAIEEILKRLEDILRKLEEDVRRELKDNEAVKRVVEKALEAVKEVLKAIEDAVRESLKAAEDVLREIKRVSDAIIRVLEALARGERDVDEVLETARRLTEEVEKVVREVLERSERALRKVRTVVKRVLDIIRELLAEVKRAVPDLTKALKTVRDVLELLRKILEEVRRLNEKLLEELKRLLDEVVEKNERLIKLLEKDAE

SEQ ID NO: 27256 - protein, 232 aa, Artificial Sequence; identical to SEQ ID NO: 27255
  Synthetic sequence.

SEQ ID NO: 27257 - protein, 240 aa, Artificial Sequence
  Synthetic sequence.
DELETLEDVLRKIEDLLRRWLEKLEETLKRIIRLLETSLKLLEESIRRILRILERDVDDDKVVRKLEEVLRRALKEHRRVLEELLKVLRDVLEENRKVVEDLKRVLEEVIEKIARVKRREELLRVVEELLERVREVIKELLRVNDRVLREVEEVVKKLLKVNDELAKRVRTVVKELVDSREDKKVRDVLREIEELLERHKRLLEKLARELRELAKRHREEIKKVLETLKKLAEELTRRVR

SEQ ID NO: 27258 - protein, 240 aa, Artificial Sequence; identical to SEQ ID NO: 27257
  Synthetic sequence.

SEQ ID NO: 27259 - protein, 235 aa, Artificial Sequence
  Synthetic sequence.
SEKEELRRELEEHAKRSRDTVKRLEDENRRVLESLKRKVDTLRRINEETLREIRRLAREERLSKDVVRRVEEVVKESEDILRRILRRIKEIADESERILREVLKKSEEIIREVERVLREVDSEELLRRLREALKRNIEVLRELLELNKEVLDRLVEVIKELLERNERVLEKLVRETDSRDEKLKRDLEDLKRKHDELRKRLKEELDELRRKHEKIKEELDRHLKELEDKLREARR

SEQ ID NO: 27260 - protein, 235 aa, Artificial Sequence; identical to SEQ ID NO: 27259
  Synthetic sequence.

SEQ ID NO: 27261 - protein, 235 aa, Artificial Sequence
  Synthetic sequence.
SEKEKLTEILRRHERESERVVKELDEENKRHLKKSREIADTLRKLNEETLERIRELVKRARISEELVEKVERVAEKSKRILDEAVKRSEDIARESEEILRRARERSERIIREIRRVLREVDSDDLLRLLEELLRRNVEVLEDLLRRNLEVLRKNVRVLRELLKKNERVLEELVKTLNDTDETLKRELERLKEEHERLKEELDRHLKALEEKHREIRREIDEHLKELKRRLDEERR

SEQ ID NO: 27262 - protein, 235 aa, Artificial Sequence; identical to SEQ ID NO: 27261
  Synthetic sequence.

SEQ ID NO: 27263 - protein, 252 aa, Artificial Sequence
  Synthetic sequence.
SEKEKLIEDLRRILKETEERLKRVKERLRELLDEYRRRSEDKLRELKKELEEEEEKIRRSGLSEEAERAVRKLLKVLREVLDKLKKLNEDNLRVLEEVLRLLERLLDELLKVLRELLRELEKLAEDKQDKDEVLEDIKRRIAEVIDRAKKLLDKLRELIEESIKRVRTETDRLRKDIEKVLRDIAEDVKDDRLRKRIKETADRLREMLKRHRELLERSMELLRRALEEAKKVLDETEETARRLLKLAEDEER

SEQ ID NO: 27264 - protein, 252 aa, Artificial Sequence; identical to SEQ ID NO: 27263
  Synthetic sequence.

SEQ ID NO: 27265 - protein, 246 aa, Artificial Sequence
  Synthetic sequence.
KEIEETLKELEDLNREMVETNRRVLEETRRLNKETVDRVKATLDELRKMLKKLVDDVRKEPTSEELKRLLRELEELLRRVVRRVEELLKKSTDLLERAVKDSKDALRRSHEVLKEVAKRVKRAKDENLPREEVLRLLRELLERHAKVLKDIVRVSEKLLREHLKVLREIVEVLEELLERILKVILDTTGRDKKVEELEKALEEIKRRLKEVIDRYEDELRKLRKEYKEKIDKYERKLEEIERRERT

SEQ ID NO: 27266 - protein, 246 aa, Artificial Sequence; identical to SEQ ID NO: 27265
  Synthetic sequence.

SEQ ID NO: 27267 - protein, 237 aa, Artificial Sequence
  Synthetic sequence.
SEEEDREREYEERHKKAEEDLRRAEEEYARELRREEERLKEEAKRLEKELRDARTKLDEDEIADKIAKALREIAELLKRLVKVIRDVLRENEKLLRDIAEVLRRISRENAKLLRDAREKQRAGEIVEALRESNKRILDALREVVKALKKTNEDVLRTVKEVVKRIEELLRRLASEGNDEKAKKALDEAVKRVKEDIKRLEDSVKTADDKDRKAIRRAEETVRTHIRTNEEAVRREEK

SEQ ID NO: 27268 - protein, 237 aa, Artificial Sequence; identical to SEQ ID NO: 27267
  Synthetic sequence.

SEQ ID NO: 27269 - protein, 235 aa, Artificial Sequence
  Synthetic sequence.
SELEETLKRLKETNKRLLKKVKELVDESLRLNEELLRRLREVIRKIKETIKEVLEEGVDEKDIRKAEEILDDVLRKLEKLVRDSVRVNETVLKEVEDIIRRSLTELDKVAERLKEAKSEKVVKDVLKEVIDRNEEIVEELLERIRRVLEDDLRIVKEILDILRKVLKEILKVLEEIVDEDERVDELRKRIRKTEEEIEDIKRRYEKRVRELKETLDRIVKELRDRYKKIREEIDT

SEQ ID NO: 27270 - protein, 235 aa, Artificial Sequence; identical to SEQ ID NO: 27269
  Synthetic sequence.

SEQ ID NO: 27271 - protein, 239 aa, Artificial Sequence
  Synthetic sequence.
DIEDVLKKVLEKNLRVLREVHEVNKRVLDEIVKLLRELHRVNKRVLEIILRLLEALRRGERDREEVLRELERVVKESKEVNKEVLKRLEDIVRESLREIERVLDETRKAIKEVEKVLRERRVEERVLEMLRRYADRSRDFADKDKKKNKETLDELRKLSEDDKRINDRLVETLRRIIAQGDTSDEDLKRIEDELRRTLEEHRKRLREVERELEKKVEEHERELRKYEEETKRLLREAER

SEQ ID NO: 27272 - protein, 239 aa, Artificial Sequence; identical to SEQ ID NO: 27271
  Synthetic sequence.

SEQ ID NO: 27273 - protein, 236 aa, Artificial Sequence
  Synthetic sequence.
REEERLRELITDYKRKLDDLKRRSEDLLREYEKTLEDIRRESERTKKELRESLKRDLDREGESEKVKVLKEVEDLLDKVNKRLLEIIKTNLDLLRRVNEELERVLKTNLDLIRKVLELARRGAPEKDVKRVADEVSERAEKLLRDVEKRNREVSKRLEDLLREIKERNDEVVERVKERTDDEKVKRELEKHTKLLKEILDTVRDLNRKHSEEIRRTVEEVRKANRRLLEELKETRK

SEQ ID NO: 27274 - protein, 236 aa, Artificial Sequence; identical to SEQ ID NO: 27273
  Synthetic sequence.

SEQ ID NO: 27275 - protein, 241 aa, Artificial Sequence
  Synthetic sequence.
SELEETLKKIKELAEISRKLADETRREIKKLIDDSRKLLEDTHRTNEEMVRRVETKAKDKDERIKEVLKRVAKEIKDSNDELRRRVEESAKRLREVLEELKEKIERSIKRLEDILDLLRRGEVREEEVVRELLKVLADNLRAIEEVLRKLLRILEDNLRVTEEVLRTNLRLLKKLLDELKLDEEKLREVRELLERYREDVRRLKKEYEELLREEDKKVKKKKEDYERILRKTKKELDERRK

SEQ ID NO: 27276 - protein, 241 aa, Artificial Sequence; identical to SEQ ID NO: 27275
  Synthetic sequence.

SEQ ID NO: 27277 - protein, 234 aa, Artificial Sequence
  Synthetic sequence.
SEDEKAAEDLKKLAEESIRELEKALRDAARLHEEALKRLKKALDEAARLAERAIEEARKGLDLRRVADEVAKAAEKAARAIEEVLREVLRASNEAAKAWKRVAKRNAEAAEEAARRRRDKTAEDLLREARKAAEDSKKEADDLNREAEELARRAREEAERLLREAEKAARDAKTKKLVGEELIKLIEDLLRLAAELAKKIAELAERHLRLLEEAARKHIELVERLIELAKRDTD

SEQ ID NO: 27278 - protein, 234 aa, Artificial Sequence; identical to SEQ ID NO: 27277
  Synthetic sequence.

SEQ ID NO: 27279 - protein, 234 aa, Artificial Sequence
  Synthetic sequence.
SEDEELEKLLEEAKKLIEESSRRLDELLEEDRRVVKRIEEEVEKLLKEVKEEIDKIKKEVRELEKIKRVLDALVDVARKIVEVTKELLRDNVRVAERIVEVIKDVNRKLVDVVDKLRKTKDKRELEEILRELERENRRVSKEVEDLLRELRKRNEDVLRRIEKLLRELKKEVDELLKDLGKVLEIVKEIIDRIRKLLKKTFDISDELLRKWEDLLRRNNDLSRRLLKEAEDKAR

SEQ ID NO: 27280 - protein, 234 aa, Artificial Sequence; identical to SEQ ID NO: 27279
  Synthetic sequence.

SEQ ID NO: 27281 - protein, 235 aa, Artificial Sequence
  Synthetic sequence.
SEKEDLARKLRKLVEELTREYEELVKKLERLIEEIEKVSEESVRKLEKLLREISEEVRKLGTDSRVLKRLLERLRRIIEEDHELNTELLKRLLDLLKEILDTSRELLKRLLDILREVVRDESVLRDLERTLREVLEENERAIEEAERVLRKVLEDSERAVRDARRVLKEVDKSPTKDELLRKLVELLVEVLRRLIRVNRELVKLLREVLERLLRILRESVKKLKRLIEKVIKDET

SEQ ID NO: 27282 - protein, 235 aa, Artificial Sequence; identical to SEQ ID NO: 27281
  Synthetic sequence.

SEQ ID NO: 27283 - protein, 242 aa, Artificial Sequence
  Synthetic sequence.
KEEEDLLERVKRVLDELIEIVDRNHELNRRVVETSARLVERLLEEVERALETLEREIPNRKLLDKAIKDLRDVLRRVKEKVKRSIEELKEVLEESRRVLEEVVRKLREVIDRVRRLVEKGVDLRDLIRELKRVLEEAVKLIERLVRLNTRAAEKDNESLRELVRAIKEALKRAVDMVRADGLDSRLVKKLDEIVKEVAKKLEDVVRRNEELWRKLVELNKESVRRLREIVERVARDLEETAR

SEQ ID NO: 27284 - protein, 242 aa, Artificial Sequence; identical to SEQ ID NO: 27283
  Synthetic sequence.

SEQ ID NO: 27285 - protein, 232 aa, Artificial Sequence
  Synthetic sequence.
RRTEEVIKKIAKLIDELIETLKKIVEDSAKLIKELIDLLEEIIKRSADLIRELEKVSKRGDRDRLKKLIDRMRRETERALEELRRVIEELKERTERALKTIEDLIREIEEAIRRELEDEDLAREILEVIRRILELLREDMELNLRALEEILRLLEEVIKLNKDAIDEILELLKKSEERRIAERIRELLRESKKLVRDVVEEAKRLLKENRDSTRKIIEDIRRLLRKIEDSTR

SEQ ID NO: 27286 - protein, 232 aa, Artificial Sequence; identical to SEQ ID NO: 27285
  Synthetic sequence.

SEQ ID NO: 27287 - protein, 242 aa, Artificial Sequence
  Synthetic sequence.
DKEDIIRRLARVLERHDEANREVVKEHDEVLEEHLDVHRRVVRSNIEVLRTLLELVEKLDSEDLKRVLDEVRKRLEKSLEELERRLRESDKKSETVIRKNEKAVRESAEALKDVIRKLKEARDDEKVKETAKKVRELLERLIELNRRWVEALRRLNERLNKLNRDAIELSRRLLKELEDLTREGVPEKDIRKVIEDIERLHRESMEEVRKLVEEIKRLNKEVLKRSEELVEEAKRLLKEVAD

SEQ ID NO: 27288 - protein, 242 aa, Artificial Sequence; identical to SEQ ID NO: 27287
  Synthetic sequence.

SEQ ID NO: 27289 - protein, 247 aa, Artificial Sequence
  Synthetic sequence.
DTKEVIEKLIRVLERAVKLLRELVDRDNRSLKKAVDLHREVVRKIIEVLEEAVRLLATVKEDEKLKRVLEEVVKELERVLKESEELVRTVIRDNREVVKDARELVREVERELKKVIDDARRRTDDEELRKLLEEIKKVLDDLRKLLDTNIKISEKVLRDWERLNRELAKILKDVIRKLEELARKMRDEEKLLREVERLVRELAKRLRESLKTVEDLVRELADTNRRSVKTVEDIVRDLERKAREVTR

SEQ ID NO: 27290 - protein, 247 aa, Artificial Sequence; identical to SEQ ID NO: 27289
  Synthetic sequence.

SEQ ID NO: 27291 - protein, 248 aa, Artificial Sequence
  Synthetic sequence.
SKRELLERVIREAERVLKEWEDLLRELTETSDRVIRDVERLLRELLRKAEEVIKDILRKSDDEELRKLLKRVRELLKELADILKRLVDEHRRLVEENIRIVRTAIELVKELLKRLADLLESGLPREDLTREVEKVLRELEEIVKKVKRDSERIVEDNRRLSEELRRLVEEILERLRRLVDDLIKKKDKDEDLKRVLERLTRVAEEILELLEEVLKKSNRSLEKAVEANAEALDRLIEVLRELLDDLRK

SEQ ID NO: 27292 - protein, 248 aa, Artificial Sequence; identical to SEQ ID NO: 27291
  Synthetic sequence.

SEQ ID NO: 27293 - protein, 248 aa, Artificial Sequence
  Synthetic sequence.
SKEELLKKVEDEARKVLEEWKEEVKRLIEESKRVLDDWRRLVDEVSKDIKRVIDEARKDSEDKDLEEVADRVRKLLEDNKRIVDEAIRRHEELLDENRKIVERVIELLEELLDEIAKLTRSGKPEEELIRRAEELVRRLAEIVERVIRESRRIVEDNRRISREVVERSKEIVDRLRKIVTELIKKKDKDEDLKRVLEKLIKVIEKIVRLNEEALRKSNESLERIVKLNEEALRELIRVIERLVELVRK

SEQ ID NO: 27294 - protein, 248 aa, Artificial Sequence; identical to SEQ ID NO: 27293
  Synthetic sequence.

SEQ ID NO: 27295 - protein, 230 aa, Artificial Sequence
  Synthetic sequence.
KEREEIDELVKELEKELRRLVRENEKLVEDNERTLKRLLEENKRLVEELVKRLRDGLDRDELKKVLDDALDANRKSVRRLEESAEEVLKTNRRSLERAIDLLRRALEEIADKVDKRDLLEEIERLIRELIRRLERVHEEIERLIRRSIEELRRIHEEVEKLIEDVKRVADRVDKDEVVEIVIRVLEEILRLSEEALRIHIRVTREVLRLSKELIDEIRKVLREIADRIRK

SEQ ID NO: 27296 - protein, 230 aa, Artificial Sequence; identical to SEQ ID NO: 27295
  Synthetic sequence.

SEQ ID NO: 27297 - protein, 245 aa, Artificial Sequence
  Synthetic sequence.
SKEELLKELLDRVRRVLTEIKKLLERLLRRSKEVIDDSERLVREVLKRVEDLAREIKAERSVDDRAVDRMLELVERWVELWKRVLELLEEISRRIVRLIERVLELLLKVVEEVLKRLTEVRTEKELKDVLDTVEELLKRVLDELRKVVEEIRELHREVLEANEEVMDRVEKLLKEVRDTLRRRLKDKDALDKLRRLIDELARLLREVHERDKELIRDHLREVEEIAKEIARLIKRLAEEIREITT

SEQ ID NO: 27298 - protein, 245 aa, Artificial Sequence; identical to SEQ ID NO: 27297
  Synthetic sequence.

SEQ ID NO: 27299 - protein, 245 aa, Artificial Sequence
  Synthetic sequence.
SERELAKRALERAKEAAEESKRLAKELLDRSRELAKRSKELADEVLKRAKKAAEEIKKKRSADDRAAEEALRAAAEWARLWKEVAELLLEASRRAAELWKEVAEEALRAAEEVARLLEEARTEEELKKAAEDAERLAREVLKANEDALREARRLHREVLEANDRAAEEARRLAEEVRRELDKRAEDKDAAREARKLLKDLLELAERAHKKDRDAIEEHLRLAEEASKRDKELLKELLDLIREIAR

SEQ ID NO: 27300 - protein, 245 aa, Artificial Sequence; identical to SEQ ID NO: 27299
  Synthetic sequence.

SEQ ID NO: 27301 - protein, 231 aa, Artificial Sequence
  Synthetic sequence.
SKEEEVEKVLRKWEEILRRLIEENKRANDKIRREYEELVKEIRRVLEEIKEVAERLRVSEEVKRILEKLIKLLEDILEYEKENVERLIELNERILRELKKSVEELKKLVTRVRRDKLPESEVRKLVEDVLRKNEELLKEAKKAWRDSIENLKRVLEEVKKLVKTVLREIEEKIDDKDVVRKLIEVIERLLRVAEEVIRRILKVNTELMRVDERSIRESLKAIREVLKVLDT

SEQ ID NO: 27302 - protein, 231 aa, Artificial Sequence; identical to SEQ ID NO: 27301
  Synthetic sequence.

SEQ ID NO: 27303 - protein, 245 aa, Artificial Sequence
  Synthetic sequence.
SKEELVDTVKKKLEEVLKKIDKLSRDVKEKLRRVIEELRKLSREVHETNREVARRLREEAALEEIVKLLEESAKRATKLLRDVVRRIKEVAKEASELLEELVREIARVLDEVVKLLAEAGVPEELVRDLERLVREAVRELERLVEEHKRLVEEAAKRLEKLVEEHKKISEDVARRLRELLEKISDEETVLRTLEKIIRDHNKAHKRVTDAVAKILEELIKLHDEVSRRLKDILRRLLELLDEVTR

SEQ ID NO: 27304 - protein, 245 aa, Artificial Sequence; identical to SEQ ID NO: 27303
  Synthetic sequence.

SEQ ID NO: 27305 - protein, 245 aa, Artificial Sequence
  Synthetic sequence.
RKEELVDTVKKDLERVIETVRKLSEDVKEKIRRVLEDIDRLSKEVHETNKRVVEELEDKKSLEEIVKLLEESAKRASRLLKELVRELKEVLKEASDLLREIVERVERVLKKIVDLLRESGTPEELVRTLEELVRRVVERLKKLVDDHEKLVKEIAEKLEKLVEEHERISRRVVEELRELLRKISDEETVLRELVKLIRDHNRMHEEVVRRLKKIIEEALKLHDEVSRRVAELLREVIELLDRVAK

SEQ ID NO: 27306 - protein, 245 aa, Artificial Sequence; identical to SEQ ID NO: 27305
  Synthetic sequence.

SEQ ID NO: 27307 - protein, 245 aa, Artificial Sequence
  Synthetic sequence.
DKEREVDEILRRVTKLLKELEKRSKEILDRVRELVREYKRKVEEILKRVEDLIRRLIKDKKEVEEIETVLKKILDVVRTIVELLKESLDEAVKVVEDISRVNRESLDRIRKVVEEIVEVIKKVRTKEELKEVIDRIAKKLDEVLKRNEEVIRRVARRLEEVHEKNRRAIEKAVRDLRKVLKELEERGVSLDELRKILKELEELLRTLNKELKEVVKELRELLKELHDRLREILEELKRLLEEIAR

SEQ ID NO: 27308 - protein, 245 aa, Artificial Sequence; identical to SEQ ID NO: 27307
  Synthetic sequence.

SEQ ID NO: 27309 - protein, 245 aa, Artificial Sequence
  Synthetic sequence.
DEDELIRKLLEDLKDIVRKILELIERDLRDIERVVRRIVKVIRDDLKKIKEVVDDIRRRVPRTEELERVIKRIEELLRTSEEELDRILKEIEELLRESRRRLEEVVKAVEELLRRVEEIVDKGRERKEDVIKLLREVVDDILRLVEEVVRTNLEIIKRILELIERVIRLNLKIIRDILRLLEETVDSELADRIRKLIEDLERHTKKVLEDVKRAITELRKNSKDILEEVRKLIDELRKRIKEVED

SEQ ID NO: 27310 - protein, 245 aa, Artificial Sequence; identical to SEQ ID NO: 27309
  Synthetic sequence.

SEQ ID NO: 27311 - protein, 232 aa, Artificial Sequence
  Synthetic sequence.
KAEEIAKIAVDAVRKIAELLRRASKINLDAIRKAAKLSKEASKINLDAIRKIAEEVKDAEEIKRDAERIAREDAEAAKRSAELAEEIAKRDEDLARRLEEEAKRLADEIRAEKATEEAAEKALRAIDELLKRAKRASEESARLAEEWIKEDKRLSEESAKLIEDLIRKAEKKNRVDRKALEKARKLAEDALRANKRANDEAKKLADEALKENRKALEDAKRLARKAAEDAKR

SEQ ID NO: 27312 - protein, 232 aa, Artificial Sequence; identical to SEQ ID NO: 27311
  Synthetic sequence.

SEQ ID NO: 27313 - protein, 246 aa, Artificial Sequence
  Synthetic sequence.
SEEELLRRIRELLKKALEDNKDVLREIEELLRKVTEDNDRVLEEIRKLLEEVDEVVKRAGVDEELLKLIEDILRTEKRVLEDWKRLVEETRKAVEDLLRELERLSREVVERVERLLDELRRRNDEDVVRKIAREVEKIVDTHRKVVDDIRRKVEEIVKKHEELLRDIERKVEEIVRRLKEILERVDKDELRRVVEKIEKVLRDVVRALRELVRINARVLEEILRLIEELVRRNAEVLKRILELVAT

SEQ ID NO: 27314 - protein, 246 aa, Artificial Sequence; identical to SEQ ID NO: 27313
  Synthetic sequence.

SEQ ID NO: 27315 - protein, 238 aa, Artificial Sequence
  Synthetic sequence.
SKEDELRKAEEDARRVVEEILDLNRESVEKSRRVAERVLRLNEDSVRKSRDVVRRIKEEVNTDDKLLDILEKVLRTNERLSERDLRLIKTILELNERLSERDRRLIKKILEDVRRLVELVRRGTREEELEELVRELIRRIEDILRESEELVRDTIKKIEDILKESEDLVRRTIEEIERKVDDRDVVRKLIEANEDHLRVNKEIVDRLIKANEEHLEVNRRAVEKLIEVLKRLLDVARK

SEQ ID NO: 27316 - protein, 238 aa, Artificial Sequence; identical to SEQ ID NO: 27315
  Synthetic sequence.

SEQ ID NO: 27317 - protein, 237 aa, Artificial Sequence
  Synthetic sequence.
SEKEDLVRTIEEVVKTIEELVERHERKIDEIVKRSRELVRTHVEKIEEIVRRVEELVRRGGSRDEELRRRILDLVEKLFKHVEEVLKTILKLSEELLKHVTEVLERIRDIIRRLAEKLRRNNVKRESLEKVLEKAKRVLDDVKKKLEDSADENRDVLRRVKEELERSLDKLRKILKSNSDLDTLAEEVKRVLKEHVDLVRKAARLDSETLKKHVDLVRTAAERVSEVMKELVELVRR

SEQ ID NO: 27318 - protein, 237 aa, Artificial Sequence; identical to SEQ ID NO: 27317
  Synthetic sequence.

SEQ ID NO: 27319 - protein, 237 aa, Artificial Sequence
  Synthetic sequence.
SEIEELVKDIERIVREIKKLIDDHVRKLEKIIEDIERDMRRHEETVREVVRKIEDEVRRGGSRAEEIKRRILEEIERLVEHVKDLLRRILELIERLAENIRRLLRRIEEIVTELVERLRRLNVKRESLEKVKKKAEDIIRRVKKELEDSLEELKDILRDAKRRLDESLKEIREILKSNSDLDSLAKKVSDVARKHLDLARRVIKLISEALKKHIRLVEKAMEDISRILEDLVRLVRK

SEQ ID NO: 27320 - protein, 237 aa, Artificial Sequence; identical to SEQ ID NO: 27319
  Synthetic sequence.

SEQ ID NO: 27321 - protein, 236 aa, Artificial Sequence
  Synthetic sequence.
SKLEDAVRRIEEILRHIVRSLEEVVKDIEKILRDHVRMLREVVKRIEDVLRRVVELLRRAGDQRELVRELEELVRELVERLRRIVKRNEDLVRDLLDKLRKIVKRNEKVARELVERLRRRGESKEEAVELLREALRLNKKSVEDIERLLKELLDLAEESVEEIERLLRDILKKIADVITDKDVLREVAERIRKVIERLKELLDRSRERAEDVIKKLRDLLKENERLIEEVRRRLEK

SEQ ID NO: 27322 - protein, 236 aa, Artificial Sequence; identical to SEQ ID NO: 27321
  Synthetic sequence.

SEQ ID NO: 27323 - protein, 228 aa, Artificial Sequence
  Synthetic sequence.
SREEAVADVIRRLEEILEKNLRLLEEIIRRLLRILEHNLRLNEKAVEIIEDLIRKLLRDEKVIREAKKTVEEILRESKRVLDEVKKKLEKILRDLERVHEKVMRDIREILKRNKGKERALETLRRVVEELVRVTEEVAERLKEVVKEVVEANRRVLEKLKKLIEELAEKVVKSRLADDLRRVVKKIVEDLEENLERIKDIIRRLVEELERSLEEIRRLIDRLVKEIRR

SEQ ID NO: 27324 - protein, 228 aa, Artificial Sequence; identical to SEQ ID NO: 27323
  Synthetic sequence.

SEQ ID NO: 27325 - protein, 234 aa, Artificial Sequence
  Synthetic sequence.
SEEEAAREAERLLEEAARVAERIVRDSERLLDEAAEVARKAVEDSKKLLEDALRAAREGQPRDAIREAAKELEKESKRLAEEIKDAARRLKEETDRLLEEAKRAAEELKKEADRLATEGAAAEDAARALKEAADLLVKVAEDLARANKEAADLLVEVAEKLNRANKEAAELLKKLADDREAAERVARRAERANEEALKEAEEVIKRAKEANKRALEEAKRVIDRADKALKEARK

SEQ ID NO: 27326 - protein, 234 aa, Artificial Sequence; identical to SEQ ID NO: 27325
  Synthetic sequence.

SEQ ID NO: 27327 - protein, 247 aa, Artificial Sequence
  Synthetic sequence.
RDRDVLRKVKREIEELVRRIEKVSRDALKEVKRLLDENRKIAEDVLRLIERLLRKIRDTRNDDRVVKETEEVLRDNHRLLEELIRRLIKVLEEWLRRHKKLLDEIRELLKEILRLVKESGVSEDLLRRLKRVIEELDKKLKESEEKLRRVVEKAKEDLKRVLEEHRKVLEDLKRALEEVREKLRERDREEVVEELLRMLKRVAEEMKRVHDDLSRAVEKVVRDVVRVDKELLDELRRILRRLEEVIT

SEQ ID NO: 27328 - protein, 247 aa, Artificial Sequence; identical to SEQ ID NO: 27327
  Synthetic sequence.

SEQ ID NO: 27329 - protein, 231 aa, Artificial Sequence
  Synthetic sequence.
SKDEELMRLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGADERVTEAIKKVLDTSEDLIRRVIKVNEDILREIAKLVEEVLREAERILTEIKKEVDREEIRRILEELKRIVDDVLRIIARILKLLRDLTRRLAEVAKKVHKLLEELLRKLKEDTR

SEQ ID NO: 27330 - protein, 231 aa, Artificial Sequence; identical to SEQ ID NO: 27329
  Synthetic sequence.

SEQ ID NO: 27331 - protein, 234 aa, Artificial Sequence
  Synthetic sequence.
KDAETLEKVLRDVLERADEIIKRLEDIYREIKKRLEAIIKEAEDINRKILEEIRRLAEDRKALADVVRKVAEDNLRLNRRIAEVLRELVKRALDVNEELARVLEELLKRLLEIVESANVDELRDIVDKVLKTVKKLLDESRRVAERLKREVERLLKESEDIVKEILERVEELARKITDVKRALEELKDLIDRNLKVLKDLLDATRKLIEENIRVLREILKRIKDIARELLEATK

SEQ ID NO: 27332 - protein, 234 aa, Artificial Sequence; identical to SEQ ID NO: 27331
  Synthetic sequence.

SEQ ID NO: 27333 - protein, 242 aa, Artificial Sequence
  Synthetic sequence.
SSKEEVLELIKELVRSSKEVLERVVRLNEKSLRISVEVLDRIVELIEEIVRIVVRELEKKVDERLVRKLKKVLEEAKERVERLVKENRDLIREVEEKSKRLVDENKKVLDEVVKEIDEVAKGELDSEEAVRRLLKILDETLRRHKEIVERLLKVNKDLLDRHREILERLKRLLEETLKRVKDTVPEIRELLKEIKRIIEEIDRLVKESLKRHKDINDEIRELAKRTLDEIKEVIDRIRERLR

SEQ ID NO: 27334 - protein, 242 aa, Artificial Sequence; identical to SEQ ID NO: 27333
  Synthetic sequence.

SEQ ID NO: 27335 - protein, 234 aa, Artificial Sequence
  Synthetic sequence.
SEEEDVIRDVKRRLEEILKTNADVIRDIEEILKEVKERNKRVVEELKDILRKVLEELRKKGVEERVLRLIEELVKKIEEILKRHLKLVEELLRLLREVLKRHLTLLEELVKLAKEVLDARLPKDELKKLLDRLLEEVRRVSDEVRRILEELLKRVEEVVRESKELLKRLLEEVEKLGVGKEVVDLIREIVERLARAVEESLKLLKEIIDLLTESSKELVKLLEEILRTLKEAAR

SEQ ID NO: 27336 - protein, 234 aa, Artificial Sequence; identical to SEQ ID NO: 27335
  Synthetic sequence.

SEQ ID NO: 27337 - protein, 235 aa, Artificial Sequence
  Synthetic sequence.
SDEERLEKVVKDVIEKVRRILEKWKKDIDKVVKELRRILEEWEKIIREVLDKVRRLKDEVDMLVKVLEEILRLAKELSKRVEEVLREILKLAKRLSDELVKVLREIVKRARDITRDDKLRKIVEDVKRELEDLARKDRKILDDVRELLERIAKEDKDILREAEETLRRLADEMRRTTVDERLLKRVVDILKRLLELNATTIERLLRILEELLKLNKELAERVIRVLEKLLEEIKR

SEQ ID NO: 27338 - protein, 235 aa, Artificial Sequence; identical to SEQ ID NO: 27337
  Synthetic sequence.

SEQ ID NO: 27339 - protein, 235 aa, Artificial Sequence
  Synthetic sequence.
KDMERVLTEHKKAVKELIELLERLLEEHERASRELIKLLRELLERHKRATDELIKLLRENKRRDEEIVRRVEEITKRVRKIVTEIVERAREITEKIKRIVEEIAKRVREVTKRLEDELKSEKAKKVVDLSREVVKIIEKVLDELVKLSKEVVDIITRVLEELVRLSEEVVRIITELLRRVEEVVKRLEDVNRTLEEIIRKVEEEAKRVNEDLRKRIEDVVRTLEEVNKRLKEITK

SEQ ID NO: 27340 - protein, 235 aa, Artificial Sequence; identical to SEQ ID NO: 27339
  Synthetic sequence.

SEQ ID NO: 27341 - protein, 240 aa, Artificial Sequence
  Synthetic sequence.
SELEEVAELLKRSKELIDEVEERIRRLATESLRFLDEVVRRIRELLTRLLKEVRDSGVPDELIELIERVIRLIEKVLEDIKRLIEKNIELAERVLEAIKRLVEEDIKLLIEVLRRKEEGRPEKDVKELLKRVEESVKRSLTEIRKLLEEVRKSVERTLEEVKKLAEDVLRLVEEVLKRAKDRGVDERLLKKTEDVVREILRLIEEVLRTHAEIIREILELIERLLELHKTLVDRLLERIE

SEQ ID NO: 27342 - protein, 240 aa, Artificial Sequence; identical to SEQ ID NO: 27341
  Synthetic sequence.

SEQ ID NO: 27343 - protein, 235 aa, Artificial Sequence
  Synthetic sequence.
SVLETVKRLAEESSERIRKIVEDDKRVADDSSRKIKELIEEIKRRVKELLDRIKDLDSTEDLEKLLDELLKEVKRLLEELLDAHRKWSDDSRRLLERVLRTHKELIDRLIKLLRDAGKPEEVVRRLEKVLRESLRRVKEVIKELIDLNKETLDRLKKIVEDLERVLREVLTELRRKRDKKEVVIRLIEELVKLLEDVLRRLLEVNETLVELNKRVWDRLVRINEELAEVALRVAT

SEQ ID NO: 27344 - protein, 235 aa, Artificial Sequence; identical to SEQ ID NO: 27343
  Synthetic sequence.

SEQ ID NO: 27345 - protein, 235 aa, Artificial Sequence
  Synthetic sequence.
SVLETVKKLLEDSSEKIERIVEEDERVAKESSDRIRRLVEEDKRVADEILDLIEKITDTDTLLKLVEEWSRTSKKLLDDVLKLHKDWSDDSRRLLEEILRVHEELIRRVKEILDREGKPEEVVRELEKVLKESLDTLEEIIRRLDEANRRTVKRVKDVIRELEDINRKVLEEIERKRDDKDAVIKVIEKLIRANKRVWDALLKINEDLVRVNKTVWKELLRVNEKLARDLERVVK

SEQ ID NO: 27346 - protein, 235 aa, Artificial Sequence; identical to SEQ ID NO: 27345
  Synthetic sequence.

SEQ ID NO: 27347 - protein, 251 aa, Artificial Sequence
  Synthetic sequence.
SIRELLKELEDVVREIIRDIRRLLEESRRVVERIERETKRLLDEIRDVARRIEETIRRLPLPEEVVKDVLDMIRRLVKEIEEVVRLHLELVREVLESHEKSVRDVEELIRRLVEVVREVVRKLEESRDKDTLKKLVEDIKRILEKILRDIERLNKENARLIERVTEELRRAADRVRKIAEDILRRIEKAGLKKEAVDELRRLLEELKKIVEDILRTLEKLNRELLEIDKRVADRLRELLRTLKKLIEEAAT

SEQ ID NO: 27348 - protein, 251 aa, Artificial Sequence; identical to SEQ ID NO: 27347
  Synthetic sequence.

SEQ ID NO: 27349 - protein, 230 aa, Artificial Sequence
  Synthetic sequence.
SKEEAIKELLKKHKRITEDIIRMARELDREHEEITREIAERLRRLLKKLLDDVRREVKDERLLREVKKILDEIEKILREALRRTKEILDETKKILDRALKETDEVLERIKELVERGEPKEEVLDAVRRLVELDKKAVDDWNRVNRDLVRVDKEVLKTLLDVIRELIKVLKARTDDERAKRVLDKILDDVRRLVEEAAKLLDESVKKSTDIVRRVRKLLDDSLKEVAELAK

SEQ ID NO: 27350 - protein, 230 aa, Artificial Sequence; identical to SEQ ID NO: 27349
  Synthetic sequence.

SEQ ID NO: 27351 - protein, 230 aa, Artificial Sequence
  Synthetic sequence.
KKEDDVRRLLKEHEDITREIIKLIRDLARKHLELNKRVIRALEKVLKDLEDEVRKDVRDKDLLRKIKELIKKVEKILRKALKDSKDLLKRLEDILRRALEETKKVLEEIERLLKEGRPREEILEVVKKLVELDKRALDEILEVVTDIVRVDAEAIETALRLIEEIIRELKANTTDERVRRVLDRVVERVAELVREWKELLKRSLDEVREVVKRARDMLRRSVKTVKELVD

SEQ ID NO: 27352 - protein, 230 aa, Artificial Sequence; identical to SEQ ID NO: 27351
  Synthetic sequence.

SEQ ID NO: 27353 - protein, 241 aa, Artificial Sequence
  Synthetic sequence.
DEVEDARKKLEDLERENRKVIKEIEDALRELVKDHDRVVEELRRRLRRLLEELKKLVDDRKRREETEERLRRLLEALKKLLKELIDKHREIAERMLELARRAIKISREIIEKVREILRRAGVPEDVVREIDKVVRDSLKRLEEVLKRIEEELRRSLKRLKEVLEEIKRKAEELEDILKKIKDEEMLKRVVDVLEDLVRTIEKVLRELSETLRELVRRLLELLRENNESVRRLIRILEEALR

SEQ ID NO: 27354 - protein, 241 aa, Artificial Sequence; identical to SEQ ID NO: 27353
  Synthetic sequence.

SEQ ID NO: 27355 - protein, 240 aa, Artificial Sequence
  Synthetic sequence.
SEDEAAERLLREAKKILKRLEDAARESLKSAERILEELEKAARDSLRKAEKIIRDAKRKGLDEKALKRAKEALEKAERDHRRALKRAREAIEEAAKRHKEALEEAERAIKRAEEEARKAKKESDERTAAKRLLDAVKELADAAKKAADRALKANEDLARAAKEAADEALEANKRLAKALRDDTTDKEAEKLATKLVEDSERAAREAKKLADENVKRSKEAAEEAKRLADRLVKEAEDDAR

SEQ ID NO: 27356 - protein, 240 aa, Artificial Sequence; identical to SEQ ID NO: 27355
  Synthetic sequence.

SEQ ID NO: 27357 - protein, 244 aa, Artificial Sequence
  Synthetic sequence.
SEDEELLKRLDELLKEILKVIEELIRRLEKAHKENMDKIRDSARRLRELLRKLAEDEREPTSEETKKRLVDELKELVRRSVEELRRSVEDLKRLVDEVRELLERLLRKLEKLVREIARELEKRSRSDELEKKVEELIRVAETVVKLVADVVRLLIEVAERAVELNREVVKEHEEILETVVELLARGGREELVKEILERVDRLLRKSLERLREVLEESRRRLEEVLRALEEVIKRVRDLLRKLRE

SEQ ID NO: 27358 - protein, 244 aa, Artificial Sequence; identical to SEQ ID NO: 27357
  Synthetic sequence.

SEQ ID NO: 27359 - protein, 238 aa, Artificial Sequence
  Synthetic sequence.
RKKEELARVLEESLEVNRKLVRDLAEVLRKDLEIIRELVKRLVEILKKILKVLADVIRKEELRRALKEAEEVLRKLIRTLEEVVRRHEEILRKLIEDLKRVVKRWEEVVDRLIKEIEDLEDVLRKLLEVVRRSVRELEKILERLKRSVEEVIKRITEVLEELEKLVRDLIDVLRRAGLDEETLRKVVEDLERLLREARRVVKEAVEKSRRSLEDLRRIIEEAIRRNEKILRKLKEIVK

SEQ ID NO: 27360 - protein, 238 aa, Artificial Sequence; identical to SEQ ID NO: 27359
  Synthetic sequence.

SEQ ID NO: 27361 - protein, 244 aa, Artificial Sequence
  Synthetic sequence.
KEDELLRRIKEVIDKTLEDMKRLLKKHKELLDEILRLLAELVEENKKLIDEILKLVEDSGIDEKALDELRRVVEEVKEEHKRILEEVARAIKRNKEKVDRVKERVEKVAKEVKDKLDELKRDSDKDKVVREIDRVLKELVDVIRELVKELIDSAKESVDVLRKVVEDSERVLRKLVDVLRRVLDSEEAKELVRRLKRAVEESKKKLDELVKDVKRLADDSARDLRELVKRIAELVKKIRDELRD

SEQ ID NO: 27362 - protein, 244 aa, Artificial Sequence; identical to SEQ ID NO: 27361
  Synthetic sequence.

SEQ ID NO: 27363 - protein, 244 aa, Artificial Sequence
  Synthetic sequence.
DAEEALKRAREVLKEAADLNRKAVEDARKILKDAADDNKRALEEAERVLRKALEDAKDARARNEDERKALKLLADAAKRIAKLIEDASRATADALRKIAEVIKRASELLARAAKEIARLAREAAERADDEDLRRIAEELAKRLEKLAKEHKDIADRIAEELKRLAREHNEIAKELARRAEELAKKARNAEKAAEDAKRLLEEAEEASKKLIKAAEELLRELAKASKRALDEARKLIEEAEKAAR

SEQ ID NO: 27364 - protein, 244 aa, Artificial Sequence; identical to SEQ ID NO: 27363
  Synthetic sequence.

SEQ ID NO: 27365 - protein, 244 aa, Artificial Sequence
  Synthetic sequence.
SEREDLLRLIEEVIRELIKLLETNLRLNEETIRTLIRLIKKDLDLNRRSVEELVKLLKERVRDEEKLRKVLEDLERILRKIEKVNRDVIEKLKEILKELRKIHERVIRELERILEELARVVEKLDSEDLARVILDILRKAADVLREVLERSERVTDKIAEVVEEVLRLNREMVREIIEVLKKVLDSEAADEVRKKLAEDERLNDKSLEELKRILDKDREINRRVAEKLTRILETLRKIIEDVAR

SEQ ID NO: 27366 - protein, 244 aa, Artificial Sequence; identical to SEQ ID NO: 27365
  Synthetic sequence.

SEQ ID NO: 27367 - protein, 241 aa, Artificial Sequence
  Synthetic sequence.
DDLERVLDELRRIIEEIKRRIDKILEDYERVLRDAKRLIDDVLREYRRIIEELKDLLDKVRSEEAVRRIIEVLKKLNEVSRKLVEAIIKVLRELSEISERMVRLAEELLERLVEVLAKGGLPEEVIKTLKKVVEELVRRLREVVKRDRELVRKVEKVLREAVERDKRIVDRIARLLERDGVDKDVLERIKRLLDELRRANEEVVRRVKKILDESLKENRDVVRELKKILDELLEIVAEAAR

SEQ ID NO: 27368 - protein, 241 aa, Artificial Sequence; identical to SEQ ID NO: 27367
  Synthetic sequence.

SEQ ID NO: 27369 - protein, 238 aa, Artificial Sequence
  Synthetic sequence.
SKKERLKKLIKEHLDLLRRLLKELEDLIRKHLELLRRLLRRLKELLRELLKLIEELVSDEKVLRDIRRVVERVLEELDRVVDRSEKVVREVIERLRDALRKNTEVVKTVIEKLDKIEDEDTALKVLEEVVKESVRLVEEALDIAVTVVKESVDLVRRLLDSLLAVAKELVDLLREVLRKADLRDRVEKEVRRALEKVERLIREIKRLVERSLEEVEKLIREIKKRVRDSLRKVKKESE

SEQ ID NO: 27370 - protein, 238 aa, Artificial Sequence; identical to SEQ ID NO: 27369
  Synthetic sequence.

SEQ ID NO: 27371 - protein, 242 aa, Artificial Sequence
  Synthetic sequence.
DEIETVLKRLAELIKESLDLLRETLDELRKIIEESKKSLEDVLRRLKELIDRLRRLAEEKTGEELLRLLIEVIERLLKVVEDLLRESNRVVERLIRVNREALRLSNRVVADLLKVLKDAAPDVEELRKLAEDVLRENRELSRESVKIAEKMLEENRDLTRRLKELAKKVLEEIRDLVRRVRDKDELLRRVEEILKRLLELIRRIIEEHRKILERLLETHEDLIRKHEEILRRLLKAADEERQ

SEQ ID NO: 27372 - protein, 242 aa, Artificial Sequence; identical to SEQ ID NO: 27371
  Synthetic sequence.

SEQ ID NO: 27373 - protein, 238 aa, Artificial Sequence
  Synthetic sequence.
SEKEDVLRRVEEIARRVRDILRRNLEKVERIAEELKKINDDLLKEIERIIKELKEVLRDVKDKDLVERLLRVLAELVDVLREVVKRSVEVLEKLIRVNEEVIERLREVLRELVEVLARGGVPREIIETLRRLVERLVKILEKNKEDLKRLVDENRDLAKKVLEILKELIKRLRDVLRERKEAIEEVLEILDRILKTARDVSKENLESLKRALELDRRTNERLEDLLREILELLRKDIQ

SEQ ID NO: 27374 - protein, 238 aa, Artificial Sequence; identical to SEQ ID NO: 27373
  Synthetic sequence.

SEQ ID NO: 27375 - protein, 246 aa, Artificial Sequence
  Synthetic sequence.
SELEELRKLAEEAIEAAKRALDRLHKLSRELIEAAKEILKRLKKLSEDLIRAAEEAARRSESEKALEDAKRAIDELRRATERVEKRVREAIKELEEANKRVAERARKAIEELKEAVRRVEERARRGETKEAAEEALKAVRDAAKAAREAAEDHLRALKKAAKAAEEAAEEHLRALERAARAAEEALRGEDAKRAKEIAKEAIERSKKIADEAREIAKRAIDKSKKIAEEAKKIADEVLKRAEDIAR

SEQ ID NO: 27376 - protein, 246 aa, Artificial Sequence; identical to SEQ ID NO: 27375
  Synthetic sequence.

SEQ ID NO: 27377 - protein, 250 aa, Artificial Sequence
  Synthetic sequence.
RESEELIRLLRKIIELLEELVERIRDLLRKHLKLLEEVVELLKRNLDEILRLLEEVLREANVEDAKKVLTDVADLARKSLERIKKVLEDSRRLAEEVERAVEEVLERVKRLVEELEETVERLKDGRKEEVLKVAKDILDKIVELVERLLRVVIEVVKKSIDLLERLLEEHERVVTEIIKLVKRLLEKAVKDTEKAKKLEELLRDLLRTVREIVKEVRELLEESLRTAEKLVEDIKRELDELRKRLKELVD

SEQ ID NO: 27378 - protein, 250 aa, Artificial Sequence; identical to SEQ ID NO: 27377
  Synthetic sequence.

SEQ ID NO: 27379 - protein, 239 aa, Artificial Sequence
  Synthetic sequence.
DEERLVEEIIRTIKRVIELNEESLREIERVLEEVIKMDKRSLEEIKRVLDEILKLARDGDVSERLVERVERLVRRLIRKNEEIVRRVREKVERLIRKNRTLVDDVRRKVKELIEKLRRTGLKEDLERVLRKILELLERLSEDTARVLEELLRLLEELSRRTAEVLKRLLDILRELAKLRGEELERVLRELKKVLEELIKDNERVNDELRRVLEKLKERNRKVLEDIKRVLEELRDEVER

SEQ ID NO: 27380 - protein, 239 aa, Artificial Sequence; identical to SEQ ID NO: 27379
  Synthetic sequence.

SEQ ID NO: 27381 - protein, 241 aa, Artificial Sequence
  Synthetic sequence.
SSEEIIRTLEKAIRESEEKLERLVRRDEEVVKDLRTKLRENLDRVRRMVEELVRMLESGKPAEDILREAERLSKENIETLEEILKKAERVSEESIRVLEEILKENEEVVRKIIKDLPKTEKADEVVERLKELLKRSEDVIRKVVEDSERLLDRLRRVIEDVVRRSRELLTKLREVVKRVRDKDTLVKVLKEVLERHVEADEKAVRELAKVLEENVRLLEELVRVNKEVLRRILELVKELAK

SEQ ID NO: 27382 - protein, 241 aa, Artificial Sequence; identical to SEQ ID NO: 27381
  Synthetic sequence.

SEQ ID NO: 27383 - protein, 233 aa, Artificial Sequence
  Synthetic sequence.
SKEEKLKDDVRRVLEDLDRVLKELEKLSEDNLRELKRVLDRITDLHRRILDELRKKITEEELLRRVEKVLKDNLDLLRKLVEEHKESSERDLKRVEDLVREIKEVLRKLLELEDRDTDIRKIEEEIERLLRKIRKAVEESKDLNRRNSERIEEVMRRSEELARRLLKEIRERIDSKVAEDILRVLEKLVKVSREAIKLILELSEHHVRVSTRIARLLLDVARKLFEVIKEAER

SEQ ID NO: 27384 - protein, 233 aa, Artificial Sequence; identical to SEQ ID NO: 27383
  Synthetic sequence.

SEQ ID NO: 27385 - protein, 233 aa, Artificial Sequence
  Synthetic sequence.
KKEDELEKMVRDVLEDLDRILREAEELSRKNNDDLRRVLDRLRRLAEEVIKRLEEKVTIRELLEELKRVIRELLRRVKELVEEHHRSSREDNRLLKELVERIKKVLEELLRLVRNDTDRREIKKLLDELKRLIEEVARESRELNKKNSERIREVVERLERLVEKLLEDVARTIDSEVARVILEILKRLLKALKEAAEELKKISEHHLRVSEKVVRDLDRVVKKIVDVARRVAT

SEQ ID NO: 27386 - protein, 233 aa, Artificial Sequence; identical to SEQ ID NO: 27385
  Synthetic sequence.

SEQ ID NO: 27387 - protein, 242 aa, Artificial Sequence
  Synthetic sequence.
SEKEKLLRDLEEVVRDVIRLSKESVDKLKETVDRLVEESRRTVEELRRIVDRVAKEVKSKEVLDKTRDIVRKVEELNERIIRAIEDLVRKVEKLNEEVIRAIEEVVRRMAELIRDKREDKERVDRVVKELADELRRVLEKYEKILRDLARELKKLVDEHRRVVRELAEELRKILKELKDKRGDDEIVKLLEDVVRELVEVLRKSTEVIERAVKKLVDILRESLKLIEDVVRRLVEIMEEIVR

SEQ ID NO: 27388 - protein, 242 aa, Artificial Sequence; identical to SEQ ID NO: 27387
  Synthetic sequence.

SEQ ID NO: 27389 - protein, 238 aa, Artificial Sequence
  Synthetic sequence.
SEIEDVIRRLRKILEDLERVSEKLLREIKKILDEARRLNEEVIKEIKRVLEDAVRVFRDIRERKEELRKLVEELIRELRKLAKEVDEIHKRIVERLKKLVEDAERIHRKIVETLEEIVRRVPREELKRVVEAIVEVIKEHLKVLKDVIRRIIKAIEENAETIKRVLEDIVRVLELVLRGEKRIEDLVREVERLIKRIEDSLRELEKTVRELLKRIKEASDKVREDVDRLIKELKEAAD

SEQ ID NO: 27390 - protein, 238 aa, Artificial Sequence; identical to SEQ ID NO: 27389
  Synthetic sequence.

SEQ ID NO: 27391 - protein, 246 aa, Artificial Sequence
  Synthetic sequence.
SREEIVATLEDLARKILEVVKKLAKEIEDAWREIERKVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLEELELERELVKELVELLEEILERNTRVIKEIIDLLRTVIRIHEKIVEDLIKLLEELLRRLEEATR

SEQ ID NO: 27392 - protein, 246 aa, Artificial Sequence; identical to SEQ ID NO: 27391
  Synthetic sequence.

SEQ ID NO: 27393 - protein, 237 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKDIEEELAREVERVIKELLDKSKEILERIERAIDELLKVSEEILKLSEDASEELLKILREFAK

SEQ ID NO: 27394 - protein, 237 aa, Artificial Sequence; identical to SEQ ID NO: 27393
  Synthetic sequence.

SEQ ID NO: 27395 - protein, 237 aa, Artificial Sequence
  Synthetic sequence.
DEKEEALKTVERIIRDIVRRLRELLKEHEDIVREIERELKEVHEKHKRLVEKALEELGTEDDILRKVEELLRRHNEILEEVIRRVRELLRRHHEVLERIVERLRELMKRLLDVIRRGEPEDELRKILRELLETVKRIAEELRRLSKRLLDEIRRLAKELEDVSRDLERRVRELLKDLEDRLADLIRRAVDRLRDISREILKRLVEVIERLLEVSEKILKLVEEVIRELLRVVEEAAK

SEQ ID NO: 27396 - protein, 237 aa, Artificial Sequence; identical to SEQ ID NO: 27395
  Synthetic sequence.

SEQ ID NO: 27397 - protein, 251 aa, Artificial Sequence
  Synthetic sequence.
SVVEILAEVLKRLLDILRKLVDAIRDVVKKHVEVVEKLVRLHEEVLRRLVDILRKIAEVREGEAVKRLLEEARRVLEDILRKSKKINEESERIIEEVIERIEEILRRIEEKLKEILDEIRRAGIPESKKRIVDELVKLVREILKELKKVVDDWAEIVRRLDEESKRLNEEALKIVEDLLRKLEDLERKPVDEEILRRLVEEAKRLVAESIKKLRDLVRKIREAHKEAIKRLEEIVRKVEEIVRKVIDELRK

SEQ ID NO: 27398 - protein, 251 aa, Artificial Sequence; identical to SEQ ID NO: 27397
  Synthetic sequence.

SEQ ID NO: 27399 - protein, 248 aa, Artificial Sequence
  Synthetic sequence.
SDEEKLRRLLEEVRRLAKRVIDELERVLRESKRLAEENIEELDKALEEVKRLIDDVIKKLRDGARIEEVVEEIRRVLKRVVELLRRVSDDTRRILERNVELLERIVEKLERVLRRVVRVLEDVTREERLKELVRRVEELLKEVLRRVREIVKRLADLHRKVLKESEDLVRKVEEIAKDIVDKLRTTTDSETIERLLRELLKVLKEIVDRHRRIIERLLKASEDAVRELKKLIEETLRVLTDVVRRTET

SEQ ID NO: 27400 - protein, 248 aa, Artificial Sequence; identical to SEQ ID NO: 27399
  Synthetic sequence.

SEQ ID NO: 27401 - protein, 235 aa, Artificial Sequence
  Synthetic sequence.
SLVDELRKSLERNVRVSEEVARRLKEALKRWVDVVRKVVEDLIRLNEDVVRVVEKVTVDESAIERVRRIIEELNRKLDAVLKKNEDLVRRLTELLDKLLEENRRLVEELDEDLKRRGGTEEVIDTILELIERSIERLKRLLDELLRIVREALKDNKRVADENLKKLKEILDELRKDGVEDEELKRVLEKAADLHRRLKDRHRKLLEDLERIIRELKKKLDEVVEENKRSVDELKR

SEQ ID NO: 27402 - protein, 235 aa, Artificial Sequence; identical to SEQ ID NO: 27401
  Synthetic sequence.

SEQ ID NO: 27403 - protein, 229 aa, Artificial Sequence
  Synthetic sequence.
SKEERLREVAEKHKKDLEDIVKRVDEAAKETKRRLEEILKRLEEVLKKILDDLEKGPDDEKLKKVKKILKDIMDRLRELIKKILKLLKENLEKIKELLRRNLEISEELLKLAKDLRDRDVLETVRRVLEKLDEEWDRVLEDSRRIIETILRELDTLLREVEKLIKEIKDEIKDLKEVLDILERAVEVVRRVIKALKEVLERHVDATREVIERVKRVNKRLLEAVREVVT

SEQ ID NO: 27404 - protein, 229 aa, Artificial Sequence; identical to SEQ ID NO: 27403
  Synthetic sequence.

SEQ ID NO: 27405 - protein, 232 aa, Artificial Sequence
  Synthetic sequence.
SREEKLEELIKELERRLKDVLDRSRELNREIRKTTEEVIREVDRLLREIEKIVRDVRLPREIVELIDRLIKRLREILKEHKELVDEVIRRNEKSNRELVKLLEEALREARREGADEKLIRVAEELLKRIEEIIRRNEEIIKDLKRRSKRLLEEARRVVKDLLRRLEELLRRLDEDTARLVREVAELIEKVVREIVKLIDEDLKKLERVVRENARLLREVVELLLKVVRDVAK

SEQ ID NO: 27406 - protein, 232 aa, Artificial Sequence; identical to SEQ ID NO: 27405
  Synthetic sequence.

SEQ ID NO: 27407 - protein, 244 aa, Artificial Sequence
  Synthetic sequence.
DEKELLEEIIKKVEDLLRESRELWERLIKRVKELLKRSKETVDEILKRIKELLDELRKVAAEGAPEEELVKKIKEILETVKRLIEEHIRTNEEVLKEILELLKRIIERNRKVLEDVLKDVTDTGVPEEVLKELKKVIDDLERLNEEVLKEATEVLKRLLDINARVLEELDRVVRELEDLLRRLTDKRLLDVIKEIVEKLIEVVRKLLEADKRIIEELIRVLEKIAEVDETIVKRLIEVLKKIAD

SEQ ID NO: 27408 - protein, 244 aa, Artificial Sequence; identical to SEQ ID NO: 27407
  Synthetic sequence.

SEQ ID NO: 27409 - protein, 244 aa, Artificial Sequence
  Synthetic sequence.
SEEEDIERVLRELKKLHKDHLDLLREVVKRAEELLRRHLEILREVLKREKKLLKDVLRDARRREEAEEVVRRVEKELDRVLEDSERVLRELLERLKKVLEEIKRVHERVTRDLERVLRELRDVRSEEVAKLLTELLERSIRVIEESVRLSRRALEVLIRVIKESVDRLEELLRDLIRVLKELRDKGVITDELLEEAKKLVKEVRELAEETLRRLARLVEDVKRLNDEAVKRLRELVRRIKEEVR

SEQ ID NO: 27410 - protein, 244 aa, Artificial Sequence; identical to SEQ ID NO: 27409
  Synthetic sequence.

SEQ ID NO: 27411 - protein, 237 aa, Artificial Sequence
  Synthetic sequence.
RTEEILREIVDLLRRVAEENLRTLEELVELLDRVARRNLESLRELVRILEEVLKKLLKKDKDEELKRVIDEIKKVLEELIETLKRVIDESREVLKEIRKTLEKVIRETKKELERLIELLRRGVPVERLMEELKRLLDRHKDVIRKLNELLKRLLERHVKVVRDLNRALKALAEKIREDIRDEDVLRELDEVVRRVIERDREILRELKRLVEEVIRKNEDIVRKLEEAVERVLRKLKD

SEQ ID NO: 27412 - protein, 237 aa, Artificial Sequence; identical to SEQ ID NO: 27411
  Synthetic sequence.

SEQ ID NO: 27413 - protein, 239 aa, Artificial Sequence
  Synthetic sequence.
SEKEEVIKDLRKVLEEVLRRHEELVERLKEVLRKVLEDHKKLVEDLKRVLDEVRRKLENNADLETVIKELLEVIRRVLEDSNRVVEELVRAVEEVLKESIRVVKRLIDTVDELLRRLTRTEDVKEIVDRIRKKLKELLDTNRELVERVRKLLEELVETNRRLTEEVKRKVEEILKLARNGLDREELLRRLERIVEDIIRLLEESLKLAAEVIKTIIRLLEESLERLKRLVDDIVEKLRK

SEQ ID NO: 27414 - protein, 239 aa, Artificial Sequence; identical to SEQ ID NO: 27413
  Synthetic sequence.

SEQ ID NO: 27415 - protein, 243 aa, Artificial Sequence
  Synthetic sequence.
SEKELLERLEEVERRLLEIVRRLLKRNRDVHEELLRIVEANLRRNKKVHEDLLEKVRKSVRKEEVKKVIDEVDKKSKESLEELKRVIEEVKRLSEETLKKVEKVIKEVEEELRRVLDEARRNPDKDVLKKAIEVARRIIEELARVLKDDIDRLRELIKTLADVLKKDIDELRRLIKRLMEEERVDKVVKELEDIVEELMEENKDSLRRLKEIVEELLEENRRVLEKLRKIVEDVARELEETAT

SEQ ID NO: 27416 - protein, 243 aa, Artificial Sequence; identical to SEQ ID NO: 27415
  Synthetic sequence.

SEQ ID NO: 27417 - protein, 234 aa, Artificial Sequence
  Synthetic sequence.
SIEEVLREIVKLLREVLERLIRVDERLVEALKRVAEKNIEVLRRAVDALRKVLELLRRGQDKRDVDRELRRVLDEVKKEIERSIEELKRVLEEHRRRIRKIIEELKRVLEEARRKLKSERLLEKLTRLVEKTIRAIEKLHREWERILREHIRLLEELLKRLKELLDELRKLIEDGEDEETVIRRVEDVLRDLLRRLEEVVRRSTEEAKRLLKESRDVVRDVEKTLRELLEELRR

SEQ ID NO: 27418 - protein, 234 aa, Artificial Sequence; identical to SEQ ID NO: 27417
  Synthetic sequence.

SEQ ID NO: 27419 - protein, 234 aa, Artificial Sequence
  Synthetic sequence.
SVEEVIRKAVTDLDRVLKTNIRVDERLIEMLKRVADENREVLEKIVRLLKEVLDLLRNGRDERDVAKRLREVLEEARRDIERSIRKLEEVLRRHREAIKRSIDELREVLERLERKLRSEDVLRKLEEILREHEDMLRKLHEEWERILRRHIELLKRLLEKIKRLLEELLRLATEGEDEKEVVDKVKRVLDELRRDLERVVEESEKLARDLLRKSRDVVRRTRELLKKLLEEVET

SEQ ID NO: 27420 - protein, 234 aa, Artificial Sequence; identical to SEQ ID NO: 27419
  Synthetic sequence.

SEQ ID NO: 27421 - protein, 247 aa, Artificial Sequence
  Synthetic sequence.
SRRETLEKLLKEIEDLIRESLERLEKLLEENRTLIDDDERRVRELARDIKELIKEIEERLRRENVEEALKVVREVLRIADEAIKLHIEASRRVLELSRRLVEDHKRATKEVLELLRELIRRLIEVEERKEDKREVKKDVERILREIEERLEEVLRRNREIHEEIKEDLKRVSKEVRDLLREIKKTLEDGKVSEEILKIIEELIKRLEKLNEDSNELMKELVKRNERLARENLKLVEELLRRIEETTR

SEQ ID NO: 27422 - protein, 247 aa, Artificial Sequence; identical to SEQ ID NO: 27421
  Synthetic sequence.

SEQ ID NO: 27423 - protein, 234 aa, Artificial Sequence
  Synthetic sequence.
SEVERLRELVERWREELKKLLDELRKVVEEIARELKKINDELRKLVEDIAREARRETKKRELLKELLTRLIKLLEEANERVRDLLRRLLEIIDEILRRLRELSKRLIEEARRETREERVKRALEEVVRTSEEILRELKEILDRVREELKRINDDSRRIIKEVVDRLREILEKADKDDDERVIEELIRVLRKVVEDHADVTRRLVEVLRKVVKLIEEVLKKDEKVLRDIVDRLKT

SEQ ID NO: 27424 - protein, 234 aa, Artificial Sequence; identical to SEQ ID NO: 27423
  Synthetic sequence.

SEQ ID NO: 27425 - protein, 237 aa, Artificial Sequence
  Synthetic sequence.
SEVEEVVRVLEKVLRLLRRLVEELHRLSERVLELITRLLKELKDLSREVIKRLEDANIDDRVREKLKRVHEKLERVVEEVLRRIRTVNEDLKRVVKKLEEKIKKVIDELRRENASEEALRKVAKVIRDVVEEAKDVVRRHVEVVRDVIRLLEEAIESHVRVVRRLIEELLRKLAEERKKEKIDELRRVLERVEREHRRVIKKIRDVVEKVKRDHERVLREVEKVVREVRTELEKLRE

SEQ ID NO: 27426 - protein, 237 aa, Artificial Sequence; identical to SEQ ID NO: 27425
  Synthetic sequence.

SEQ ID NO: 27427 - protein, 253 aa, Artificial Sequence
  Synthetic sequence.
SVEEELRELVKRVEKLVERLRRIVKEIIERSRDLVRKSREVVDRLKKELDELVKEVVREEGEDSEVVEVIEKLVRLATRALELHIKSLEKHVKLNEEALRRLIEVIEELVKLIREVVKELLRITRRGEPEEELKRIVDRAKEEVKRVLKKLREILEEWKKKIRESLKENKTIVDKVKRDIERVLEELEEAKVASDEVIRRIAEVVKRLIDKLKELSDDNRKAVEDHERLVRKAIEELVREVEDILRRIDETAR

SEQ ID NO: 27428 - protein, 253 aa, Artificial Sequence; identical to SEQ ID NO: 27427
  Synthetic sequence.

SEQ ID NO: 27429 - protein, 241 aa, Artificial Sequence
  Synthetic sequence.
SEKELLKEILDRIRELLEDDNRLLKRIVDEIRKLLEEWLRVHKEILERIKELLDRINAPEDVIRELTRALKETEEDVDRVIRTLEKLLKEVLDRHEEVVRKLDRLLKEVERLVEERDAEEVVRDLLRVVKEILDESKRVIDELARVVDEILKLLEEVDRKLAKVVKEILEDVLRAKKDDEDMVRKIRKIIEELKRLLEDLRRDTRRVIEEAKRLLKEWRDRNKEVADTLKKLLEDLIRKIR

SEQ ID NO: 27430 - protein, 241 aa, Artificial Sequence; identical to SEQ ID NO: 27429
  Synthetic sequence.

SEQ ID NO: 27431 - protein, 242 aa, Artificial Sequence
  Synthetic sequence.
REDEIVEDWRRLLEEAKRRSEEVAKEIRDRAREVTKESKRVADEWRRLLEEVKKRAENIDERVLKLIDDNIRDVERIIRRHEEIVKTLIRLLEEILDRHRRLVERNIESVDRLLKAVKNGEPIEELVRRIEDLSRKLVETNRKLSEELKRMAKKLLDENRKLSEELVKRSRDVVKEIEDGGLGEELVRVARDLVRLNEEVLRKSNRSVEELLKALARVLDRSNKSLEDLVELNKRVLDKLRT

SEQ ID NO: 27432 - protein, 242 aa, Artificial Sequence; identical to SEQ ID NO: 27431
  Synthetic sequence.

SEQ ID NO: 27433 - protein, 242 aa, Artificial Sequence
  Synthetic sequence.
RKEDLVREWRELLRKILEDLEDLVRKWRKLLKKILDDLRELVRRVREELDKALRTVEKGELDAEEVLKELERLVEEIIRAVRELLKRLSDLNKKVLDELRRLVERLSKLNKEVLDKIREEERSRKIEEILRELEELNRRSLKKLEKILKELDEADKRSLKEVEDVLEELKRRIREILELMKAGKDLRDLVRKIIEIIEDILRLLEEVLRKNVKAVEEVLRLAIRVLEENIEAVEKVLEDVRR

SEQ ID NO: 27434 - protein, 242 aa, Artificial Sequence; identical to SEQ ID NO: 27433
  Synthetic sequence.

SEQ ID NO: 27435 - protein, 243 aa, Artificial Sequence
  Synthetic sequence.
SEEELLREIEKILDEVRKLVEKLLEDNRRLADELIKLIKELLDRNLRLIERLLELLERGTDADELVKEARRMLEESKRLVTELVKTVEDVLRKSERLVEELERRVRELLKRLKDLVRETGGDKLKKVIEDLERVLKELLDALREVVKRSVKVWRDLLRALDDVVRRSVEVVEELLRVVKETGPGEELREVLERALRKAKKIHEDLKRIVEDVRRRNDEILKDLERVLKEVEDKIRKILDELRK

SEQ ID NO: 27436 - protein, 243 aa, Artificial Sequence; identical to SEQ ID NO: 27435
  Synthetic sequence.

SEQ ID NO: 27437 - protein, 235 aa, Artificial Sequence
  Synthetic sequence.
RDEDIKRELVRLVEEILRTSARLLDESIKSNKKTLDDIERVAREIVREIEELLKRIADGNKLDEEVLRRLVEKIRRAIEEVERLLERLKEKIKRSIDDLKRVLEETARRLEDVLDKVRKDEDKDRVVERLIKVIREVLELDKRLSEENLKVLKEVLDLVETVAKRLIDVLKEVADDIKDADELKKDIRDVLERVKRIAEELRELVERDIREDKRLLDELAKLWRDLLKMIEDLRR

SEQ ID NO: 27438 - protein, 235 aa, Artificial Sequence; identical to SEQ ID NO: 27437
  Synthetic sequence.

SEQ ID NO: 27439 - protein, 248 aa, Artificial Sequence
  Synthetic sequence.
SEDELLEKIVRKLREAVKRIEEELRKSKREIERLVKEIKEKLEDSLRRVKETLDRIRETRKKPQDEEVLERLVRTLEELLRRHLKLIEDIARELKKLLKEHLDRIETIVRDLKRLLKEILDELERTGLPREVLEKVRELVKTVARLLDEVLKNNKKLLDDLKKELDDVLKNNKRIVDELRRLLERVRRRKEDLEELLRLLKEVIERSIESLERLLELILRVLEYSVRSLEELLRRLLEVIKRIVDTTK

SEQ ID NO: 27440 - protein, 248 aa, Artificial Sequence; identical to SEQ ID NO: 27439
  Synthetic sequence.

SEQ ID NO: 27441 - protein, 237 aa, Artificial Sequence
  Synthetic sequence.
DEDEIAEELKRLLREVEEKSKEIVRRMRELAREANKKSEDILRTLEKLLEELRRRVEENRRSSKAVLDKIREVLETLKELLDRHHETVRDLVRRLKELLDRHNETVKKLVEDIKRLLDESGGRREIKKRLEDALREHNRIIKEIKKLLDKVLKDHKDILDDIKKKLDDVLREVTEILKRNRIDEVVRRIERVIREVIKILARANKRLHDVVEEIIRLLEEVTDELRRVVEEVIRRTK

SEQ ID NO: 27442 - protein, 237 aa, Artificial Sequence; identical to SEQ ID NO: 27441
  Synthetic sequence.

SEQ ID NO: 27443 - protein, 238 aa, Artificial Sequence
  Synthetic sequence.
DKEEEVRRLIEENLKKIEEVIRELEKIIRDNLRKLEEVVREIEEELETTLRLIETDGVSEEVLREVLKRVEDIMRKLRDVLREVRELHEDVLRKVEEVLKDVKRLHEEVLKKLEDGLDLTKVLEELRRINDKLLKKVKRVLELLEEINRRALELVREVVERLLRVIERLIDLLRRSGVDEDLLRKLKELLETLKRRIDEIEKKLEEILKETKDLIRRLLEKLKRIDEELRKTLEDLRR

SEQ ID NO: 27444 - protein, 238 aa, Artificial Sequence; identical to SEQ ID NO: 27443
  Synthetic sequence.

SEQ ID NO: 27445 - protein, 242 aa, Artificial Sequence
  Synthetic sequence.
DDIDEILRRLREEIEDARRKLEKILRELRERIKDYKRKTDELLKESRKRIREAEDRVRRDGARDELMRKLSKEDEELTERLVRTHEKALEDLTRAVERLLRLLKELLERLKRILEEIRKRGRVPEELVKRLREVLKEVERRVEEALKRVKDVLDKSKRDLEEAVKRNREVNKKLRDEVEKRRDDKVLEALLEKLLRSNEELVKIDRDLLRDLLRVLEELIKTVRDLLRELLRVLEEVAREIK

SEQ ID NO: 27446 - protein, 242 aa, Artificial Sequence; identical to SEQ ID NO: 27445
  Synthetic sequence.

SEQ ID NO: 27447 - protein, 242 aa, Artificial Sequence
  Synthetic sequence.
REEETLRDIERLLRKLLEELKRTADELIDSHRKLIKKLKEILDRLRRSHEKLIETLRRRLTDEEVLKEIIEVNKKVLDDVTRILEEIERLNKRAIDRVKEILKRIEDTLRKVLDDVRKDKDKDRVLDKILDVLRKVVELLKRVLDESARVVEEVLTLVKEVLERSLEAVEESLRIVERRLSDKEDVKRELREVVKEHKEDLDRIKKELKELLDRHTETLKRIVKKLRDLLEEIRKALEDLKK

SEQ ID NO: 27448 - protein, 242 aa, Artificial Sequence; identical to SEQ ID NO: 27447
  Synthetic sequence.

SEQ ID NO: 27449 - protein, 232 aa, Artificial Sequence
  Synthetic sequence.
DEERVVEEAIRVLKEVLDLHRELIKRSIDVLKESLKVHERAVESLERVLKEILDLVRRGKREELDRVIRRVMEDLKRVHEELREIHEEVIRRLDEVHRRLKKVIDRLKTRLREELRIEKRLRDAEEILDRLYRENERVLRTLKKLHRDHYETNRRALETLLRLLEETEKLDKSGTKEEEVAERVKRIIEEVRKLAEDSRRKTEELIRRVKELAERTDETVRRVIEELRRRTK

SEQ ID NO: 27450 - protein, 232 aa, Artificial Sequence; identical to SEQ ID NO: 27449
  Synthetic sequence.

SEQ ID NO: 27451 - protein, 232 aa, Artificial Sequence
  Synthetic sequence.
DEEDVARKLIEVLKELLKLVEDLIRTNIRVLEESLELHRRLIEEIEKVLKRILELLEEGRREELERVARELLKELDRVHEELKRVHEEVIRDTDRVLKEIEEVVRRVLKELREEVRIEEKLRDMERILRKILEDIRRLVKRLKKLHEDHYRTNEEVLRETKKILKRTLELVRSGTDREELAKEVKRVIEELKKLARESAEESKRIIRTIEELLREARKRAREVIEELKERTR

SEQ ID NO: 27452 - protein, 232 aa, Artificial Sequence; identical to SEQ ID NO: 27451
  Synthetic sequence.

SEQ ID NO: 27453 - protein, 237 aa, Artificial Sequence
  Synthetic sequence.
DAEEVLRLLAEVLERIIELIKKVNEILIRVLREVIRLIEEVNELVREVLKRIIELIRRDIDDEDVRRLVERIKTVAEELHKEVRKLVKEIEDLARKSNEDVRKLVKDIRRVVEELKRANLRKDRLAEAVEDLLRRILEAIKRHLRKAEEIIKRILEAIREHLKKLRELAKEIKDAARKAGVDERILEEIERLVREVEEIHERVLRRLKELLKKVREVHEEVLRRIERLAERVREALK

SEQ ID NO: 27454 - protein, 237 aa, Artificial Sequence; identical to SEQ ID NO: 27453
  Synthetic sequence.

SEQ ID NO: 27455 - protein, 239 aa, Artificial Sequence
  Synthetic sequence.
SVREELEKVIREVIEEVERVLERIRDELRKSLERLKEVIKRIEDVHRDLIRRIREIKDLEKVLRLVLDVLKKVSDLTRELLRENLEVLEKIAKLLEDLARSLLKVIRRLLEILIREFKDDEELLRRLKELVDKIRKILRDLLERVKEVVDRHRKKLEELLKRDEDLLEEVKRRLDDIRRENVPIEEVLKTVEDISRRHRELLKRILDTSKRSIEETLKLAREILETLKRLLKELLDAAK

SEQ ID NO: 27456 - protein, 239 aa, Artificial Sequence; identical to SEQ ID NO: 27455
  Synthetic sequence.

SEQ ID NO: 27457 - protein, 240 aa, Artificial Sequence
  Synthetic sequence.
DAEDEARRVIDEAVDRLRKAVEEIAEVARRHLEEVEEVVRKLEEIIRESLERVRRASEAREDRALEKIATELRKLNEDVRRELERAAEESRRKLEELRRRLDKVVKDLRELLKRLRDSGDVAGEVLEALKRVIDTVVRLLEEVLRRLAEISEEVLKLLREVLEKHHDVTRKVVDLLRKVRRDKEAEEVVRRVERLHEDVLRRLKEVVKRVKELHEEILDRLREILDRVRELARKVREDLR

SEQ ID NO: 27458 - protein, 240 aa, Artificial Sequence; identical to SEQ ID NO: 27457
  Synthetic sequence.

SEQ ID NO: 27459 - protein, 233 aa, Artificial Sequence
  Synthetic sequence.
SEKERLSKIAEDLIRRLEEELERVERTHERLLRKLEELLKKIEKEYRDAMRKLETLTGVSERTLEELVKELIDISRKIVKRLEETVTELREINDRLVKRIEDLIRKLIEDLTREVEKKEVLERISRELEEVIKRLRKVVDESRRKIEEVLEELRRAAEESTRALEEVLKELKRGKDIKEVLDDLKRVLERDLRAIKKIVKELKRILKENLDVLREIVERIKRVLEKILREVEK

SEQ ID NO: 27460 - protein, 233 aa, Artificial Sequence; identical to SEQ ID NO: 27459
  Synthetic sequence.

SEQ ID NO: 27461 - protein, 248 aa, Artificial Sequence
  Synthetic sequence.
SREERLERVLERVKRAIDRYRDMLRRLLKTVEDLIRKYEEDLKRLLKEAKELIDKVKEENKDVEEVKRVLEKLLKVLEDLVRKVRKSAEDLREIVKKLVTDVERSLELLLKIVTELVEAAKRTETKEALDKVLTEAKKKVDEVLERSRKVLEDVRKELEEVLKHSEKVLREAKKELEKIIKEVEDAGTDEEIKKIIDRLREEIERILDELRRLNEELVETLRRVLETLRELNERLVKLLRDLLREEKK

SEQ ID NO: 27462 - protein, 248 aa, Artificial Sequence; identical to SEQ ID NO: 27461
  Synthetic sequence.

SEQ ID NO: 27463 - protein, 246 aa, Artificial Sequence
  Synthetic sequence.
DEEEKMKKIEDVARRYKEEVKRVLDDLERLLRESEEEVERIVRKLEKLARDLEERVRELTKKEVVERLVRELLKAIKELIDVLRDVVRLSAEVIKELLDVLRELVELNLRAIKEIIEVLKKLKSEEVKKRLDEILEKIEKVNTDVNRRLKEIIRKLREIHEEVLRELDKILRDIERVVRDVERRIDDKEVIDALKELLKVLEDLLREIKEALTRNLEKIDELLKLLHELSRRVIEELRKLLEDLKR

SEQ ID NO: 27464 - protein, 246 aa, Artificial Sequence; identical to SEQ ID NO: 27463
  Synthetic sequence.

SEQ ID NO: 27465 - protein, 241 aa, Artificial Sequence
  Synthetic sequence.
REDEELARKAKEVLKETEDLLRKLEEEVKRVLEEIKRMNREVREKVKEVIKELRKRLKDLREVLKELEELLEELLRSDTEVSRLLEEIVTRVLRVLEKVVRESKKAVDKILEVLKKVKGKDVVKLLKDILREIEKVHREVLKELDDLVREVEKILRDNIETLRRILEKIRRILERVAREKDDKRLLDLLRDLLRLLKELLETLEKLNERTLKLLRDLLRKLKEALRRNLKLLRELVDEAAT

SEQ ID NO: 27466 - protein, 241 aa, Artificial Sequence; identical to SEQ ID NO: 27465
  Synthetic sequence.

SEQ ID NO: 27467 - protein, 237 aa, Artificial Sequence
  Synthetic sequence.
SKDEIIKRIKDELEKLVRDVERLLRESERRIADLVRRVREILEESKRRVDELVKRVKETGNTEELIKTIKDLLRRNLEKLRRIIEEIKEVLRENNELVDRTLKRIKDLLRELLEMIRRAEIDEERLRELEEILRRVLDTLRRLAEELHETSKRVLEELDRALREIEEIHRRVLKELDDTGDVETILRVATEVVKESATVLKRILETLEEALKRNVRIIEEMLEILREVIERIARKLK

SEQ ID NO: 27468 - protein, 237 aa, Artificial Sequence; identical to SEQ ID NO: 27467
  Synthetic sequence.

SEQ ID NO: 27469 - protein, 230 aa, Artificial Sequence
  Synthetic sequence.
SEEEILREIKRLLEEHLELNERILREIKKDNKRTLKELRDIVRELKEILERIKRRIRIKSEKAKEVDKIIREVERRIDEVLKEIERLIREDNKKLDDVHEESEREIRRVIKDADRTDDLKTVVDEVRKVVDRDLKLLEELSESNIRVLEEVLRLLEELLRILEEVLKEILKASESEELRKLLEDARRALERILRRLAKIVKEIKEKHEEVLRRLEKSVREIDERLRRARE

SEQ ID NO: 27470 - protein, 230 aa, Artificial Sequence; identical to SEQ ID NO: 27469
  Synthetic sequence.

SEQ ID NO: 27471 - protein, 247 aa, Artificial Sequence
  Synthetic sequence.
SELERLERLLKEIVEVNRKALEDLRRVLEETVRRDREVLDRTRRKLEEIAEEILRELKNVKEVRDAVKELEETLREVVRRSEELLERLREIVDRVVKEVEDSNRETEKKLRDVVDAVRRGRDDKTLVAEVIEVILRDLKRNLDLLERLIRVTVEVLERSLELIKRVIEVLRRVLKRVLDIVRERRKERREDLKRLEDLVKRIEEELRRKLEKYERELRDLKRKLEELLKRYEEKVKELKRKLDEALK

SEQ ID NO: 27472 - protein, 247 aa, Artificial Sequence; identical to SEQ ID NO: 27471
  Synthetic sequence.

SEQ ID NO: 27473 - protein, 238 aa, Artificial Sequence
  Synthetic sequence.
SEEEILRRIAEEIKRLIDEDLRLIEELVRKIKTVAKRDLELIARLVEKIEEVIRRSIRVEEVVRELKKKLDEILKRVEDVVRESKKRLEDVRRKVEEAVKKSKEEIERILRRAEEGTDKKKIVEDLERVLKDHLDMNTEVVKDLKKILDDHLDANREVVKRLKEVLDDAVRVLRERIEDEEELKTAEKIIEDIKKEIDDVHREVRRLLEEIKEDIDRVNEEVKKRLEDIIEKIRRAAK

SEQ ID NO: 27474 - protein, 238 aa, Artificial Sequence; identical to SEQ ID NO: 27473
  Synthetic sequence.

SEQ ID NO: 27475 - protein, 245 aa, Artificial Sequence
  Synthetic sequence.
SIEELAEDIKKILDDALELLERLAKRAKEINDEILDELRKLVEKNKRDLDRALEKLRREGIPKEVLDELEKAVEDLKRDHDRVLKDLKKVADENKKTIKKVLDDLKRIIDEVKRMIEDLLKRLEDSKRVLTEILKVLKRLVEEIAKLLERLLESDKRVIEEIIKLLEDLNRALEELIRIIAEKIEDTERVRKLIRELEEELKDNRRLIEELVRRARKVNKRLRELVEEVIDRLRELLERIEEKIR

SEQ ID NO: 27476 - protein, 245 aa, Artificial Sequence; identical to SEQ ID NO: 27475
  Synthetic sequence.

SEQ ID NO: 27477 - protein, 234 aa, Artificial Sequence
  Synthetic sequence.
SKEETLRKEAEDLLRRLEELTRRLEKKARELLERAKKLSRDLAEELKRLLKELREKDVPEELIKVLEEVAKTSIDLNKEVIDVIRRVIEESLELNKRVLDVLRRVLDIAARKGRDKKAIRDVVREAARVIKEVIDEDEKVNRDLKRVIERVIDDDRKALERLRKAVEEVASRLDDERLKRLVEELLKAVTDLSRKNKRILEELLKAIETLSDENKKILTEILDALRRLVEKIEK

SEQ ID NO: 27478 - protein, 234 aa, Artificial Sequence; identical to SEQ ID NO: 27477
  Synthetic sequence.

SEQ ID NO: 27479 - protein, 241 aa, Artificial Sequence
  Synthetic sequence.
DEERKIVETLHRTSREVIKTLEKIVRDLKEVLKKNLELTERLIKRVHEVSREILRLTRENKVDEKDLERIHRELEKEIREVLEKSERDARDLLRKVERAIEELRERHKRVLEDLRRKGVPEELIRIFADLVRANTRVLETLLRILKELVDRSRDVLRKLIEIVEELARMNKEVLRKLKERDDDRVKKELEDANREVNKKLEEVLREIRELHKRVLDRLDEVLRRVEEINKRVNERLDRTAK

SEQ ID NO: 27480 - protein, 241 aa, Artificial Sequence; identical to SEQ ID NO: 27479
  Synthetic sequence.

SEQ ID NO: 27481 - protein, 242 aa, Artificial Sequence
  Synthetic sequence.
SEVEDLKRKLEEDLERHKKDVKRLKDEAERRLEEHKRLVEELERRIKKLLDELKDRNPEVKELLRVVKEIVELIRRVLEKHLKLLEEIIRLLATVLDKHLDVLREIIRLIARVLDLKEAGLDEEDLKREAEDIARKAEELLRDSARTAEDIARRAEEALKESKDDLKRILDRARELLDDIRRKKVVPKDVLRDLERILTELAKALKDLIDNSRRTLEKLLKALRDLIRESKETLEEVLRRTD

SEQ ID NO: 27482 - protein, 242 aa, Artificial Sequence; identical to SEQ ID NO: 27481
  Synthetic sequence.

SEQ ID NO: 27483 - protein, 240 aa, Artificial Sequence
  Synthetic sequence.
KEREEVKEKLDRLLEEVEKTVRELKREHDELLKEVEKLVRDLKKEHDELLKKVKDDGVPKEILDVIREHVRTNKEILDRVLEVVEEHLRRNKEILDKLLDDIRKVVEDAKRILEIDDDETLRRAVRRILEELRKLVEDIRKKVKDSLETLERALEEAEERIRRSLEDLKRVLKEAKDKTKDKDRLDKVEELVKKLLEDTKRTVDRVRELVRKILKKSRETLEELERLIEKILRELEKDAR

SEQ ID NO: 27484 - protein, 240 aa, Artificial Sequence; identical to SEQ ID NO: 27483
  Synthetic sequence.

SEQ ID NO: 27485 - protein, 240 aa, Artificial Sequence
  Synthetic sequence.
SERETVKRRLEELLKEVKRTLDKLKEEHDRLLEDVRRVVEELKREHDKLLKEVKDSGVPEELLRVIAKVLETNKRILDDLLRVVKKHVDLNKEILDRILEMIKEIVERVKRVLEDDDEKTLRDKIRDIIRRLEDAAREAEERVRRSLEELKKAVEKIRKKIEDSLRELEEALKRVRDKEEDDKRLEDISRLVKRLLDESRRVLRELEETIRKRAEESKRVLEEVKRLVEKLIRELRKEAE

SEQ ID NO: 27486 - protein, 240 aa, Artificial Sequence; identical to SEQ ID NO: 27485
  Synthetic sequence.

SEQ ID NO: 27487 - protein, 239 aa, Artificial Sequence
  Synthetic sequence.
SEDEIIKKIIEDLRRVLKEVEEIHKEVEERLDKVLKEAEEMHKEVLKELDRVLDEVKRIEDVETVLRLAIEAVRRALEIVRKVTEDLIRVVRKLLEIVDRVNKRVKKAVEDVLKLLRDTLKGSKDVERVLDEARRLLEKLHRDSRRILKRIKELLDELKELSERILERIKRLLEEVERRNSDDERLLEELIEELKDLIRRHIELLRRLIERLKELLKKHIEDLRRLLEEIEKLLEEARK

SEQ ID NO: 27488 - protein, 239 aa, Artificial Sequence; identical to SEQ ID NO: 27487
  Synthetic sequence.

SEQ ID NO: 27489 - protein, 241 aa, Artificial Sequence
  Synthetic sequence.
SREDEVRKVVEKVLRDSKRSMKELRDVVTEVLKKSKEVLRELKEAVDRVLKKLKDISRDVKSSDVVRELLRVLEELLERLARVLEKNLRINEELLRRLERVAEKNLKINKDLLKALADAERSEEAEKLLREYKKLVEDLARKLRRLLDEYRKLVEELEKRARELLEEIKRLIEDIKRKLERDGPSEELVKELLEFLKRVLEKAERLVRKNLEDNKELLERLERLIEENLKLLEDLLRRTEK

SEQ ID NO: 27490 - protein, 241 aa, Artificial Sequence; identical to SEQ ID NO: 27489
  Synthetic sequence.

SEQ ID NO: 27491 - protein, 251 aa, Artificial Sequence
  Synthetic sequence.
SEEEKLRELKEILDRTLKKIEDLIEESKRLNEEHVRLTREILDEIRRLLEELLRKLREAGIRDEEIETVFKEIKELLEEVLRRNEDSVRRIRKAHEEILRKLEEIAKRIRKLLDDVLRLLRGGRDRKDVLTDLLRVIKEALDALKKVLDDLHRVNEENVRLDKESLDRLLEVIDRAIKKIKKILKKAEERLSEEILKRIEDTLKRLKEELKRLVDEVRKHIEELLERSERLIRELRRTLEEILKRLKEKTD

SEQ ID NO: 27492 - protein, 251 aa, Artificial Sequence; identical to SEQ ID NO: 27491
  Synthetic sequence.

SEQ ID NO: 27493 - protein, 245 aa, Artificial Sequence
  Synthetic sequence.
SAAELVLELLARVVKLLEEVLKRLIDLHRDVLKKIKDVLDRDHELHERVLRELVKVLREAERRDEETVRRLLEEVRKAIERVLEESKKRLDEVVKDSRRVLEEVKELLRRVEEDIERVLREVKRSNNVEERILRDLEELLRRLIELLRRLLEEVRKINEEIIRLLEKLLRRNAEILRTLLRLAERDIDKREELEKRLRETLDEHRDLLRKLKEFLDRSLEDLERRVDEVRKELERVLEELKRKLK

SEQ ID NO: 27494 - protein, 245 aa, Artificial Sequence; identical to SEQ ID NO: 27493
  Synthetic sequence.

SEQ ID NO: 27495 - protein, 239 aa, Artificial Sequence
  Synthetic sequence.
KEVEDIERVLRKALELSKKVSDDLERVLRELLKLSKEVIEKLVRVLEEILELLKRENIGEDELLRRLEKRVRKIIRDAERTLEETKRELDRIIEESRRLNKRTAEDLKKLIDDVKRTRNDEEAIERLVRLIEKNLRLLEELVRRLSRLLEENLRKLEDIVRRIKELIKETLKLLEDAGVPEEDLRRVRELIKKVLKDLERVLKEAEDLHREVLEKLKDVVRRAAEMHEEVIRALKEVSR

SEQ ID NO: 27496 - protein, 239 aa, Artificial Sequence; identical to SEQ ID NO: 27495
  Synthetic sequence.

SEQ ID NO: 27497 - protein, 240 aa, Artificial Sequence
  Synthetic sequence.
DEEELLREIKTILDESLKALEELIRKIMRILDKSLKDLEEIVREIKKTIDELLEKVRRSGLPEEVLKKVKRVAEKVKEDIDRLLEDVERSHREVKKKLDELLKEVKRSHEEVKKELDSLRRDSDRDTVAREILRVLKKNLDVLREVVEKIVKVLEDNLKSLKRVLETLVDLLRKLIKVLREAGLREEALDDLRRLVKELKDKLRKLLKDYKDLLKELKDEAKKLLDDYRRLIEELEKKAR

SEQ ID NO: 27498 - protein, 240 aa, Artificial Sequence; identical to SEQ ID NO: 27497
  Synthetic sequence.

SEQ ID NO: 27499 - protein, 236 aa, Artificial Sequence
  Synthetic sequence.
SEKEKLDELRKLIEEIERELDRLLEDNKRAVEKVLRDLDRLLKKSEDDVRRVEEELDKDRVPEDVKRIIRRLLEVHREVLELVKTVIRRNLKVSEDLIRKVKEAVRELLEVIEKLKSREVLKRIREIIEKIKEILERALEESKRSIEEIKRIIETVDRRVKEIIKEVRDVIRRDVKDKDLAERIRKILDDLLEVHERVARAIEELLRELLEKNEEIVRTIKKLLKRLLDTLRKAAE

SEQ ID NO: 27500 - protein, 236 aa, Artificial Sequence; identical to SEQ ID NO: 27499
  Synthetic sequence.

SEQ ID NO: 27501 - protein, 235 aa, Artificial Sequence
  Synthetic sequence.
SKLETVIRILEELVKVHEELLRIVKKILEELVRVHRRVSEENLRLWKELLDALREDKGREDERVERIIEKAERLLREVAKRHEESIREIDRLLEEIARRAEESLKKIRDLLRKVKELAERGDSEKSIEDLVRTLIELHRRSVEEIRRLLEELVRIHRESIKEVEKLNEDESRELRKAGISEELLKRVEDVNRESRKVLEESLRRVEEALEKIERALRKSEEDIRRLMEDIKRVLK

SEQ ID NO: 27502 - protein, 235 aa, Artificial Sequence; identical to SEQ ID NO: 27501
  Synthetic sequence.

SEQ ID NO: 27503 - protein, 236 aa, Artificial Sequence
  Synthetic sequence.
SREEKIEKLIRLVEELLERLRELLERNAELIKRLLDRLRELLKELERLNEELLKKLLEKVDDEDLRRVLEEVKKSLEEVREKLERAVKEVKRLVDESRESAREVVKTIRDLLRKVRESEDKRDVVRVIEDIARLLDEILKENRRVNEEIVRLIRDVLRVIREVVKTNADLLREILRRAGGVRELEELIKKVERDHERVIKEVEKLVKELLDRSEEIHKRAKELIKEVLDRVREAAR

SEQ ID NO: 27504 - protein, 236 aa, Artificial Sequence; identical to SEQ ID NO: 27503
  Synthetic sequence.

SEQ ID NO: 27505 - protein, 237 aa, Artificial Sequence
  Synthetic sequence.
SREELLDRILEAIAKILEDLKRLIDENLRRLEEVVRELERIIDRNLKLIREILDELKKRGAREEILEKIKKVDKELEDLIRRLLKKLEDLIRETERRLREILKRIRDLLKEVKDRDKDLERLLEVLEEVLRVIKELAKELLDSLRKVLKVVEEVLRLLNEVNKEVLDVIRELAKDGEGDEIIRKLDELLKEVEKVHKEVKDRIRKLLEDHKRSLDEVKKKLERLLERAKEVVEREKK

SEQ ID NO: 27506 - protein, 237 aa, Artificial Sequence; identical to SEQ ID NO: 27505
  Synthetic sequence.

SEQ ID NO: 27507 - protein, 246 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEKVKRKIEELLKELERSLDELRRALERIRKEIKDSETAVRAIIRVLEKHLEAVRRVLEELLKVLAEHLETVRELIERLKRVLEEAIEVVERVAR

SEQ ID NO: 27508 - protein, 246 aa, Artificial Sequence; identical to SEQ ID NO: 27507
  Synthetic sequence.

SEQ ID NO: 27509 - protein, 240 aa, Artificial Sequence
  Synthetic sequence.
DEERKLKELLDRLRENIRALRELIKDNLRLLKTLVDALEELLKDNLRLLRELAEEAARRLSEDALRDLKRVLDELKKVHDRVRRELERVLKELDEVHKEVKERLDRSLEELEDVIRKVKDERALLEALKKHVDVVRTVLKLLLDANKRALDVVRALLELILTVNKKAVDVLREILKRVVKNEKDVRELIKRVETALRESEEKLRRVAEELKKALDRSRKDLEEVVRRTEDLLRRLEEKLR

SEQ ID NO: 27510 - protein, 240 aa, Artificial Sequence; identical to SEQ ID NO: 27509
  Synthetic sequence.

SEQ ID NO: 27511 - protein, 240 aa, Artificial Sequence
  Synthetic sequence.
SEEETVRRLLELLKENIEELRELLKRNLDLLRKLAEELKKLIEELARITERLAEKLAKDLSEEVLKELEDVLRELKRVVEEVKRRLKKVLDELREVHKELKKELDKSLEELRKKLEEVSRKEDLTRALADHVRVVKEVLDKILEVNRKFLEDVKDLLRLLLEALEKALKELERLLRRVVDKEEEVRKLVEELRRAVKRVRDLLDELRRRLEEALRKSKRELETIEERTRRLLEDIKRDLD

SEQ ID NO: 27512 - protein, 240 aa, Artificial Sequence; identical to SEQ ID NO: 27511
  Synthetic sequence.

SEQ ID NO: 27513 - protein, 242 aa, Artificial Sequence
  Synthetic sequence.
SEEEEIVKRLKELIKRNLELLDKTLKELKKTLEDIIRTLTELVKRAKEINKELIDRLREKGVREEAEKKLRRSDEKLEEVVRRVKEKLKRALERLEEAIKRAKEKIKRSIEKLDKLVKDLRSEEMKRALKEVIDEHIKILRDIIRLLEEVVETIIRVLREAIKLLEELVERNIRVLRDIVRADKLEREDIRRYEEKLRKLVEEVKKKLRDLEERLRRLVEKIRKLLEDSERRLRTMLDEIRR

SEQ ID NO: 27514 - protein, 242 aa, Artificial Sequence; identical to SEQ ID NO: 27513
  Synthetic sequence.

SEQ ID NO: 27515 - protein, 246 aa, Artificial Sequence
  Synthetic sequence.
REKEEKVKKVREVVTELKRELDDMLRRVKEAHERLKKKHDDLLKEVREVHKRLKDRLDERGGDEAIKEVLDRHLKLVEEVVRANKEVLDRHLKLVEDVLRALKEVLDKVLKLVEELVRRRDEERAEDLVRRVVKEIDKLVKEIRKRLEDVSRDVRRLLDELRKINKRVSDEVKRLIEELRKRLSGGDEEIKKTIEEIIKVLRELNDKLRRLSEDTIRVLEELNKEIARLLEKLVRDTKRLLDELTK

SEQ ID NO: 27516 - protein, 246 aa, Artificial Sequence; identical to SEQ ID NO: 27515
  Synthetic sequence.

SEQ ID NO: 27517 - protein, 247 aa, Artificial Sequence
  Synthetic sequence.
SVKEVIKEVLDRVVKLIKDVIDALKTVLDRHLRLNRENIRALLEVLERILELLEELVRKSTDDRAEEVLRRVVTKIRELLERIKRESDKVSEKVRRLVEEIRRILKEAVDRIKKLVEELRKALEGIREEIADKLRKIEKKIKRILEELRKMLEELARTIEKLNKDDEDTVRKTVETIERILEEETRSTDDLEKLLRKVRKIAKELADELRKLHREVKETHEDLKRKLDKLLKDIRKVVEDIKREVDR

SEQ ID NO: 27518 - protein, 247 aa, Artificial Sequence; identical to SEQ ID NO: 27517
  Synthetic sequence.

SEQ ID NO: 27519 - protein, 233 aa, Artificial Sequence
  Synthetic sequence.
EKEELVEEILRRLKKMSERFSRVVEEILKLLEDSSRKVEEAIRRTIRELEKTLKRVEKDGKTDELLRDLKRVVEDIKRKLEELLRDHRRILEEIRRKLEELHREHKKILEEISRRLGTEDELARLIIEVLRKNNKALRDAAERIREVLKENHDALKKVVEDIVRVLEEALEVLTKLDSRELREAVKKVIADLEKILKDLRKLDKESLDKLREILKTLRDLDRKSLEELEEIRR

SEQ ID NO: 27520 - protein, 233 aa, Artificial Sequence; identical to SEQ ID NO: 27519
  Synthetic sequence.

SEQ ID NO: 27521 - protein, 245 aa, Artificial Sequence
  Synthetic sequence.
SREEKLREDLDRVFRKNEEELKRVEKEVKKLLDDSKRKLDEVKKELEDLLEKIKRLLDRPGTAELVERLIKELKDTLEKLADLVRDANRLIKELLDRLRELAERVNDDTRKTLETLERTLDKDDVIRKLREDVTRVNDENRRVVEKLDELVRDVNRRNEEVLREAKKRIDEVIRELEEIKRDRKDDEELLRALKEVVRKVIEIVRRLLELHRETVKELARVIKEILRLHLESIKKLLDVVREVLR

SEQ ID NO: 27522 - protein, 245 aa, Artificial Sequence; identical to SEQ ID NO: 27521
  Synthetic sequence.

SEQ ID NO: 27523 - protein, 237 aa, Artificial Sequence
  Synthetic sequence.
DEEEKVRRLKELLDRTLKKLKELVEEHDKILDELLKKLEELVRRHNKLLDDLLRRVEERGLDEEVLRRLREVVERVKRENRKVLEDIRRVVEEVKKKNRDVLKKAEDVIRKVKEDADRSRDKRMLVRLIEEVAEVLKDLLRLLKESDEEVIDALRKALERLERSSEKLAKVVRDVIREENLEEELEDTVRKLLETSKKLLDEAREVLERLHRRSEELLRRVEETLRRLEDEVRKITK

SEQ ID NO: 27524 - protein, 237 aa, Artificial Sequence; identical to SEQ ID NO: 27523
  Synthetic sequence.

SEQ ID NO: 27525 - protein, 237 aa, Artificial Sequence
  Synthetic sequence.
DKEDKLRKIKELIRKLLETIKRLVEEHDKELDETLKKLEDLVREHDRLLDETLKRLEERGLPEDVLRELKKAVEDVKRKNKRVLEEAERVIRDVKRENKEVLRTLKRVVEEVEDALDRTRDDKAVEDLIRKLIEALKEALDRLRRSDEKVVEVVRRLLKLLKDSSKDLADVLREVIRKTNEEEELERDLERLEKTSEDLLRRVKEEIDRLHERSKKLLDEARKKLEELLKTVKDIAK

SEQ ID NO: 27526 - protein, 237 aa, Artificial Sequence; identical to SEQ ID NO: 27525
  Synthetic sequence.

SEQ ID NO: 27527 - protein, 238 aa, Artificial Sequence
  Synthetic sequence.
SEREELARDLDDLRRRLREAAEELKKKHEKLRRELEELAKELRKRHEELKKELDDAARRGEPSEDLVRRIEEVIDDLHEKVRKIIEEIKRALDKLNEDVERLIREIKRVLDELLDKVRRRGLPKDVLKRLEDVLREIKEELDRVLKEHKETIKKVKDALDEILREHEEVVKKLKKELRDSKEEEVLKRILDKLMKVSEDVLRKLEDLLREVIELTKKVLDLLDELLKRVKKVLEEVMK

SEQ ID NO: 27528 - protein, 238 aa, Artificial Sequence; identical to SEQ ID NO: 27527
  Synthetic sequence.

SEQ ID NO: 27529 - protein, 240 aa, Artificial Sequence
  Synthetic sequence.
DREKKVRDIEEDLKRVLDKLRRRVETSKEELKKVLKRDKENADELEKTLRDVVRELDRKIDSEVLRAVREIVKRLVEVVRRYNELSEKIIRDLVRVNDRVLELLKRIVKRLIDVVRELEEIEDKEKALRRLEEVVKEVKRRIEELLKELEDVHRELVKILEEVNEDLKRVATEVKEIIKTIIKISEVAKELDEVIKRLLDNLKENTDRLKEVIDRNLKDLRDLAEELRRVIERLLEDARR

SEQ ID NO: 27530 - protein, 240 aa, Artificial Sequence; identical to SEQ ID NO: 27529
  Synthetic sequence.

SEQ ID NO: 27531 - protein, 238 aa, Artificial Sequence
  Synthetic sequence.
DKEEVLKDIKRKLDDHRRRTDEIVERLERLLKEHEEKTRRLLEDVRKKLEELKEIIKRKEQSEELLIKSVEELLRETKKILEDLIRHLDELVKRILDILRDLDRHLEELIRDTKRILEEGDAEERLLKKLEELLRRLLKRNKEALERLKRILEELLKRNRDALKRAEDELRKVLEDLRRRPEEEVLKRILDRIEELLRRLVKVNTDSLRELKRVVDELVKVDRESLRELERVLRELTK

SEQ ID NO: 27532 - protein, 238 aa, Artificial Sequence; identical to SEQ ID NO: 27531
  Synthetic sequence.

SEQ ID NO: 27533 - protein, 241 aa, Artificial Sequence
  Synthetic sequence.
SKEEEIVRELEKILRDHLRKVERIVEDLEKLLDDHLKKIEELAKRLEEIIREAARKLEEKGVDDKVIKKIRELLREIEEELRKVLEDVRRLHKKLREELRRVVKRIRDLHKRILDELRKDTREDAIRRVLELIKKVSREILELVKRVLEALRRISREVAKLLRRVLETIRRVLEEVVKEVEDEEVKELLKRVEKLIDDVRKKVEDLHRELEKALRDIDRKVKRLNEELERLVEEVEEKVKT

SEQ ID NO: 27534 - protein, 241 aa, Artificial Sequence; identical to SEQ ID NO: 27533
  Synthetic sequence.

SEQ ID NO: 27535 - protein, 233 aa, Artificial Sequence
  Synthetic sequence.
SESEELRRKLEELEKELRDVLTKDRKMLEDLKRRLDKLVKDSERRIRELKRRLDEKIKDEDVKRVITRLVEEIKRVNEEVKKALEDVLRELRKVSEDIARLLKRVIDDIRRVLEELDRTTDKETADRLLKRLKEIIDKVREDVKRLNDKLRELVDRVRKRVEELHTRLRELLKKLNLPREIVEELRKVIEDHERLVREILELLRKAIDDNHKLVRDLLERLKRALDETREDRR

SEQ ID NO: 27536 - protein, 233 aa, Artificial Sequence; identical to SEQ ID NO: 27535
  Synthetic sequence.

SEQ ID NO: 27537 - protein, 241 aa, Artificial Sequence
  Synthetic sequence.
RETEETLKKLEKLLRKMLEVSKRLNEEDEKLLRTKRKLIEDLLRRVEELLEETRRVVSNTTDERVLRRADEVLDEVRKIVEDVERAVEEALREVERVNEEIIRKNEELVERVKTVLERIRRIREKEKILRALKEVVEILKEALEENLKAVRKSIEIHRKVIELLVRLVERIVKILREILEEVVDDKDLVETLKRKLDKLLRDIRELAKDYKRKLDRLLEDVERLHRELKKELDELLKEVKD

SEQ ID NO: 27538 - protein, 241 aa, Artificial Sequence; identical to SEQ ID NO: 27537
  Synthetic sequence.

SEQ ID NO: 27539 - protein, 245 aa, Artificial Sequence
  Synthetic sequence.
SELEKLLTDLERVIRKVVEDLRRLLEEHKKALDEDKKRDEDSNEELADAIRKVIEKLKRTTDEEIIERALRELLKVATEVIKKNIESNRESVKVTRRVIKDIVEVVKRLIDVLRKVIKEIVRRDPRRDKAEKVRRLVEELARRLEELLREIRKLLEDSTRKVERLNEEVERLLRELAETVKELTDKRAREEDTKRLLEKIHDDHRKLVEENERLLREDHKTLEDLIRKIKKLAEEILELTARETK

SEQ ID NO: 27540 - protein, 245 aa, Artificial Sequence; identical to SEQ ID NO: 27539
  Synthetic sequence.

SEQ ID NO: 27541 - protein, 240 aa, Artificial Sequence
  Synthetic sequence.
DEREVLKEILDLVRRLLELALEILKRSLELLRRLAEEAKKVLDRSVELLRRLVREAKEAAKNPDERVKREVVEKAERVLEESKRRLTEVLERIKRVLEESKRLIKEVLDRIRDVIRRVKERRGEDKDVKKLLDLLRELLRELKELLEDHLRIIEEIIEKLKRLIDEHLEILKKILDRLRREGITDELVKEVEDRLRESEKKLERLLEDVERLLRENEERLRRLLEEVERLLRELAETLER

SEQ ID NO: 27542 - protein, 240 aa, Artificial Sequence; identical to SEQ ID NO: 27541
  Synthetic sequence.

SEQ ID NO: 27543 - protein, 241 aa, Artificial Sequence
  Synthetic sequence.
SEKEEVEKRLKKVDEDTKRAVEEVKKAIEEVLRRHEEASKRVEEAIRRVLKELEDLKEDESVLRRVLRMIEEISKEHIRVLEETLKLIEEIVKKVLDVLREDLDASREVVERVERAIKDEKTLRELREILERHERLMEEVLRRLEKLLEEARKFVERVKRENKKLLDDARDVIRRLEEARRDVDREELLERLKELIKRLLEALKRLDEEVSKLIDELLKRLEKLAKEVLDLNRELLERTRR

SEQ ID NO: 27544 - protein, 241 aa, Artificial Sequence; identical to SEQ ID NO: 27543
  Synthetic sequence.

SEQ ID NO: 27545 - protein, 244 aa, Artificial Sequence
  Synthetic sequence.
SDEERLDKVLKEAEDIIRELERLLRESLETLKRLIERLEKLLRDSLEELRRLIEDLARKRVPKEILDRLLTVHEETLRLLKEVLDKLLEVHKEILDELKKILEKLLRAVEEILRRLKKIRRERELEEVLKRLKKALEDIKRELEEVLRRDEEVNEEAKRDLDRIVERNERANREIEEELRRSNVPEDVVRMLKEVSRRDEELTRRLLRMAKKLLEDNEELSRRLVKKLDEVLKRVEEIIKRETD

SEQ ID NO: 27546 - protein, 244 aa, Artificial Sequence; identical to SEQ ID NO: 27545
  Synthetic sequence.

SEQ ID NO: 27547 - protein, 246 aa, Artificial Sequence
  Synthetic sequence.
SREERIRKLAEDLKRKIEELLRRVRKLAEEHKRLIEKILEESERLAEELKRRAEELKKRLDKEEILRVVDKLIKILKKLVDAHRRSLEKHLRVVDELIRRIEEVLKKLLEILDELIKLLENRDSKEVERVLREVLEKLERVIRELEKLLREVLKASEDISREDMKAIRDVLEDLKRVLDEIRKKGVPKEVLDELRRLLELLKKLVDRLLELNKRLNDHAKKLVEDLLRLLKKLLEEIKKLVDDARR

SEQ ID NO: 27548 - protein, 246 aa, Artificial Sequence; identical to SEQ ID NO: 27547
  Synthetic sequence.

SEQ ID NO: 27549 - protein, 236 aa, Artificial Sequence
  Synthetic sequence.
SEEERLEEEVRRELERYRRTVRRLAEEVKEELERYEREVKKEEEKLEKTLEDLERELTRDGLDRESAKETLRKLREDIRRTLKKNEDLLRKIEKRIKEVLDRNEEMLKRIKELVDRGNLDRDKLERIERLIKRLRELSKRVAEELERLIRELRKLNRRVLEELDRLLRELEDRLRKTEDKKTIAEELKRVLRELTRILRELVKLNSDVVRRLLEVLTRLAKLSEDVVREILEIERE

SEQ ID NO: 27550 - protein, 236 aa, Artificial Sequence; identical to SEQ ID NO: 27549
  Synthetic sequence.

SEQ ID NO: 27551 - protein, 245 aa, Artificial Sequence
  Synthetic sequence.
SEEEKLETVREELRRALERIEELITKNEKKIEDTLRDIRREIEENARTVKEALERIKKDGVDREDLKDIKRRYDEMLEKLKRELDEIVREIKERHERLRKELDDIVKRVEEKLRELRKKPNSEELIRELLEIVREALERIRRLLKKLLEANERLLKRIRELLDELLKANDKLVKDLEDILRKENMPKEKVDRTKEELERLKKEHRERVEETKRKLDELKKEHEREIRKTETDLRRLLKELADRAK

SEQ ID NO: 27552 - protein, 245 aa, Artificial Sequence; identical to SEQ ID NO: 27551
  Synthetic sequence.

SEQ ID NO: 27553 - protein, 247 aa, Artificial Sequence
  Synthetic sequence.
SEDEKLRKLVEEVERTLKKLIDYLRENVEDVDRILRRLKELIDRHLKKVRELIEKLLRGGIDRKELRDLKRRVEDLHRKIREELKELKKRYKELIDRIKEDAERILKEAKRKIDEIEKLDDDRKSLLKALEEIVRDLVRLIRELLRKLKEINKDLVKAIRELLEALLEIHKRIVDAIRDIVRRELREDKDTVREIEKDLEDSKRELERIKEEIEELLKRLEDKNERAIEEIEEDLKRLEERLREAAK

SEQ ID NO: 27554 - protein, 247 aa, Artificial Sequence; identical to SEQ ID NO: 27553
  Synthetic sequence.

SEQ ID NO: 27555 - protein, 248 aa, Artificial Sequence
  Synthetic sequence.
SEEEKLRKTEEDLKRTLEELKKILDDHLRIIERLLREIKRVLEENKRNARRLLEEIKRSGLDTEELKRIEEEYKRRLDEILRELRELVEEAKRLHDRIKEELDELRKRVKELLERIRRSDRDRKELLKELEDVIKEAVDAVRRLLDELRKVHKRLVDAVRRLVEKLKRINKRLVDLIREILEKMKKDLDERVLKRLEKELRDHLKRLEEIIKRLEEDLKKTLDELKRTIEDAERKLRDLERKVKEDAK

SEQ ID NO: 27556 - protein, 248 aa, Artificial Sequence; identical to SEQ ID NO: 27555
  Synthetic sequence.

SEQ ID NO: 27557 - protein, 246 aa, Artificial Sequence
  Synthetic sequence.
SILERLVRELIRLLRELLRIHKELVERVIRVLERLLEVHKKLVETIERLLDKLAELVRRGLPEKDLKTEIDRVKTELERVLRETKEEVKRLIEEIKRLEDDSRRRMKELVEEIERLIRKLEKDGTEPREKLKRAADEARRLLEELKKLHETSIDETRRILEKLKRVHEELEERTRRLDKRLEELARRGSDKREIEKVLREIKEELRRSLRELKRVLDEVKERLKESLERLRKLIEEIKERLDRIRK

SEQ ID NO: 27558 - protein, 246 aa, Artificial Sequence; identical to SEQ ID NO: 27557
  Synthetic sequence.

SEQ ID NO: 27559 - protein, 252 aa, Artificial Sequence
  Synthetic sequence.
SLEEITKRLLELVEENLRRHEEILRELLELAKRLAKEDRDILEEVLKLIEELLKLLEDNTSSEEDLKRLLKEVIEELRRVVKRVKDKWDEVVKRIEDLVKKLKELHDDTLRKLRELVRKIVTDIREKGGEAEKVKRVVEKILELVERLAKVVKESVEKLLEILRELAEVSKRVAEALLRLLEELVRVIRIKDERTLREVVRKVLEEAKRLLDELEEVHKRVKKELEDIIEENRRVVKRVRDELREIKRELDE

SEQ ID NO: 27560 - protein, 252 aa, Artificial Sequence; identical to SEQ ID NO: 27559
  Synthetic sequence.

SEQ ID NO: 27561 - protein, 247 aa, Artificial Sequence
  Synthetic sequence.
SKIEEVLERAKEVLDRLLDLHRRLVKEIEDVLDRSNELLDRLLKELEKVLDELLDIVRRRSSEEVLEELRRILETLARRLDDALRKDKELVDRLEKSLEDVLRTSERIVRKLEKELEDVVREGAVRKEVVEAIVRLLRELVEINREIVKRIVELLREHNRASRRLVEEIKRLLKEILDVARKIVERTSEEALKELKERIEEIKKTLRELLKELKKLNREIKETIKELSERLARAVEKIKRELEKLRK

SEQ ID NO: 27562 - protein, 247 aa, Artificial Sequence; identical to SEQ ID NO: 27561
  Synthetic sequence.

SEQ ID NO: 27563 - protein, 241 aa, Artificial Sequence
  Synthetic sequence.
KAEEAVEKLVRIARAIVKINEDLSREVVRILREIVRLNEETTRLLVEIAREVVKVVEDAGLSEDVVRKLRKLVKELEDLLKKSNDDIRKLVEDVRRRLKESNDEIRRLVERLEELLKRLPDDEELLRLVEELTEELLRTHEEVVKALEKLTRDLLELHRELLERVRRLTKRIEEELKRVNVSEELLRRLEELRKRLEKVLDDSRKELEKLKRELERLLEESRRKLEKLKRDLERVLEETRR

SEQ ID NO: 27564 - protein, 241 aa, Artificial Sequence; identical to SEQ ID NO: 27563
  Synthetic sequence.

SEQ ID NO: 27565 - protein, 243 aa, Artificial Sequence
  Synthetic sequence.
DDRRILKLLIDIIRKLVKLNEETADKLIRVIDELLKMAEESLKKVIDLVRTLVEIIRRERGKRDLERVLRRIKEEMERIKREHEEALKEIEERLKRIVDEHERLLEEIERELREVEREADDKPQSERVKRLRERLRRILKEILDVSRKVLKDLKDLADEILEDSEEILKELERLIREILKVTAETDDRKVVEELLRKVEKLIKDIRERYERLVKKVRDLVERWKELVRRLLKKAEDVIREIEK

SEQ ID NO: 27566 - protein, 243 aa, Artificial Sequence; identical to SEQ ID NO: 27565
  Synthetic sequence.

SEQ ID NO: 27567 - protein, 236 aa, Artificial Sequence
  Synthetic sequence.
DEEDALRTIEELVKRVNEENKKILDESEDLVRRLNEKNERINKESRDLVKKLREDAEDLDDEELVKKIIDVIRRNLELNRRSVKLVIEVLERNLELNEESIRLVLKVLEEILEILRETTRSEKLKELEKIAKRIIEEIRKALEEAKELNKRIIERLEKVLREIEKLNKELEDLVRRKGAGDERVLKLVEDAAREDERLNRELDRATREVAEEDKKLNEDIDKTLNDVIRELLEAAR

SEQ ID NO: 27568 - protein, 236 aa, Artificial Sequence; identical to SEQ ID NO: 27567
  Synthetic sequence.

SEQ ID NO: 27569 - protein, 240 aa, Artificial Sequence
  Synthetic sequence.
SSVETIKKLVEDARKKLEDSIRKIEKLVRDVEKTLRDSLKRIRDLVEKVVRTLRELLREPKTEELLRRTRKLVREVLERLKKINKEVLDILKKVLEDLERIDKEVLDLLRDIIKKLEDMNQVDEKVIRRLRRLAEEIEKRVEDINRESRKKADDIRRKVEEINERSDRAAKEVEDEARRNDSDLEELVKRITDILREHVKMHEDLIRAIAKVLRDHVEAHKRLIKRITEILEEVVKAVTD

SEQ ID NO: 27570 - protein, 240 aa, Artificial Sequence; identical to SEQ ID NO: 27569
  Synthetic sequence.

SEQ ID NO: 27571 - protein, 242 aa, Artificial Sequence
  Synthetic sequence.
DTKEEIKKLVEELLRLIEELIKRTEELNKEDNEIAERVVETHSRILRDLLRSLEEVARTRDKRVVKTLDEKAREVVKTSDKLVDEWRERSERIVEEAERLVRKLEEDVRRVIDEIRRLTQREKLKKILDELKRLLEKVIKLLEELIRKHLELAERVIRLLKEITRENLEIVKEAIDALDAGLDDDELREVLDRIRERVKRSEDKLREVLERLKRDSKRIHKDLRKALEEAKKDVDEIRKETE

SEQ ID NO: 27572 - protein, 242 aa, Artificial Sequence; identical to SEQ ID NO: 27571
  Synthetic sequence.

SEQ ID NO: 27573 - protein, 238 aa, Artificial Sequence
  Synthetic sequence.
RREEELKRIIREIERILEELRRRSREIEEKLKKVLEEHERVSRRIKERVEDLKRKVRDKEKLVRRLAELLKEASDVNHKLIRDIARLLKEASEIIKRAVKRLSDLLEEVVRVLKDGNSDERLVDTARRLVEEIVRRLEKVVEEHEEIVERVVRRLEESNRKHRRLVKEIIDRLEDLVRRNVDEKDIERIVEEALKLHEDVHDENRRILEEAIRTHREVIKRLEEIVKEAIKLIEDVTR

SEQ ID NO: 27574 - protein, 238 aa, Artificial Sequence; identical to SEQ ID NO: 27573
  Synthetic sequence.

SEQ ID NO: 27575 - protein, 238 aa, Artificial Sequence
  Synthetic sequence.
SEKELLEEIEKRAEEVLREHDKRSEEIKRELERVLKELRDLSRKIEEDLERLVREVTDLEELVRRLVEIARRASKIIEDVVRKLAKLLREASEVIKKTVDKLVRLLEEAVRLLREGNTEEERVRDLERLVEEIVRRLEEIVRKHRELVRRIVERLREIVEEHKRIVEEVVKTLERLVENRVDKKDIERIVRELIKVHRDVLRKLEKVVREALELHDRVNKELREVVERALRLLREVTR

SEQ ID NO: 27576 - protein, 238 aa, Artificial Sequence; identical to SEQ ID NO: 27575
  Synthetic sequence.

SEQ ID NO: 27577 - protein, 239 aa, Artificial Sequence
  Synthetic sequence.
SEEEILKKIEDRLRAITEKHERMLREIKKELKKVMDEHEDLLRKIEKELRDVLERLRRGVDRKEVIELLARILEKVLELNERILRKLVKILKKVIDLHREAIRELLEVLEDVLRRLRGTDDDVARELERVVRELKEELKRSVEKIERAAREIEDLLRRVLEESKRLVEELKRRLRRIKDNNLDATLLERIVERARRELTKNHDKLRKILERLERILRELNEDLRRILTTAVDILRKLRK

SEQ ID NO: 27578 - protein, 239 aa, Artificial Sequence; identical to SEQ ID NO: 27577
  Synthetic sequence.

SEQ ID NO: 27579 - protein, 237 aa, Artificial Sequence
  Synthetic sequence.
REDEVLRDIERLLREIEEKIRRILEESTRELRKVEEEVKRIIERTKRELKKIKEDVERKGIDEELRKLLDEVLDKLTKLIERNKRSLERILELIKRIIDENLEVLRDIIRLLEELLKMTKDNRVPKDEVIKLVEDVVRRIEELVTRVVRRNEKLVKDLDDLAKKNVRENEELLREIDRKLDRDLLEKIKRVIREHIKALEKLARDLKEILRRHIEALKELARDLAEVIRKLLEDVKR

SEQ ID NO: 27580 - protein, 237 aa, Artificial Sequence; identical to SEQ ID NO: 27579
  Synthetic sequence.

SEQ ID NO: 27581 - protein, 240 aa, Artificial Sequence
  Synthetic sequence.
DLERLVELLKRIDDEAVKLVRKLVEVLKRIDEELVRLVEELLRALRRINEEVVRLVKRVPDKKKLKDRSEKLIREIEKLLDELRRRSEELLEEIRRLLERLKDESRKLLKRVEKELERVTDKKALELTDRWLKLHKEVVDRLAKLLRDWLRLHRRVLRELEKLTKEHLTEHERVVKILEDGRREEELLKRLRRIVEESKRRVDELLKELRKISEDVAREVERLLRELERISREVKRRVEE

SEQ ID NO: 27582 - protein, 240 aa, Artificial Sequence; identical to SEQ ID NO: 27581
  Synthetic sequence.

SEQ ID NO: 27583 - protein, 240 aa, Artificial Sequence
  Synthetic sequence.
SDEEVARELSDIVRKLVERNKESIEDAMRIVKELVDRNKKVTEDVLRLLEKLLEDVRDTPNDEELLKRVEEIVRRIAKELDDLVKETRKIVEEVEKRLRDDVKRTEDIVRELVKRAEEVNRTEKVEEAIKKIIRLLEEHVRIIREAVERIIRVLEKHVRIIEEIVRALITLARRIVELIARNGSEEFLRRLKEEVRKIVEKVKRDLERSLKELERILEEVKRMLERSLRELERVLKEIKD

SEQ ID NO: 27584 - protein, 240 aa, Artificial Sequence; identical to SEQ ID NO: 27583
  Synthetic sequence.

SEQ ID NO: 27585 - protein, 231 aa, Artificial Sequence
  Synthetic sequence.
SKEEILRELEELSRRLVEKLKDLLRKLEKLSDEVVKELRKSLEELKDLADKMVKKLGDSEIARELLKVVEEHVKLLEEILERLKTVSKDIVRVVDRIAKKLLEVTKEIVELVKRLKTDKDALRELERKLEDVHRRIREELKRLLDRLRDLHRRLKEILEDSKRKLEELLTRANSDKRLLEEIVKLLRDVAKRNLDLLEKHRELLERALEEVKRLLDEHLKLLRDALRRLKK

SEQ ID NO: 27586 - protein, 231 aa, Artificial Sequence; identical to SEQ ID NO: 27585
  Synthetic sequence.

SEQ ID NO: 27587 - protein, 237 aa, Artificial Sequence
  Synthetic sequence.
SREDLLRKLKELIETILRKSSELLDRLLKLVREHSETSERLIRELKKILEDILKLIKGGISEDDVRRIVKEAKDELRRSVEEVKKSVDDLKEELKRSLREVRELVKRIADALEEIVRRSSSLREVIKKLLELLRRLLEVHERTIRLLAELLERHLEVHEESIRLLLRLLEELLELVERKGDEKELRRIKEAVERVLRDHKRKNDKILRDVEEVLRRHLEELRRILKDVKKVLDEARK

SEQ ID NO: 27588 - protein, 237 aa, Artificial Sequence; identical to SEQ ID NO: 27587
  Synthetic sequence.

SEQ ID NO: 27589 - protein, 237 aa, Artificial Sequence
  Synthetic sequence.
DDEELLKRLEDLDERLLRFSKENLEELRRRTRELIETSETLLERLREIIETILKVIRDGARKEEVKKLVDELERVLEESLREVKRLVDELRETLKKSLEDVRRLVREIEEVLDKIVEDSSRLKDVIDKLREILKRIADIHEESLRRLVELLEELLRAHERSLRKLTELLRRLLEAVRQGGPERFLEEIAERVERILKEHRELLKRIEDEVRRVLTEHKKKLEKLKREVERVAEETKT

SEQ ID NO: 27590 - protein, 237 aa, Artificial Sequence; identical to SEQ ID NO: 27589
  Synthetic sequence.

SEQ ID NO: 27591 - protein, 237 aa, Artificial Sequence
  Synthetic sequence.
KETDEVVKRAKELVDTLLKVIKEHVERLKRLVEELLKVIRDHVRILRELAKRLREKVVKSEIADEVEKIVRDVARENERVVERIKRLAERNARSNDEVVRRIEELVDRLAKLAKKLDKKELLDTLKRITDEAIRLVEELLEENKRSMEELIRLVEDILEKNRRVEKKIIDLVRREPTTSDVERVLEELRRRLEKSVEEVERVLKRLKEELDKSVEEVKDVLRRLLEDLKRVVEELRR

SEQ ID NO: 27592 - protein, 237 aa, Artificial Sequence; identical to SEQ ID NO: 27591
  Synthetic sequence.

SEQ ID NO: 27593 - protein, 240 aa, Artificial Sequence
  Synthetic sequence.
SEEERVLEEIKREIDRIVKRARELLEKYRELVERIKRRNEEILKKYEKLLEEIERLADAGVPKEELLKLLREISKEHLKVLKELLDLVKELSDVSLEALKELLEELTRIVKEVLKALRRADIPEVDKVIETLERLLDELREVVERIIKRDADLLRKIEKVVRDIIETDKKLLEELERLIRAGVQERDLKRALRRHAEELTRLNKELNELLKEHEDELRRLLAELDRIVRKLLRTLKELTE

SEQ ID NO: 27594 - protein, 240 aa, Artificial Sequence; identical to SEQ ID NO: 27593
  Synthetic sequence.

SEQ ID NO: 27595 - protein, 236 aa, Artificial Sequence
  Synthetic sequence.
SKEEEAKRVIDELREELRRILRENTELVKESERRITELLKENSDLVEEVRRRLEEVLEKERDEKIKRLVELVEELLKRHNDIVRRLVKLHRDLLKRHNDVVRRLIELLDDLLRKLVEAIERGEDEKRLRKLLEDARRRIEKLERESREELKEVHERLKKLADDSRRLLEDVKRKLEEEGTREDLKRLVDDVLRLAEESHRKIEELNRRTLKLMEDSHRKLKELVRKALELITELTR

SEQ ID NO: 27596 - protein, 236 aa, Artificial Sequence; identical to SEQ ID NO: 27595
  Synthetic sequence.

SEQ ID NO: 27597 - protein, 242 aa, Artificial Sequence
  Synthetic sequence.
DSIERLAEELDKIVTDVLRVNEDSVRTWTRILEEVLRLNRELARILIDIARRVLELVKRKSPEEDIKRLTEELKRVLEEYERRLDRLTEEARDALREYERRLEELKERLRRALDRARKDVDEEVEKITRETEKELERLTETHKELVKTLEELLRRIVDDTARVIKEILDLLKELLDMTRELSEKELLDEVRRLLKRVKELLKRSIDLVEKILRDVKRLLDESIELVKRVLDKIRRLLEELAR

SEQ ID NO: 27598 - protein, 242 aa, Artificial Sequence; identical to SEQ ID NO: 27597
  Synthetic sequence.

SEQ ID NO: 27599 - protein, 239 aa, Artificial Sequence
  Synthetic sequence.
SEEDEVLKTLDRKHKEAKKELDKVLRELEEEHKKVKRELDEVLKRLEDIHRRITELLRRGDIRLEDVLRMVKEANRELVEVIKRIVKTVEDLNRRAVEVVKRLAEELERLNREMVKVLRKSGREEEIEKDLRRSSKDIRRLVEEIERRLRDSLRKLRKLADDLAKKLKESLDKLEELVRRGVDEEAVERVLKENKELIEEIVRLIRKILDENIELIRRIVRLLERLLRENLRLIEEARK

SEQ ID NO: 27600 - protein, 239 aa, Artificial Sequence; identical to SEQ ID NO: 27599
  Synthetic sequence.

SEQ ID NO: 27601 - protein, 248 aa, Artificial Sequence
  Synthetic sequence.
SKEEDVRRLIEELVRELRRILEENRRMLKELVEKLEEVLRRSEEVWRRLAKELDELLKELNRDVVREAVETIRRVLEDLVELDRRVVKVIKEVLERHAKSSTELVRELEDVLRAAVEAIEKVKREEDLKRELRKLKERLKKVLKRHDDTNKELFRELEDVLRKHEEELRRLADELRRLLEDLKRKGDIPEEVIKKIEDLVRKTERELREVHKELRRLVEEAKEVVDRSVEILRDLVRKIVRILEESAR

SEQ ID NO: 27602 - protein, 248 aa, Artificial Sequence; identical to SEQ ID NO: 27601
  Synthetic sequence.

SEQ ID NO: 27603 - protein, 249 aa, Artificial Sequence
  Synthetic sequence.
STEDELRKIKEELEDIRRRIEELDKKDNEDLDRIDEEIKRRLDKNIRDLDEIAKEVRKRRQDKDLLKEIVERLAEVLRHHVRVTADVVRLLAEVLKHNNELLKEAVRLLTELLRKILKVLKDAGKPEDEVRKLKEELEEIERRLRELVERNRRLSEELIRRAEKNVEDVRKKVEDLIREAEEVVKANLPKEELAEITERLLKKYREVAEENMRSLKELLREYREVNTRTHKALERIIDRIREILEKVRK

SEQ ID NO: 27604 - protein, 249 aa, Artificial Sequence; identical to SEQ ID NO: 27603
  Synthetic sequence.

SEQ ID NO: 27605 - protein, 233 aa, Artificial Sequence
  Synthetic sequence.
KEKEAIKEVAELLKRLIDDLLRLLKEDVDTARRVLDEIKKLLEENERIAREVLRRLREDKGKERAEELVREWIERTREILKRIEELLRRWTRKTREILKRIEELVRRVIEVVRRLDVPKELVDKLEEVLRKLLKLVEDHVRKVEKIIRELLKLIKEHVEKVERIARKLLELLRRNRDETDLDRIVKEMEKVLEDSIRELEKLVKRLEDILRESEKALRDLLRELRKVLEEVRT

SEQ ID NO: 27606 - protein, 233 aa, Artificial Sequence; identical to SEQ ID NO: 27605
  Synthetic sequence.

SEQ ID NO: 27607 - protein, 230 aa, Artificial Sequence
  Synthetic sequence.
SSMETAVKLVKDLLREDIRSNEEHVRLAKKLLEEDIESNERLLRILKKLLDLVEKTEDDEKLRKDLREVLEELRELVDRNKKRLEDVLRESERLATENKKRLERVLRELERTGLEERVLREVRKLLEELKELNDRTLEETRRLLDRLKKLNEEILELLERLLRRLEKLRKDKSDREELRRVAEEIKRRAEELLRRTEELVRDILRRHEDALRRTEELVRRIEKRLRDATR

SEQ ID NO: 27608 - protein, 230 aa, Artificial Sequence; identical to SEQ ID NO: 27607
  Synthetic sequence.

SEQ ID NO: 27609 - protein, 247 aa, Artificial Sequence
  Synthetic sequence.
RELEDVLRMIEELARRLVEILERHNKLSKRVIELLVRILEEHLKLVAELIKKAVEILRRILREDGKLAEEVIKRLEDAVEESKRNVDETKRKLKEAVRKDNELVKTVKEILKRVVDTVRELVKNNGDKEEIIRLIREMLKKLEEILRESEKLLRDLLEEAERSLEENIERLERLLEDLKRIIENANVRDDIRKLLKELLDDVKKIIDDSRRLLDELRKELEKILKESEKLVDELREAVDRLIRKVRE

SEQ ID NO: 27610 - protein, 247 aa, Artificial Sequence; identical to SEQ ID NO: 27609
  Synthetic sequence.

SEQ ID NO: 27611 - protein, 237 aa, Artificial Sequence
  Synthetic sequence.
SREELLKELRKLVEEIKRRSEELLRRLEKLLEDNERRTRELLERLKELLREIEERIRGGRPSEEVIRLLEELVRAIERVLEEHLESNRRLVEAAERVLREHVELVKRLVRAIEDVVEKELEEDKIRTIKKLLDEWRRRLEKLVRDVRRKLEEWIKRTEEMIDEVRRLLEELKETIRRKGNDRDIVRELTELVRRLLKRVEELLKRSLEILRELIKAIADAIKESLDILDRLLREVAR

SEQ ID NO: 27612 - protein, 237 aa, Artificial Sequence; identical to SEQ ID NO: 27611
  Synthetic sequence.

SEQ ID NO: 27613 - protein, 242 aa, Artificial Sequence
  Synthetic sequence.
EEEEVLRRLRELIERLVRETEEKLKEIERRIEEVLERHRRALEELKKEIDEILEEAERRKEKVEDVVRELRRIAERLLEINERSLELLRRILKALEEIVTRHLDTLRKIAEEIIRAMRDSEKAKKLLEDLRRLVEENKRRVDELVKKVERVVEEIEELSRRLLEKLERVLKEIEDVAREGTSEEALRRLVEKVKRVLEEILKVSEEVLEKVKKVLTDILKRLKELVERNVRLLERILDEARR

SEQ ID NO: 27614 - protein, 242 aa, Artificial Sequence; identical to SEQ ID NO: 27613
  Synthetic sequence.

SEQ ID NO: 27615 - protein, 241 aa, Artificial Sequence
  Synthetic sequence.
SKIEKLLRVIKKIIDKLEELLKRLLEVVRESIELLKRILDELLKVVERTADELRRIVNDKRLLEIIEDLVRRVLELHERTIDDVRRLVKEVEEEWKRVIDELRKLVKKLEDIVEEARKSEDLETVLRLVEELTRRIEKTTEDLERRHEKILKEIIDLIRENLKRHEDITREIIKAIEKLPTTKDLERLLRKVKEDNDRVKKEVERLLKEIEDRNRKVVEEIKRRLEEIKRELDKVVEEIRR

SEQ ID NO: 27616 - protein, 241 aa, Artificial Sequence; identical to SEQ ID NO: 27615
  Synthetic sequence.

SEQ ID NO: 27617 - protein, 241 aa, Artificial Sequence; identical to SEQ ID NO: 27615
  Synthetic sequence.

SEQ ID NO: 27618 - protein, 241 aa, Artificial Sequence; identical to SEQ ID NO: 27615
  Synthetic sequence.

SEQ ID NO: 27619 - protein, 238 aa, Artificial Sequence
  Synthetic sequence.
KDEDKLRRIVAVLEDLIRLTEELAKILKRVTERLKELTEELKRRNEKVVEEILKLLRDSGLQTEDVTRKLKKIRDDYKRITDKLREDHERIREELEKILERLKREHERIIRTLEEISRKLRGEELVDTLLRLVEEVARINVEVLERLIEIVERLVEINRRVLEEILRLSAKLAEDLDRSIGDEEVVRRIRELATKNLDDNRKALEESRRIIEEIVKRIKDVIRTSREIIKELRKEIRT

SEQ ID NO: 27620 - protein, 238 aa, Artificial Sequence; identical to SEQ ID NO: 27619
  Synthetic sequence.

SEQ ID NO: 27621 - protein, 231 aa, Artificial Sequence
  Synthetic sequence.
KEAEELVEVVRKHIKTLAEIWKKLVDALRKHVEILRRLLKELVEVIRRAIERVRRDGIPEEVIRDAERVLRRIEELIERLLRENERVIREVEELIKRNLDENRKVVEDLKEVVDRNGDKRELTEIVRRLLKSNKRVAEEVVRLTERLLRENKKITDELVKIVEDLLRRITKTRGRTERLDTVLEELRRVLKELERKLRESIKELRDVLREVEERLKESIEELERVLDRLRR

SEQ ID NO: 27622 - protein, 231 aa, Artificial Sequence; identical to SEQ ID NO: 27621
  Synthetic sequence.

SEQ ID NO: 27623 - protein, 239 aa, Artificial Sequence
  Synthetic sequence.
SEEEIAERVKDLIRRVLEEHERSVKKVEDLIERVLREHRRVLEEVRRLAEELERRLGDEKLVRAVRKIAEDVVDIIRKILEIVRRTVELMKRIHKKVLDIVRKLVEDVLDILKRREREESVEEVKRRVERENEKLKREVEKVKKEHRDALERLAKEVDDVLRDAKRFLEELEKDVSNIEDDRRKDDLRRVLEELLKRLKELLEELKRINEELLKTLEKLARDNLEINKELIKRLDEETR

SEQ ID NO: 27624 - protein, 239 aa, Artificial Sequence; identical to SEQ ID NO: 27623
  Synthetic sequence.

SEQ ID NO: 27625 - protein, 246 aa, Artificial Sequence
  Synthetic sequence.
SEEDVLRKLEEIVEELERSNRDAVRRLEEVVKRVEDLWEEVVRRLRELVREVEERLRDVEAKEVVEELVKVLEEAVRIVEKALRDHVEVLRRVVEKIADLLRRNVDVLRRVVEKLKRILEARRRVDEKEVRKRLDDIRKELEDVLRETRKTVKKIEDDLRRVHKRLDEIIEDLKRRLKEVLKRVEEKGVKKKEIEEIIERVLRLLAELLKRVKRISEDLKRLLDELIEENADILRKLDELVTRDET

SEQ ID NO: 27626 - protein, 246 aa, Artificial Sequence; identical to SEQ ID NO: 27625
  Synthetic sequence.

SEQ ID NO: 27627 - protein, 251 aa, Artificial Sequence
  Synthetic sequence.
DKERIIKRVLDELKEALKKAEKLHEDVLRELRRLLDEALKLHEDVLRELEELLRKIESTLEDEKLKKKLRDVKRDIDRLVERNRRLLEELRKRLEDLVRRNRELLERLKRKLEELDRRIKELEERGTPREELLERVAEIIREILEDIRRVVTHLRKSIRDILKEIREVVKHLVEVIRDIARRITELLAEDRNREKVEELADEIRRVVKRIEERHDKLRKDIERLVRRIEELHKRLLEELEELVKRITEELK

SEQ ID NO: 27628 - protein, 251 aa, Artificial Sequence; identical to SEQ ID NO: 27627
  Synthetic sequence.

SEQ ID NO: 27629 - protein, 231 aa, Artificial Sequence
  Synthetic sequence.
SVLETIVDIVRKLIELIEKLLRDLLELDKRNVDAVARNADKILKIAEDIVRTIASKGVPEEVKRRLEEILERIARLVRESKERLKRNNEELEKLVRKLEKELKEVLDDVKRVVDAGEDKDDALRRILELLDRLLESIKRVLKEITDSNKRLLDEHERVSKELIELLREMAERVNLDEDLKRELDRLIKEIEESNRRLKKTTKDLVDEVERILRKIKDDIEDVKRKIEEDKR

SEQ ID NO: 27630 - protein, 231 aa, Artificial Sequence; identical to SEQ ID NO: 27629
  Synthetic sequence.

SEQ ID NO: 27631 - protein, 245 aa, Artificial Sequence
  Synthetic sequence.
SEDELLDRLDESVKEVLDRHRKLLEDLADTIRRVIKKVKDLLDEHKKTLEDVIEKVLRRGIDVEELEKVKDELEKAHKKLEDDLRRILEEVKRLVEELEKHLKRIEDEAKKAIEELRRREPDKELLDRALEAIDRLLKLLTENIKRIEEIVKELLDRLKRIVDELLKVSERVVDLLRKIVDKLDTDETVVRDLRRLLEELRRISEEIVRDLRRLLEELKKIVEDVVRESKKLLDDLRRIIDETVR

SEQ ID NO: 27632 - protein, 245 aa, Artificial Sequence; identical to SEQ ID NO: 27631
  Synthetic sequence.

SEQ ID NO: 27633 - protein, 243 aa, Artificial Sequence
  Synthetic sequence.
SRAERLADEVRKAVKKSEEDNETLVREVEKAVRELKKNNKTWVDEVRKLMKRLVDLLRDNQVRDRDLLKELEEVLRRVLEALAENHERTEEILKRWLDRYREDIERLRKVLKEVIEALKREGRDDKRIVDELEEILRRNEDVLDKIKKRLRRLLEEDRRLLERIVRELKRLLDDLDRITKELKSEELVRIAIEVLKRLLEIIEELVRLNNEILERLLKIVRELHKDNIKILEDLLRIIEEVLR

SEQ ID NO: 27634 - protein, 243 aa, Artificial Sequence; identical to SEQ ID NO: 27633
  Synthetic sequence.

SEQ ID NO: 27635 - protein, 236 aa, Artificial Sequence
  Synthetic sequence.
SEVETLIRLIEENLRLLKEVADLSLEVIERLLRILKEIVKRSLDVIRRLLKLIEEVLKDRRLVERAKKEIDRLLEENDKLLKEVEKVIKELLEENRRLVTRVRRMNEELLRLIKENRKRKDDLLRELKDLNRKVLKALKESHDKLKRALEEVLRVLTESHKRLEEVLKEILDELRRRGVEDERAKKRLEDLLREHREILKEVVKRLKELLDRHRKLLDEARRESKRVLDEIDEKTK

SEQ ID NO: 27636 - protein, 236 aa, Artificial Sequence; identical to SEQ ID NO: 27635
  Synthetic sequence.

SEQ ID NO: 27637 - protein, 236 aa, Artificial Sequence
  Synthetic sequence.
SRVETLIRVVEKNLELLREIVERSLRVIKKNLRLLEEVARLSLKVIKELLEEIKRRVRTEDLLRDVERKIRDLLRKNEDLARRVREINETLLEENRELLRRAEKVNKRILDLIRNNEKPSEVLARELEKVNREVLKALEESHRKLRKVNKEVLEVLKRSHDETEKVLREILTELRRSGNEDRRVKEELKRLLEKHRELLKEAVKRSEDVLKEHKEVLDDVRRESEKVLEELRRAET

SEQ ID NO: 27638 - protein, 236 aa, Artificial Sequence; identical to SEQ ID NO: 27637
  Synthetic sequence.

SEQ ID NO: 27639 - protein, 245 aa, Artificial Sequence
  Synthetic sequence.
SEKDEVTRRIRELLKEAEETNREAIERIKRLLDRVREKVEEVAKRSEELLRRLKKVLDRDLQDDEALLKLLIDALREHNRLSTELIKILIDVLRTILKIIKDVLATNIEIARRILDLVRRLAERAGLDDRLVKEVEKLVRTAERLHRDALRKVKRLVEELEKRLRELVKTDHDLVRRLETLLRRKERRKEDLLREIARILRESLRLIRELLKEIEKIVKEIIELLERLNDELRKIIEKILETTKK

SEQ ID NO: 27640 - protein, 245 aa, Artificial Sequence; identical to SEQ ID NO: 27639
  Synthetic sequence.

SEQ ID NO: 27641 - protein, 231 aa, Artificial Sequence
  Synthetic sequence.
SRKELLKKLREVLETNLKLIEDLVRDIERALEEDRKLIEDLLRRIEEVARRILELRERGGSREEDVIREAEKIAERLKELVEKLADDSRRIVEELKKRIKELLRRSEKLVEELKKDLREDEKLLKLIEDLLRVSRRVIEALLEIVERLLEVSERVMRAIKKLIDDLMKVLRAGVEDKRLREVIKRLIEELRRLLKEYEDVLRKVREDLKKLLEEYKRVLERVDEELRKRDK

SEQ ID NO: 27642 - protein, 231 aa, Artificial Sequence; identical to SEQ ID NO: 27641
  Synthetic sequence.

SEQ ID NO: 27643 - protein, 243 aa, Artificial Sequence
  Synthetic sequence.
DEEKRVEDVLRRVEDLLRKLEEEHRRIVKRIRDELRESERKIEELVDRLRKEIDRIRKTRDDRSSVVTELIKILEEVVRAIERIVERNIEILDRIVKLHRELVKRTIEILREAVKLVAELADSEDAKRILKKLKDIVRALEEKLRRLNKEVEDVVKKLEDDHRRLVERVRRVVDELRELLERNTVRKEDLLRRTEKVEREIRKTLDDLHERTRRVVEETLRKNEELLKEIKRVVETILDEIRK

SEQ ID NO: 27644 - protein, 243 aa, Artificial Sequence; identical to SEQ ID NO: 27643
  Synthetic sequence.

SEQ ID NO: 27645 - protein, 234 aa, Artificial Sequence
  Synthetic sequence.
SKKETLVKLAEEIIADIHRVNRESLELIKRLIERVEKLTKESLDSIRKLIERILRDIDDEEVVERIERLLKKLLDENEKIIREIRELLDRLKKANEKVNEEIKKLLDDLKKELRDATDEETAIRLLVDVLRKILELLKRLSEINVRVLEEIVRLIRELSERNKRVLEDALRLVKERVDSDEVREIKEKVRELIDKDRRLVKEIEDLAREILDTDRKLVKRLEEVVRELIERARR

SEQ ID NO: 27646 - protein, 234 aa, Artificial Sequence; identical to SEQ ID NO: 27645
  Synthetic sequence.

SEQ ID NO: 27647 - protein, 236 aa, Artificial Sequence
  Synthetic sequence.
DEERVLTEIEKLVKRLKDRNDEIRRELEKTSKRLEEELERIERELDRLVEELKKELERTKDKDTIVRLIIDVVRKLLKLLEEILRLILRVIERHIELLRRLMKENIDVIKRILEELAKAADSKILEEIRRLLTEWIRKSKEIADEVDRLLKEWLDEVREIAEEIRRLAEELIKRIKDRRSDKDLEDLIRRVLTRVKELARRLDRKNKELLKEIERLIREDKETADRVKTEIKKKTD

SEQ ID NO: 27648 - protein, 236 aa, Artificial Sequence; identical to SEQ ID NO: 27647
  Synthetic sequence.

SEQ ID NO: 27649 - protein, 248 aa, Artificial Sequence
  Synthetic sequence.
DEEELVRRVEKLARDIEETLERLVKELERLYREIEKELKRLVKELEDANRRIVKRLKDLFDKKAPLERLVREVLELVKEHLKLVEDLIREVDKLNERLAEANEKLIREVLKLLKELLDIIAESVDSRKLEELERLVREVIREVAELLKRLKELHDKVSKDIRELLKELRRLHEEVIKTIKKLLDERMPDEEVLRRIEKLNKELEDVLREVEERIRKLLRELEEVSRRVTERIKRLEDELRKAFEEVTR

SEQ ID NO: 27650 - protein, 248 aa, Artificial Sequence; identical to SEQ ID NO: 27649
  Synthetic sequence.

SEQ ID NO: 27651 - protein, 236 aa, Artificial Sequence
  Synthetic sequence.
SKKEDAIRKARKLLERIRRLADKAIKRSRRLLERVRELVKESLDILRKLLERLRDLVRKIKKDGKREVLKELIRLLEELLKINKRVLDSVIELVERVIRSNEDVLRKVIRLVEELIRLVEETTDAKKLRDELRRLKEELKDIARRNRERLKRLEETLRRILKKSRDDLKRLLDEAEKKDITDELRRLTEEILKLHEESVKKLEDLTKEALEASEDVHRKLEKLTEEILRRTEEAEK

SEQ ID NO: 27652 - protein, 236 aa, Artificial Sequence; identical to SEQ ID NO: 27651
  Synthetic sequence.

SEQ ID NO: 27653 - protein, 238 aa, Artificial Sequence
  Synthetic sequence.
KEKEEADRELRELKREMEDILREVEKELRELLKKSEELLEEIERLSKELTDEAREVERNNLPEDELATELLKVIKKILDVNRDVVRKHEEILEDLERVLREVVRKLLELIRKLLDVIRRRVDSEDLKRVEELIREIEETIKKLLRELEKLIRKVKKRTRELLKESEDLIREVLDVIEKNKDLRELARKLLKRLKELNDRILETLRRLNEETARLVKEVLDTARRLLEELIRVLDETRT

SEQ ID NO: 27654 - protein, 238 aa, Artificial Sequence; identical to SEQ ID NO: 27653
  Synthetic sequence.

SEQ ID NO: 27655 - protein, 247 aa, Artificial Sequence
  Synthetic sequence.
SKEDRLREILTELKEVIDTILRKLEEDARRLKKAHEESNEKLKRIVEDLERVLRELLRKLKERVDERLEEEAKRILTEVRKELKKIEEEARRINKEYEDDVRDIERKVERIKEKLERLVERIERSDRDEKELIEEVIKVIEDVLRLIEELIKEWIRVNEKALELDRRLVEEVKRVIERLLRAIERLISKGNKELLDKAKEIVDRVTEEVERILEENERLWRESIKDVKRILDEAREIVRRLLEEVRK

SEQ ID NO: 27656 - protein, 247 aa, Artificial Sequence; identical to SEQ ID NO: 27655
  Synthetic sequence.

SEQ ID NO: 27657 - protein, 233 aa, Artificial Sequence
  Synthetic sequence.
DESEKVKEILERIERSLREVKRRVDEVLKRIKELLEELKRRHDESVKELKRILEEIRNSDKEAVKRVEKREREIIKRDIEVNERVLRELKKLLEELKKVLEENLKRLKELLEELDTTDDIRREVERLIKENRELIKRVEEEMRKLEETLRRMAKEYKREVDELEERARKSNLDGEELAKTLEKLAKELLDANRRLVDTSVKLVKRLLEIVAELVERHKESNRRLLKLIEDRDR

SEQ ID NO: 27658 - protein, 233 aa, Artificial Sequence; identical to SEQ ID NO: 27657
  Synthetic sequence.

SEQ ID NO: 27659 - protein, 236 aa, Artificial Sequence
  Synthetic sequence.
SEEDILRRVVEELERLIKEAKEIIEEIRRLHEELDRKSEELLDRLLELLRDLLRRLNVDDERLRRALERVEREIKRLKDEYKENNKRLEEEVERLKKELDDALERLKRELDKLKRDKDALAKLVKELLDVVREVVEALKRLSTHNVEVNEKLDRDLVRLWEEAVEVIKRVLRERLSDKDKVRRLDELVKELLERLRRLHEENTEEVERVLRESARLLDDLLRKVEEVVEKIKEELR

SEQ ID NO: 27660 - protein, 236 aa, Artificial Sequence; identical to SEQ ID NO: 27659
  Synthetic sequence.

SEQ ID NO: 27661 - protein, 237 aa, Artificial Sequence
  Synthetic sequence.
SREELVKDILRLLTESNDEHKKLSDKLVDLVRKLIELAEKLTEEVVDLVRRLLEELNLDEEVLRRLKEILEKLRKDNRDVLEELKKVLEELKEANAEVHRRSERLLRELKKRLDKVKGEEAVKLIEDVLREHSRLLEESVRRNERVAERLVELLEDLVDKNRRVLEELVELIARALDSEDAKELLKKVKEIVDELVRRHKKLVDEVREVVERVVREHRELVKKDRRLVDEVLKRLRT

SEQ ID NO: 27662 - protein, 237 aa, Artificial Sequence; identical to SEQ ID NO: 27661
  Synthetic sequence.

SEQ ID NO: 27663 - protein, 237 aa, Artificial Sequence
  Synthetic sequence.
SREDLTRETERLLRESNEKHKELTKEIIRLVDRLIKLLEELTERLKELVKELLKRLRLDKEVLDRLREILKELDEANRTVVDTLRKVLKRLKEELDRVHRESEELLRTLRDLAERVRGEELVERITRALETHSELLERSVELLKRVLEELVKLARELVKRNEDVLRRLVELVERALDSEDAKKLVKEVRDVVERVRREHDKLVKEIEKIVRDIEKKLRDLVREDRELVKKIEKKLRD

SEQ ID NO: 27664 - protein, 237 aa, Artificial Sequence; identical to SEQ ID NO: 27663
  Synthetic sequence.

SEQ ID NO: 27665 - protein, 239 aa, Artificial Sequence
  Synthetic sequence.
SAEDLVRRVKDLVDKLEDKLRKVVRTNERLWEEIRKRLEELVRRNKELWDRLVEKLKAGDKDKDELIEEAKRLEDESNKLVEKLVRDIERVLRESNKLLDTLAKEIEEVLEEIVELVEREGLADKKAREKLEDIKRRLKEVLKKLREESKRIIDELRRLLEEYKRLVKEIRDRIEEVRKRNSEIRVLVELVRRHNKVLKELVEELEKLVRDHNRVVEEVVRELVELLRRAVEVIKEVVK

SEQ ID NO: 27666 - protein, 239 aa, Artificial Sequence; identical to SEQ ID NO: 27665
  Synthetic sequence.

SEQ ID NO: 27667 - protein, 253 aa, Artificial Sequence
  Synthetic sequence.
REKEVIDDVRRMLEDLLRTIRRVIEENKRIVKESSDHIREVLKRVLEVLRRLLEEVKRLTERPVDEEDVKRTAEELLRILEEVVKEVEDAVERNRRLIEESIKELKRIADELVRRAEAVIEKVETELGRESEKVERIVRIIEEVIEAIKRIVKSLVEINEEYVRLVEELVKDIVDIIRRVAKLLKELADSRRDRKDVERELEKIIREVEERLRRVKEKLDDIDRRAKELHEEVMKRLEELVERIRRLLEDVER

SEQ ID NO: 27668 - protein, 253 aa, Artificial Sequence; identical to SEQ ID NO: 27667
  Synthetic sequence.

SEQ ID NO: 27669 - protein, 254 aa, Artificial Sequence
  Synthetic sequence.
SDEEILREILKTLEDVVRRLEELLKENEKLIRESTKLIKDVLDELLEIIKRVAKLIRDLKRNKVDEKTVEDIVRKIEEDLKRVVDKLRKLVKESEKKLTDSVKALRDVVRDIERLLRELVDKARKNVRTDELREVVERLEKLLRDALRVIKRIVDELERLNREYLTDVKEIVKRLAELLDDILRVVREIARDEDEETVERKLKKLLDKARTELEKIKRRLDKLNEDYERKLRELEKRLRDLLERLRKTLEDIRK

SEQ ID NO: 27670 - protein, 254 aa, Artificial Sequence; identical to SEQ ID NO: 27669
  Synthetic sequence.

SEQ ID NO: 27671 - protein, 242 aa, Artificial Sequence
  Synthetic sequence.
SEIEKILEELKRLVERVLKLNEDIARRIAELVKKDLKLIEDLLRELEDLVRKILDALRKKKDSKELVEEIKKRLDELLKRVREESDRVLKELKELLDEVRKVHEEIKEALERLLDKARKTIKDERILRLIEEIVKRLIELVEDNLRKWEELVKRHIELNEELLKRLEKVVEDIKRIIELVARGEEDKDKVVEEIRRLLKRLKEEAEKVARESEELLRRIREASKELAERAKDLLRKLDEAVR

SEQ ID NO: 27672 - protein, 242 aa, Artificial Sequence; identical to SEQ ID NO: 27671
  Synthetic sequence.

SEQ ID NO: 27673 - protein, 251 aa, Artificial Sequence
  Synthetic sequence.
SDEERILDTLRRIIEDLLRLLREALRRHEELLRRNIELIRRVLETIKEVLRRLLKLLLEVAKEEIKELKDALRKLLEELDKALKEYKKRIKDSLDELRKVIKRLEEELRRLLRELEEVRKKIEDRKTLIDTLKRVIDDIVKLLEDALRDLERVLDENMELSRRVVEILERVIEDVLRLLEEVVRRLKERRDREELDRLLEDVRRVIEELKKLVREVLERSERMVKEVRDLWRDLKRRIEEAAERIKDELRR

SEQ ID NO: 27674 - protein, 251 aa, Artificial Sequence; identical to SEQ ID NO: 27673
  Synthetic sequence.

SEQ ID NO: 27675 - protein, 239 aa, Artificial Sequence
  Synthetic sequence.
SERELLEKVRKVAEENIRILEEVLRKIAEVVKEDLKLLKELLEATERVVEELLKRIVEKKKREPEEAIRRLRKLLKELREEMERVKKESKRLLEELERILRRAKEKTEELLKRLRELLEAGLPRKDLAETLLRVVEAHAKLLRDVARVLLKLLEDHIRLSRELARRTEEVLKRIAKILREESEDETLERLLEELERLVKEVVERSERLLKKLLEDVRRVAEELVKSVEDLLKDIEREVT

SEQ ID NO: 27676 - protein, 239 aa, Artificial Sequence; identical to SEQ ID NO: 27675
  Synthetic sequence.

SEQ ID NO: 27677 - protein, 232 aa, Artificial Sequence
  Synthetic sequence.
REKELVDDIRRILEEILRLLRRLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLKELVRVTEELVRTNKELLEEAVRVIRKEVEDDSLVREVEELIKRLEKHIDDLLKTSRDLVKRVLDLVDEVVKRVEDLVERVKEKIDT

SEQ ID NO: 27678 - protein, 232 aa, Artificial Sequence; identical to SEQ ID NO: 27677
  Synthetic sequence.

SEQ ID NO: 27679 - protein, 247 aa, Artificial Sequence
  Synthetic sequence.
DEERLAEELERVLDRNRKLLEEALRELRRVIEENRKSVKRLLDELKRVLDELLKVLRELSRDDKDEKLRKVIEDLIRKLTKVLDKVRRLVEENIERLRRVLEKLERLARENLEDLKKVLDDVDKKLKDRRLVERLAELVRELIEVNKEILEMLKEIVRELLEINRTLLERLKDLVRTALEIIKLLARGDITEEDVERAVKEIRDRLRKLLEDYERAVRRLEDKLRRVRERYEKVLKRIKDKLEETKR

SEQ ID NO: 27680 - protein, 247 aa, Artificial Sequence; identical to SEQ ID NO: 27679
  Synthetic sequence.

SEQ ID NO: 27681 - protein, 247 aa, Artificial Sequence
  Synthetic sequence.
SREEVLRELEEVIEDNRRLLEELIEKSKKVLDESLKLIDELLRRLEEVLERVLRLLEELSKLDDEETLRRIVTKIRKELEDVLDEVRRIVKEILDRDRRVAEDLKRVVDENLEKLKKVLDELDKKLKDRRLVEILRDIVRLLIEINERALRELLKLHEEHTRIVAELLRELERVVEELRRLVELIARGEIREDDLKRVVDEVEKKLRELKRRYKEALERIKEKIKELKDRYERAVREVVAELRKTTK

SEQ ID NO: 27682 - protein, 247 aa, Artificial Sequence; identical to SEQ ID NO: 27681
  Synthetic sequence.

SEQ ID NO: 27683 - protein, 230 aa, Artificial Sequence
  Synthetic sequence.
KKDEEIREKLDRLLEENRRALEEITTRLDDLLRRNKDALRKVMEKLKRLLDDLRRADIREELLKRIADVIRDIMRLLKELHDHTAEVIKTIKKLLKELHDINKEIIERLKRLKDNNVPKEELLKRVEELVRTSLRLTTEVLKTVEKLIRDDKRLSEEILKRVKELIEELKRRVDIERVKEILERILRVVEEAVRLNEESLRRILDVVRKAVKLDRESLKKILDVVEEAVR

SEQ ID NO: 27684 - protein, 230 aa, Artificial Sequence; identical to SEQ ID NO: 27683
  Synthetic sequence.

SEQ ID NO: 27685 - protein, 243 aa, Artificial Sequence
  Synthetic sequence.
SRVEELKKLIEDILRISREVVERIKRVAEDIHRINRRVLDDLRKLIEDILRTVEEILARKVKDTEMAERLRDTIRRVVDEIRKLLEEHEKRSRELLEEIRKLLEDILRRSERAVEEIRELLKKNVRTKDVLRIIEEILREHLELLERVVRRIEEILRELLKTIEEIVKRIKEILEELKEVLKRGRVKDDEVEREIRRVKEDLDRILEEYRRLLEEIKRKLEEILRRVEELHRRLRRKLEEIDR

SEQ ID NO: 27686 - protein, 243 aa, Artificial Sequence; identical to SEQ ID NO: 27685
  Synthetic sequence.

SEQ ID NO: 27687 - protein, 244 aa, Artificial Sequence
  Synthetic sequence.
SRVEKVLELLKRIIEILRELVKVHLDVLRHNDELLKRIVEDLKRLVKKLVDILKEIVEKRKGEELDEIVRRLAKKLDEIIKTLKRLVDELARRNKESIDTLRRLVERLEERLREIVKLLKKLEEEGVDEETLKRLIETILRDIERVVRELKEIMDRINDENRRVVETLVKIVDDLLKDVEDVVRRANVDEEALERLKRLLEEIRERLEELKKRLEESLKRHEEEVRKLLDKLRRLLRRAEEEAR

SEQ ID NO: 27688 - protein, 244 aa, Artificial Sequence; identical to SEQ ID NO: 27687
  Synthetic sequence.

SEQ ID NO: 27689 - protein, 232 aa, Artificial Sequence
  Synthetic sequence.
SKEDELRKVLETLERLARELEELNKKILDDLKKLIEELRRHTEEVMRRLKELADELRKKPTSEDLERILRRLEELLEEHKDDLEKITETLERLVKKHNDLNKEVLDKLRRLLEKAKKDRTGREVLKELDEIIKEWRRLLEESIRELREIIKEIKKRLDDSIRKFEKMVEDVERSGAGEEVVRVLEELLRLVRDNVRRLDEILKELLRLVEESVRTAEEILKELLRLIKELAR

SEQ ID NO: 27690 - protein, 232 aa, Artificial Sequence; identical to SEQ ID NO: 27689
  Synthetic sequence.

SEQ ID NO: 27691 - protein, 237 aa, Artificial Sequence
  Synthetic sequence.
SIEELVDELLKVLKEVVEETAKLLEENNRRLKKITDDVRRLNEDTIRRLREVVKELETKRDERDVVRRIIEKLKKVVDDYRRVIEELIKRNEEVAEESRKVSEKLLKELEDLLRDIEKKVKSREKVRMLKRLIEELIRLNKELADIDVEINKKVSEVLRRNLEKVVEIAKRVLDVIRRDTDDDKARKALEDLERELRDVDRRSDEEATRLHEEHKKALDRYVKELKRVLDKMKEDTR

SEQ ID NO: 27692 - protein, 237 aa, Artificial Sequence; identical to SEQ ID NO: 27691
  Synthetic sequence.

SEQ ID NO: 27693 - protein, 237 aa, Artificial Sequence
  Synthetic sequence.
SEKELVDKLIKLLEDVVKKLEDIARDNNRILKEIADRVKELNERTVEEIKRVIEELRRKKDDREVVKKILEDIERVLREYEREIEKLIKRNDDVARKSEEDVRRLLEEVKKVLDEISKDLKDERLVKALADVIRKAIELLKRLLDKDVKINEEVSRILKENLDEVRKIVEELLKLIERDTDEEKLTRAAEDLLRKLRRVDEESDKKLREVHRKHKEALEEVKRRLKEITEEADRATR

SEQ ID NO: 27694 - protein, 237 aa, Artificial Sequence; identical to SEQ ID NO: 27693
  Synthetic sequence.

SEQ ID NO: 27695 - protein, 240 aa, Artificial Sequence
  Synthetic sequence.
SESELIRELEKLVKEIVDELERLLRNNIRLLEEVAKTLIRLLENNIELLDEILRELERLSKENRPDDEVRRTVEELLRRSREHSREVKETVEELLRRLERHSEEVRKTVEKLLTDLRRVVERNNQEDLRKLVDDIERVLRELLEVNRRANKKAKEVLEELLEVNDRANRKVERLLEVLLRGEVSEEEVRRTIERLKEEHEDALRRLKEILEELKDEHRRVLKRVKDKLRELKRRLEEREK

SEQ ID NO: 27696 - protein, 240 aa, Artificial Sequence; identical to SEQ ID NO: 27695
  Synthetic sequence.

SEQ ID NO: 27697 - protein, 228 aa, Artificial Sequence
  Synthetic sequence.
SEREELERLLKELEDVTREVVERLKKLLRDNEKLTDEVRKRLRDLLRRLEEMVRRRGLSDEVLKDLKRLIEELLKTVEELLREHIRSVEELLKAIRKLLEDHIRLIKELVRRADQRDETLERVDRKLEEDHRRILRRLEKVVEELKKEHERILRELEKVVDKVKKDLERVRREEEIEEIVKRLVEVLEKVLRELERASRKLVKVVEEVLRALEEISKELVDVVREVLR

SEQ ID NO: 27698 - protein, 228 aa, Artificial Sequence; identical to SEQ ID NO: 27697
  Synthetic sequence.

SEQ ID NO: 27699 - protein, 244 aa, Artificial Sequence
  Synthetic sequence.
DEDRRLEDAVRKLRKEHKDIMKKLDDIMRELDEDHRRIKERLDRILEELKKLLTRVLRETREDELLRKVLELLTRLLKLLADVLEENKRLLEDILRLLKELIETNLRLLEEILRLLRKVRREPVSEEEAKRLVEEITRLLERSTEEARKLVETIKRLLEESLDKLRRLVEEIERRLRTVLEEIRRRGAPEEIERIIRRVIEVIREILDLVRKVNKKALRVIEEILEDLARVNKKAVDAIDELRK

SEQ ID NO: 27700 - protein, 244 aa, Artificial Sequence; identical to SEQ ID NO: 27699
  Synthetic sequence.

SEQ ID NO: 27701 - protein, 244 aa, Artificial Sequence
  Synthetic sequence.
DEERLLKTILDVIRKVLKESKDILRRVEEILRRVIETAKEIHKEVKEIIEDVLRLLRENDKLEELVREVAKRLKEVIDRWREVVERVAETLKRVLEEHEEVVRRVARELEELLKRLREGEKLRAIEEVVKKVVRALEELSKELEKIVRTIVKLLRENVRRLEEILRRVVKLLRELVKLAKERSREEEIEKRVREIKKEVEDLLRRSEELLKELLDRIRKLLEELKKRHEDLLREVKKDLDEIRR

SEQ ID NO: 27702 - protein, 244 aa, Artificial Sequence; identical to SEQ ID NO: 27701
  Synthetic sequence.

SEQ ID NO: 27703 - protein, 240 aa, Artificial Sequence
  Synthetic sequence.
DEVEELLKRVRELLKRSEELVRKILEDVKRLLERSIEEVEDLLRKVEELLKRLLDLVERRKLLEEILRELVRLLKEIVRKVLELNRKLVEDVIRIAKRLLELNKESVKEWDRILKLLRDGTVDKKELLKDAEEALEKYERAVREILKELEEIIKEYVRRVEELLKELKDAVDKAKDEVRKEGSDEDLDRDVDRVLKEIMDLLRDLVRRTKELLEELLRLLEELVRRHKELVRKILDEIRK

SEQ ID NO: 27704 - protein, 240 aa, Artificial Sequence; identical to SEQ ID NO: 27703
  Synthetic sequence.

SEQ ID NO: 27705 - protein, 247 aa, Artificial Sequence
  Synthetic sequence.
REAEELLRELEELLKKSEKVLEDLLRKNRELIKDSKRRLDEVRRKVEKLAEEVEEVIRRGVSEEELIRVIKKVLDDLRRIIKELIEVSRKYLRTTLELVKELLDVSRDVLREVLRIIKALLDTIAKDNKEEKIKEIADVADEIRKLAEEDIRLIKKLLEESAKLVDEDVRKLEEIAKEITELVERLRRTTDKDAVRKLIEELKKLLEDLVEHHERLLKEDHERLKRLLDHHRELLKTVLTILRETAK

SEQ ID NO: 27706 - protein, 247 aa, Artificial Sequence; identical to SEQ ID NO: 27705
  Synthetic sequence.

SEQ ID NO: 27707 - protein, 238 aa, Artificial Sequence
  Synthetic sequence.
ELDEILRKVVEDSRRLVKELEDILREVIERTERILEEHRDLTRKADEDIRRILEEATRTKTDDELRERLKRLLDETAKLHRDVKKRLEDLNRDLLRLEDEILRRLEELNRRLEEVLRKKNKVSEKILKEHRELLEESRKRLEEIKKEHREMLKRSEDESRKILRDLEELVKEIDDKEDKKPKEEVLKDIVRVLRDVLKKANDLLKTHLDLNRESVKKVVEIARRHVKMNEDSVRKVEK

SEQ ID NO: 27708 - protein, 238 aa, Artificial Sequence; identical to SEQ ID NO: 27707
  Synthetic sequence.

SEQ ID NO: 27709 - protein, 238 aa, Artificial Sequence
  Synthetic sequence.
DVEDVLREVVERSRRLVEEHKRISEKVIRDTKRILDEHRELTERVIRRAKKLVDDARRTKTDEEVLKRFADLVRELLELHRRVKKKLDELNERLLRAHRTLLERLERLNRELLKLLRERNKVSEEIIRKHEELLKKSRRESEELIKAHETMLEESERRSKKILDEVERLLREIEKKARKKPKEEVLKDAVRVLEEILRKLNELLERHLKLNEESLERMNRILTRHVKLNKESADDARR

SEQ ID NO: 27710 - protein, 238 aa, Artificial Sequence; identical to SEQ ID NO: 27709
  Synthetic sequence.

SEQ ID NO: 27711 - protein, 245 aa, Artificial Sequence
  Synthetic sequence.
DEEELLRRVTEELKRLLDEARKLHEDVKRELEKLLKENDDLLRDVKRKLERLLEALKRGELTEDEVIERILRLVEELLKRHAETVERILKLVRDLLRLHEKLVKEILDLLTRLLELLERRKGEENREKVDKLKKLAKKVVDEVERSLEELRRLVEEVIKRIRDSLRRSARIVKEAVRELRELLRDVRDKDKLLERIRRLLETLLEVLKRDNEEIKRILEELLRVAEENLRRIKEIIDRLLDATRR

SEQ ID NO: 27712 - protein, 245 aa, Artificial Sequence; identical to SEQ ID NO: 27711
  Synthetic sequence.

SEQ ID NO: 27713 - protein, 249 aa, Artificial Sequence
  Synthetic sequence.
DEEEVVKRLADVLRENDETIRKVVEDLVRIAEENDRLWKKLVEDIAEILRRIVELLRRGGVPEELLDRLRKVVKRIVEKAEKILERLNRVSKAIAEKLKTIVDELNEVSKEIVKRAEDILRKVKDKETVLRKLRTLVKEYADLSKEVLERVERIVREYVKLSDEVVKSLREIVEELIRIIEDLLRKVNLDEDVKRALEELVKRLRKLLEDVKKKSEDIVREVERIVRELKKRSDEILKKLEDIVEKLRE

SEQ ID NO: 27714 - protein, 249 aa, Artificial Sequence; identical to SEQ ID NO: 27713
  Synthetic sequence.

SEQ ID NO: 27715 - protein, 240 aa, Artificial Sequence
  Synthetic sequence.
KEREEIRERVKRILETSRKLLEELAKAVEDVLRRSKELIDELRDAVRRVLEELERGGLEEELRRILEEVARILERLIRALEDLNRRAAEILRTLIDLAKKLHDELKRVIEELDKKPKSRELVEEAKRAVERYKRVVEELLDRLREAVERLRRAHEELLRDAARVVKELVDKLREVLKRVDEDRTKKIVERIIELIEELLRLLVKVVEDSVRLIEELLKLAEEVAKRSLKLIEDLLRAIEK

SEQ ID NO: 27716 - protein, 240 aa, Artificial Sequence; identical to SEQ ID NO: 27715
  Synthetic sequence.

SEQ ID NO: 27717 - protein, 247 aa, Artificial Sequence
  Synthetic sequence.
SDDEVIEKVKEDLRRLIKEAEDVVREYEKRLREVEKKLDEVVKESERLLRELLKKLEAGEKDVREIVRELLEVNKDVLRKVVEIVKELKKIDEDLLRKVEDIVRKLLEVIDEALRRVIESKKDVDRVRKIVEELRRKAEDVLRRIRELVRDLERISDETLERVKKLVKESEDLAREALDRIEKVNTDKKELIKILRDLARKHRELLKRLKELTREHLKRVREILEELLRVTRELVEEIDKILKDLKK

SEQ ID NO: 27718 - protein, 247 aa, Artificial Sequence; identical to SEQ ID NO: 27717
  Synthetic sequence.

SEQ ID NO: 27719 - protein, 240 aa, Artificial Sequence
  Synthetic sequence.
SEDEVLERIRRALERVEDEHRKVLEKIVEDLKDVLEKHKRVLEEAKRDLERIKEDADKGVPIEELIDKLRRLLEKLIERVRRITELLKRIIEEVARMLKEITDELRRIAEEVVKDTPEDERLKEVRRELEELLKENDKLIKDLVKEAEDLLDEDRKLISKVLRDLERLIEDLRDRLRDSDEKSLKDLLREVLERSKKLLEEHHKHLEEIVRRTKELLERHHRHLKEIIRRIEEILKRERD

SEQ ID NO: 27720 - protein, 240 aa, Artificial Sequence; identical to SEQ ID NO: 27719
  Synthetic sequence.

SEQ ID NO: 27721 - protein, 237 aa, Artificial Sequence
  Synthetic sequence.
SKEDELREVLERVKRLIETVKRALDEALDRTRRLIEELDKTSKRVLTTVKKLIEDARREDKRELLKKLAELIEEHLRTLEELLRRNKDLLREILELLEELLKELKRLLKELLENQERDEEVKRVLDRIRRLLDEVRKDLERLVEEVRKLHKEIEDRLRELTKRTRELLDKIRRLLEEGVDERDLLRELLRIVKEHVDEVRKLLDELRKVNEKIVDAVRKILEKLLKIATDAIEETRK

SEQ ID NO: 27722 - protein, 237 aa, Artificial Sequence; identical to SEQ ID NO: 27721
  Synthetic sequence.

SEQ ID NO: 27723 - protein, 251 aa, Artificial Sequence
  Synthetic sequence.
SEKERLMEEIKRVAEELRKTVDRLRERNEKVVRDIRETVREVEREHEDVVKELADRVRELRRTDALERLVKLLLDIIKRLVEESRKLVELVLKIIEDNVRALTELVKRLLRIIEELLRVLRDVEGKEELDKVKKKVRDELKKVEEEAERILRESERLLREVEDTVRRIHEEVERKLREVEKRIEDSNLSEEVREVLRRLTKILRDLLKRNKEIMEKLLRDLKELLKENKKALEDLLRKLEELLRRIAEAEK

SEQ ID NO: 27724 - protein, 251 aa, Artificial Sequence; identical to SEQ ID NO: 27723
  Synthetic sequence.

SEQ ID NO: 27725 - protein, 240 aa, Artificial Sequence
  Synthetic sequence.
SKEETTKRLLDRHLERDRELLDRAARTNEEILRRNREVLKELFELLKRILDRVREANLIKRELLREAEERVKEILKEVDDINEEYKRELERILDEVDKRNEETKRLLEEIVDELRRTGTTEEVIRKVLEVVRRNLEVHRKLLEDSIRLIRRLLEVTRELLERLIEVIERLLRALLEDKKELEEVLRELRELLKRLKKRLEELLREHEKLLEDYKDRLRKSDDDLRRSVEEIKKALDRLRK

SEQ ID NO: 27726 - protein, 240 aa, Artificial Sequence; identical to SEQ ID NO: 27725
  Synthetic sequence.

SEQ ID NO: 27727 - protein, 240 aa, Artificial Sequence
  Synthetic sequence.
SKLEDSAEKLKEHLKRDRELLKRAEDLLREILRRNREVLDELRRTLDDILRRIREENLIKKEALDEVKKEIEEVLRKADRANEKIKKAVEDIVRKAEEANRDTEEKVRRILEEVKRRGTTDEIVRALLRVLEENLRVHKELLEELLRVVKELVDLTRDLLRRLIEIIEKLLRLLKEDVKEAKEVLDRLEKLLRDARKRLKELLDEHEKVLEDMERRLRESLDDLRRSLDRIRKDLKRKTD

SEQ ID NO: 27728 - protein, 240 aa, Artificial Sequence; identical to SEQ ID NO: 27727
  Synthetic sequence.

SEQ ID NO: 27729 - protein, 243 aa, Artificial Sequence
  Synthetic sequence.
SEKERTKELLERLLKLIRELLKKLEDLNRDLLRRVKEVLDRLAELNEELLRRVEEVTRLRDEVDKDELTRRLREIIRRYEEELERIVRELERILTEYEEMVRRLLREIEELIDRVKKELDKLPRTEILEKVKKVIEKILDSIRKVIKASLESAKELLDELRRVAKASVRLVRELLRIAEEVKEKEKLTKLIKEIKERSKRLLEEVKRALEEVMKKNEKILRDVRDDLRRAREELREILREADD

SEQ ID NO: 27730 - protein, 243 aa, Artificial Sequence; identical to SEQ ID NO: 27729
  Synthetic sequence.

SEQ ID NO: 27731 - protein, 249 aa, Artificial Sequence
  Synthetic sequence.
REEEKLKETLERILRELEKLAKENKELLERILKRDEDLTRENKETLDRLLKRVEEVTRRKEDDDRLREILERIKEEVDRDVRKNEKILKDIEDEVREAVKRNETRLREIKRKVEELVKDLREKLKDVDRARRIVEELKKIIDKVLDDHRKMVRRLLEVIKKLLDLHRESVKKLKEVVKELLDILREVRGDREVEKVLRDIKRKIKEIVDEHRDMNRKIKEEIDRIDTEYKKSLKDIKKEIEEVLDEARQ

SEQ ID NO: 27732 - protein, 249 aa, Artificial Sequence; identical to SEQ ID NO: 27731
  Synthetic sequence.

SEQ ID NO: 27733 - protein, 240 aa, Artificial Sequence
  Synthetic sequence.
RKEEAIERIRREIEKVRRRLREVHKESEERIRRLEDEYRRALETSAELIRRILDELRKNRVREDDLRRDEELARKLEKLNKELLEALRRIVKKLEDLNREVEKSSEELVEELKRVLDSDLDRDELTEVAKRLKDKLKRILDELRRLHEELKEELERLLKRYAEVIEKLKEDLKRVLAEVTDKRVKDIVRKILRVIEENLKFVAEAVKKLKEIIERNLRLLEEIAKLLLDILEEVLKRLTT

SEQ ID NO: 27734 - protein, 240 aa, Artificial Sequence; identical to SEQ ID NO: 27733
  Synthetic sequence.

SEQ ID NO: 27735 - protein, 240 aa, Artificial Sequence
  Synthetic sequence.
REKEVIEDIKRLLDEILKRLEEANKETEERLEKLRKEYRELLEDSKRKIKDIEAELRRLNVPEEKLRLVRELVKRLEDLNRRLKKALEDIARRLRDLNRRVKELIKRLLEELKEVAESNLDREEVEKVIRDLIRRLEKILTDLDEVHERLKKDLEKLLEEYERTVRKLLKDLEEVLKRVDKEAVKEIVKRLKEVIKDNLRVVEELVRKLKEIIEDNLRVLREIAKLLKDVLEKLLRDVRK

SEQ ID NO: 27736 - protein, 240 aa, Artificial Sequence; identical to SEQ ID NO: 27735
  Synthetic sequence.

SEQ ID NO: 27737 - protein, 240 aa, Artificial Sequence
  Synthetic sequence.
DKDKRLEELLKRLKELNDKTFEELERILEELKRANERSLREAERILEELRRRIEERNLDKRLAELLKKLLDDLKRLLEEYTRTNEELLKRLRELLERYRETNKKLLDLLRKLLDEARRTKTDEDLLRRLEDILRKYEDEVRRLLKELEDILREYEDTSRRLLEELERIAKEAAERVSRIKDKDVKDIIRTILEVARDLLRLLEEDSRTNSEVVKRLLDLLREDSKANSEVVKRLLDVLRE

SEQ ID NO: 27738 - protein, 240 aa, Artificial Sequence; identical to SEQ ID NO: 27737
  Synthetic sequence.

SEQ ID NO: 27739 - protein, 240 aa, Artificial Sequence
  Synthetic sequence.
SKEETLKRLLDELEKRNRETVERLERLLKELEDRNRRSLEELERVLEELERKIEESNLEKELKDTLRRILEELRKLLEEYFRKNEELLRLLRKLLDEYRRTNEELLRLLEELLDTARRTRNDSELLKRLEDIAREYEKRVRRLLEKLKDILDKYRKTVEELVRKMEEILKEAKKTISRIERREVKDIVRKMEEVIRRLIEILRRDVELNLDVAKKLLELLKEDSKLNLDVARELLELLDR

SEQ ID NO: 27740 - protein, 240 aa, Artificial Sequence; identical to SEQ ID NO: 27739
  Synthetic sequence.

SEQ ID NO: 27741 - protein, 243 aa, Artificial Sequence
  Synthetic sequence.
RELELLDELLRRTERLVKEYLRVSKELLEETLKLLTELLKLSKRLLEETERLLRRDKLGDEEEIRRLIRRAEDSHRRLKEIIDRLFREAEESHRRLEDTIRKLKREAREVLKALERGERSLKEVLDVLDTLVKRLIKVLRDNNRRLEELLRRLVKVLEENARILEDLVRELIRAAREKLRDKSKTELLEEAVKRLETLLRRYKEEIRRVAKRLEELLRELNELSKRLEETLKKLLEDLREDAR

SEQ ID NO: 27742 - protein, 243 aa, Artificial Sequence; identical to SEQ ID NO: 27741
  Synthetic sequence.

SEQ ID NO: 27743 - protein, 243 aa, Artificial Sequence
  Synthetic sequence.
DEEETLRRLLERKVELAKEYLDVSKEVIDRTTKLLDEYLKTSKRIVDKTVELLERDDLGPKELIKRLKEELERSLRELEEEIKRLKRELEESLKKLKEIIDRLKEEAEKLLRVLKRGEKSEEEALRALAKLVRELIEVLRENDERLRDVLRRLIEALRKNNEILERVLRKLVRAAEERLRDKSLRERLEEARRRLEELLRELNEITKDLERKLEKLLRDLNELTKRLEEELKRLLDELKKRTD

SEQ ID NO: 27744 - protein, 243 aa, Artificial Sequence; identical to SEQ ID NO: 27743
  Synthetic sequence.

SEQ ID NO: 27745 - protein, 247 aa, Artificial Sequence
  Synthetic sequence.
SEEDELVKRLRELVKELIDAIREHLRRLEELLRELLKALEDHLRKLAELVRRIIEELRRTNAVDDKLLETLDRIVKRVAEEHKRLNEELERIARKVAEESRRLLEELERIVRKVETDIKDLKDKGGDKDAIARLVKELADVARRVVTEHARLVRELARAIKEVVKAHVELVERLLEVIKEVIDRGDVPEELKERIRRIVETIRRSLERLKEEADRIVKEIEKSLRELEERLERIVDTIRKLLEDAKR

SEQ ID NO: 27746 - protein, 247 aa, Artificial Sequence; identical to SEQ ID NO: 27745
  Synthetic sequence.

SEQ ID NO: 27747 - protein, 251 aa, Artificial Sequence
  Synthetic sequence.
SEDDVLRKLLEAIKKLLKETKEILDRYLRESDRHNKALREILERLLELIKTLLEDLVRRTGKVKDLDKLAEDVKRVRKRLEEILEDNKRKSEEIARRLDKILDEIRKRVEDVVRELERITREVKDKDTLVREVVRLLEELLEVARRVVKRLEDLVRENNRVNNEVTERLVELLKRLLELTDDLLRKLRKDVPEEALKEIKRKLRELEKEIRKVVEDSRRISEESLRRLEKALEDIERILKKLSDEIRTDAT

SEQ ID NO: 27748 - protein, 251 aa, Artificial Sequence; identical to SEQ ID NO: 27747
  Synthetic sequence.

SEQ ID NO: 27749 - protein, 233 aa, Artificial Sequence
  Synthetic sequence.
DEEEVTKEVERLNRELLKRLREIVEETKDLNRRLLEILEELVRRTEKLLKDVLEIRKRGEKDERVLRDLKRTVEELIKRAKDALERYERDLRRIEERLKKLLDDYRKVLEDITRALPRDEKVERLVRLLERSLEVIEELIRLIVKILRDSLRVVKELIDRIVRIMERILELLRKEKDKDRLREELKKLLEELRRVLEDAKRKSEELSRRLEEVLRRAEEKNKEIMDRIRKARE

SEQ ID NO: 27750 - protein, 233 aa, Artificial Sequence; identical to SEQ ID NO: 27749
  Synthetic sequence.

SEQ ID NO: 27751 - protein, 235 aa, Artificial Sequence
  Synthetic sequence.
KEKEELLEEVERKVTELKKRSEDLVRKLDEEVKRLEREHEELLKKLRDAVEELRRAKLEIDDLERTTRELTREHEETLRKSLRELERLLEDHVRTIEKVLKDLRKILEDVAKKTRDDERLKELTKRLEEAAERLRRDHERLLRDLERVMRELKKLHEDARRELERVVREVKEEEDRETVLRKIIRLVEELLKILARINEEVKKLIRKLLEILTRINKKMIEVIDELVKIIREAAT

SEQ ID NO: 27752 - protein, 235 aa, Artificial Sequence; identical to SEQ ID NO: 27751
  Synthetic sequence.

SEQ ID NO: 27753 - protein, 243 aa, Artificial Sequence
  Synthetic sequence.
SEEERTKESLKKVLKALVDLNRELLRKLEENMRELTKLNEEVKRKLKEVLDKVRENGIVDKDAEREAERLMRELDKSSEDTKRETRKLIEESKKSTRRTEEEARKLTETLDRLKEAGLPREDLLRALVRLLEELARLIEEDVRRNAELVKRHIELVERDVRELLRLIKELVDLLRDLAEKLRRTEEIRKIVEEILKEIKELADRYREEVRKSKDKLRRILEDYKRKVDELKERLRELIEEVET

SEQ ID NO: 27754 - protein, 243 aa, Artificial Sequence; identical to SEQ ID NO: 27753
  Synthetic sequence.

SEQ ID NO: 27755 - protein, 239 aa, Artificial Sequence
  Synthetic sequence.
SLKELAEEVLRRILELLRRIIEIHERSLERSNRTLKKLIDEIERVMREILETLKRALSIKDKEKLKEVRDRLRELLTELLRRAEEIAKENERLLRENKKRLKKIAEELRKLLEDLKRRLSGGPDKLERILREETKLLEDILRRIEEVVKEHEKLNREVLKRLKEILDRTRELLKKLADEDSRDRTLLEEIRRRVEKVIREARETLREHRERVERSIEELRRMLEDVERIVREAIERLRR

SEQ ID NO: 27756 - protein, 239 aa, Artificial Sequence; identical to SEQ ID NO: 27755
  Synthetic sequence.

SEQ ID NO: 27757 - protein, 239 aa, Artificial Sequence
  Synthetic sequence.
SEVEDILRRLAELNKRLIDKLRELIDRIRRLNEELLRVVEDILRRLKRLADELIRVVRERGDIPEELLRKLEEELKKIVDELRRLVEEYEKALRDLIKELRKAVEEYRRTLAELVERLRRLEEPEELLKDLAEDVRRNIKAVEEVIRRFEKNVEDNIEVVRRLVDALEKLVRRLEKVLRDKLRDEDLKRLLEKLKEDVERVLKEVRDRTRESLKHLEDVIRELEKKTEDSLRHMEERRK

SEQ ID NO: 27758 - protein, 239 aa, Artificial Sequence; identical to SEQ ID NO: 27757
  Synthetic sequence.

SEQ ID NO: 27759 - protein, 239 aa, Artificial Sequence
  Synthetic sequence.
SKEELVKEALEENVRSVEEVIKLLKDALDENLKVVERVIRELKRALERVKDVIRKLIEQRELLRRAEEELDRLEEELKRILDEYRKRVREIKEKLKKLLEDIRRVHEELERRLRREGPAERLLKELKELNKRIREMTERINREVRELNRALLEKIEDLVRRLVELLERVKERLKDNGRLDKKVADELKKLLDELKKILEEIRRMLEEANRKHDDIVRDIRRVLEENDRKLEKIADDIRR

SEQ ID NO: 27760 - protein, 239 aa, Artificial Sequence; identical to SEQ ID NO: 27759
  Synthetic sequence.

SEQ ID NO: 27761 - protein, 239 aa, Artificial Sequence
  Synthetic sequence.
SKKEELEKLLDTNLTEIRRLLKRVKDVLDRNLEVVRRVIEELARLLDEVTEVVRRLIDDEKLLREVEKVAEDIKRELERILREYEKLVEDIKRELKRLLEELERAHREIKKEVERDGPDDRVLKKLKELNDDLLRAIKEINDKVKKLNEDLRKKIEKIAREVLKLIEDVKRKLKEKGRLDEKVKRELEKLIKRVKDILDDIRRRLKKVNEEHEREADRLRRELERLDRELKKRMDDIRR

SEQ ID NO: 27762 - protein, 239 aa, Artificial Sequence; identical to SEQ ID NO: 27761
  Synthetic sequence.

SEQ ID NO: 27763 - protein, 236 aa, Artificial Sequence
  Synthetic sequence.
DEDEELKERTKKSLEKLRRLLERLEKIIRESLDKLRDLLRLLEEALKRILDELRRNNVVSKDLLTELKKLLDRLREEVKRLLEESKELVKELKKRVDELLTESREAVKDLERKVRREEGEEKLLRLVKRLLERHLELSDRIARLVVKILEDNLRLIDELVKIIKELLERVLEVVRRVVRDRDKLEKIERDIRKIIRDLEEIARRLKEDHERVIKELRETVKKHKEDLEEVIRELRR

SEQ ID NO: 27764 - protein, 236 aa, Artificial Sequence; identical to SEQ ID NO: 27763
  Synthetic sequence.

SEQ ID NO: 27765 - protein, 234 aa, Artificial Sequence
  Synthetic sequence.
REKEDVARRIKRIHDELETRIRKLARDLERIHRKLKEDIERLVREAEKKLRELEKKTTDDKIKTLIDRTRKTLEDLTDEIRRLLKKHLEDLKRLLDDIERVLRRHLRKLKELLDVARRNEVPDKEVRDEIRKSSRELEDILRRLREKLKTLHEEVRRAVERVRKKIEDLEREVRREGVPEEIERLVEELKKILETILKLIAELNEEVVRLLEDILRLVRELNERVAELLERAEK

SEQ ID NO: 27766 - protein, 234 aa, Artificial Sequence; identical to SEQ ID NO: 27765
  Synthetic sequence.

SEQ ID NO: 27767 - protein, 243 aa, Artificial Sequence
  Synthetic sequence.
DEERIIKTLEDINKKLVEDIKRILDKVRELNERLADAIRKILEETKRILERTTRKVRKDGEISEELLRRLEEKLRKLLEDLERVLREHEDESRRILEEVERLLKRHKDRSKELLDRARDVKDRVKRDKELVDRLKKLIDDSLESVRELIERLKELLDRLVKSVEDLIRTIKELLDRLVEVLREVVSDKDTLRTVEKLVEDVKRRLDKLLEDYKRLIEEVKKELDKLLKEYEDRLREIKKRIDE

SEQ ID NO: 27768 - protein, 243 aa, Artificial Sequence; identical to SEQ ID NO: 27767
  Synthetic sequence.

SEQ ID NO: 27769 - protein, 244 aa, Artificial Sequence
  Synthetic sequence.
DLEDAIRELLRRLTELIEELVRILEELNKRLNDLVRRLVEILRRINELLKKLVDRLRKDPDASEDLKRVVEEARRLHREALERLKEVVRELRKLHDDARKRLEDVRRELEKRLEDVARRTREDEKLERLRKAIKDILDKLEELLRKHLEDVERILRELEELLERHKRMLEKLLKDLEDLLRRRVEERELKKVLDDIREKVKKTIKEIDEVLEKITRENERTRKEIEEMLRTLRELIKRLLEETK

SEQ ID NO: 27770 - protein, 244 aa, Artificial Sequence; identical to SEQ ID NO: 27769
  Synthetic sequence.

SEQ ID NO: 27771 - protein, 239 aa, Artificial Sequence
  Synthetic sequence.
SEEDEVAKTLEDILRRLEELLREHHELHRRILEELEKLLRDHIKLHKDILDEATKSTDDLEKLADEVRKKLRESLKTLKKIVEDIERKLEESKRRLKRTVEEIRKKLKELLERIETRNLDERLLRALRELVRLLEEILRRLLELLEEDVRLLKEILRELERLLREDIKLLEEILELLKRRPDSKETLKRLKDRSKELNDRVRETLKRLAERSKRLNEKVEEDVRRAVEELRRLLEEIRK

SEQ ID NO: 27772 - protein, 239 aa, Artificial Sequence; identical to SEQ ID NO: 27771
  Synthetic sequence.

SEQ ID NO: 27773 - protein, 227 aa, Artificial Sequence
  Synthetic sequence.
DERKVIEDLVEVLRDLLRVIKEVLDRNVKLIKDLLRLNLKVAEELIRVLKELLDRLRRDKDLRELEERIKRVLEEHEDVIRRAAEKVEKVADDSRKVIEDISRKVEALSRRNLEMDTLAELAKEILKLIEDLLRDHKRKTDRLLEELRELTKRTARKLEKILEDIVRKTGETEELDRIRKELKRLLDELTKLHEDVRKKSEELVREAERTLEDVKRKLDELLERAKK

SEQ ID NO: 27774 - protein, 227 aa, Artificial Sequence; identical to SEQ ID NO: 27773
  Synthetic sequence.

SEQ ID NO: 27775 - protein, 244 aa, Artificial Sequence
  Synthetic sequence.
DEERELERLLEDVRRRHEELLRRLEKLLEDIRKLYEDVRRKLKRLLERVDRLVREILRRDKRDKVREVIKELLEVLRRVVERIEELIEESLRVDERVVEEIKKLIEEHLRVLEEAVDRIKKKKDDEETMREIIRELEEVNRRLDEEVKRLKRENDEVLRRVKEALKRLAEELREALKRLEERTGRDELIKELADIVKEILRLAEELAKELEKINRELDRVTRELIKDLLRISRELIKRLEDTTR

SEQ ID NO: 27776 - protein, 244 aa, Artificial Sequence; identical to SEQ ID NO: 27775
  Synthetic sequence.

SEQ ID NO: 27777 - protein, 238 aa, Artificial Sequence
  Synthetic sequence.
SDKELLDDTIRKMRKLHRDSVELLDDIRRKLEELLRKVRELLDRNVKKIRELIELRKKTDERELKKRVDDIERENEEALRRIAEEIKEIKKKIDRAVKEYKTELRKLKEKLKDALRRVSDEKVKEVIRRLLEALDRNAELNEDVLRRILEMLERILETIKEIIKKNIKSLRELLELIARGSRDSDLEDLIRRDIEELKKVIEKLEELVRRIEELLREAKERDKESLDRIEDELRKAKK

SEQ ID NO: 27778 - protein, 238 aa, Artificial Sequence; identical to SEQ ID NO: 27777
  Synthetic sequence.

SEQ ID NO: 27779 - protein, 238 aa, Artificial Sequence
  Synthetic sequence.
EEDDLLKANLDTLRELHKESEKLLRDIEETAKELHKKSEELLKRITDELDRLVKLSRKVDDKVLEELIRRIVREIEKMVEDYERELRDLVRKIEDAVRRYEKKVREIEKRNKEFLKKVTDEKVKEVIERNLKTIRENVELNKEILRRIIEVLRENVRLNREVAKELIRVAEEILKLLRAGSRDSDIKRILDDLRRRLEDALRRDRETLKRLKEEIERVKKEDRRSLERDKEELEKARK

SEQ ID NO: 27780 - protein, 238 aa, Artificial Sequence; identical to SEQ ID NO: 27779
  Synthetic sequence.

SEQ ID NO: 27781 - protein, 235 aa, Artificial Sequence
  Synthetic sequence.
SAAELILKAAKEAAEANREAAELALKAAEESARAAREAAELALKAAKEAAEAARRGAEDKDTALKLVDEAVRKAEEALRRANEKNRRAVRKAEEAVKRAAEKNRRAVEKAKEAAERGRADEKKKRRLEELAKRTEDAIKRILEELKKLAEDSEEIDRRALKALKELADEAREIAKANLDKDDLTRAADELLKKAKKLADDYKRAADRLLKEAEDLAREWKKLADKALEDAKRDAD

SEQ ID NO: 27782 - protein, 235 aa, Artificial Sequence; identical to SEQ ID NO: 27781
  Synthetic sequence.

SEQ ID NO: 27783 - protein, 235 aa, Artificial Sequence
  Synthetic sequence.
KAEEAAKEAARLAKEDADLAKKAAEDAAELHERHAKLLEDSARTAAELAKRLAEAATVDEAARLLKKAAEDYKKAADEAARLNREAAKEAEKAARDAAKLNREAAEDVKRAAKDRLREAVERAKEALKRSLDLAKEAVERSKEALKRSVELNARAVEIAKEALKEALRIAAERAERKEDLDRLAKIAKEAADALEELLERSKESAERAARALEKLLKEWADSAKKAADALEELDR

SEQ ID NO: 27784 - protein, 235 aa, Artificial Sequence; identical to SEQ ID NO: 27783
  Synthetic sequence.

SEQ ID NO: 27785 - protein, 237 aa, Artificial Sequence
  Synthetic sequence.
DELETLKKEAEDVLRELRDILRKLEDLSRKTIEDMRRIVEEVLKLNEDSIRELKRIIEELDSKDLMDTVEKVVKRNLEIAERVIERLLELVRRNADIARRVIEELLKVLERLADIVRKRIKSEVLREIKRVAEEVLKKVREVLKRHEDAIRKVLERVRDVAREHRRVVKEVLEDVKRAGGLTDEVVKKLEDVSRKSIDDLRKIIETLREVVERSIEEIERIIRDLERVIREIIEREK

SEQ ID NO: 27786 - protein, 237 aa, Artificial Sequence; identical to SEQ ID NO: 27785
  Synthetic sequence.

SEQ ID NO: 27787 - protein, 240 aa, Artificial Sequence
  Synthetic sequence.
SKIEELAKIAEEHAELNRRAARKNNEIAKEAAELWKRAAEKHVRIAERAADAIRKAAKSEAAKTALKLIKENAEDAKEAARRALELAKESAERNTRAAEEADKLSKDAARTAREARREDALKKAADKAAEASRRAVELNKKAAEDHHRANETAARLAERASRHLIEALERAVRAAARELEDEKALREAKELAERAARENREALKEAKELAKRNSEKAKESAKEHKKLAEDANKRAEEATR

SEQ ID NO: 27788 - protein, 240 aa, Artificial Sequence; identical to SEQ ID NO: 27787
  Synthetic sequence.

SEQ ID NO: 27789 - protein, 240 aa, Artificial Sequence
  Synthetic sequence.
DEEEVIEEILKTLEEINRRVLKLIKDILEKVKRVDDEIKTLVKEVLRENERVLREVREKAKVKDLVKELLKRVREVAKIHREIVRRHLEILERILEEVAKVVEEHIDALRRILELLERVIRDEEVVKEVRKLVEDVLRASREVLERVTRLAEELIRESKRVLDTSRKLIEEIEDRLRKVRSEKMLEDILRRLEEINRTSLRLVDEVSKKTREVLERILKLVKEVLDESRRVAKKVKDDLK

SEQ ID NO: 27790 - protein, 240 aa, Artificial Sequence; identical to SEQ ID NO: 27789
  Synthetic sequence.

SEQ ID NO: 27791 - protein, 229 aa, Artificial Sequence
  Synthetic sequence.
SAVDIAREAARRVIELLKRSAEAAEEAARRSIKLAKESADAAREAAKKVIEILKRAADEDRALKEIEDLARELRKASKEVLEEDERLARELEEISRRVLDEIRRLAKELEDKATKKKAEKAAREIERAAKEHLEVNKRAAKRSKDATERHLEANDEAAKRIRDAADEVRKRGEEDAARKAAEIAARAAKRSADTAKRWAEVAKEAAEESAKSAKKAAKIAEDAAREIEK

SEQ ID NO: 27792 - protein, 229 aa, Artificial Sequence; identical to SEQ ID NO: 27791
  Synthetic sequence.

SEQ ID NO: 27793 - protein, 231 aa, Artificial Sequence
  Synthetic sequence.
DLREAAKEAIDAAEEAARRTEEAAKENIRALEEAAKRTRDAVRRAIKAIEDAVRDAGSTDEAVKIVEDAARDALRASKESIDIVREAAKRSLDASRESIKIVEDAAKKAEDAARKAGRDASRAAELAKRAAEADKRAAEEDARLNEEAARADRRVAEELARLAEEVADAAKKADKREDLERIAREAAERAKELADRLEEIYRRAAEESKRLAEELKRIYKRAAEEAKKAAD

SEQ ID NO: 27794 - protein, 231 aa, Artificial Sequence; identical to SEQ ID NO: 27793
  Synthetic sequence.

SEQ ID NO: 27795 - protein, 242 aa, Artificial Sequence
  Synthetic sequence.
SKIEELMKLVEKIIRKTLDLVRKHAEVSKEVLKEYIRISKEHLDVSKRVAEELKKEIEVKRLLEEVERVAKKVVETNKRNIETVERVLEDIKRTNTELLKRIEDVLREAVRVAEVLRRGDSDKEEVVRRIKELLKELLKVIREVVEKDKRLLDELLKSNADVVRTDEELLRRLLRVVERDVERKEDLDRIRDTLRRVIERSKRIHDRLREMLEEVKRRSEEIVERIERELRDVARKLEETLR

SEQ ID NO: 27796 - protein, 242 aa, Artificial Sequence; identical to SEQ ID NO: 27795
  Synthetic sequence.

SEQ ID NO: 27797 - protein, 243 aa, Artificial Sequence
  Synthetic sequence.
SLTEELRRVVKEIEEVVRRDVRTLEEVVKKITEVVRRDDKSLREVVKRNEELVRLLARGDRRDEDVLRAVAKSNKELLDSSREVLKTVADLLRRLLESSKRVADRVEELARRLLKMVKDSGKDDRKLREKLKKILREYRERLKEVAKKIRDALKRYEDILREIEKKNRDVLKRAEELRSKDTSEKDRREILRELVELTERSVEEIARVNKELVDIVRELVKELKRLNERLVELVKRLVEETAT

SEQ ID NO: 27798 - protein, 243 aa, Artificial Sequence; identical to SEQ ID NO: 27797
  Synthetic sequence.

SEQ ID NO: 27799 - protein, 241 aa, Artificial Sequence
  Synthetic sequence.
RAIETLVDVVREAIEINKRLVDRNVESNKELAKLNRDLVRRNRESNTELADLVRRDKDVDRLREEAKRVLEENKRLLDELRERHERVLKRNEDLLREVERLHTRILRDLREIVRRDNSRKEVLERLERVVRDILRSLKEVLDENAEVVKRILKSLEDALRENERVVREVLELLKRVRDQDREEELKRVVDEIVELLKRVLETTEKVVRDNVRLLEKALRSSKKVLDENVKKLEDVLRDLKR

SEQ ID NO: 27800 - protein, 241 aa, Artificial Sequence; identical to SEQ ID NO: 27799
  Synthetic sequence.

SEQ ID NO: 27801 - protein, 241 aa, Artificial Sequence
  Synthetic sequence.
SAAEALAKLAKENAELNRELAERNARSNKELAELNEEAARRNAKSNKELAELARRERDVDELRRRAEEALRRNKELLDKVRRDHERALRRNKKLAKEAEERHKKSLEDAKRIAKRDKAREEALRSAEEAVRRALKSLKDALRSNEEAVRRALKSLKEAADENEKAVKEALDLARRARDDDTEEELKRAIEEAAKLLKRAADETRRAAKENAEALEKAARESKEAAKDNAEALKKAAEEAKK

SEQ ID NO: 27802 - protein, 241 aa, Artificial Sequence; identical to SEQ ID NO: 27801
  Synthetic sequence.

SEQ ID NO: 27803 - protein, 232 aa, Artificial Sequence
  Synthetic sequence.
TEEEVVEDVKRVLDESHDDLRRLIETLTRVLRESLKRIKEALEELERVLKKLLDLLEGGRDKREVLDEIRKVLERLREVIEELLRINKEVLRELERVIRELLKKNEDLARRVRRDVKSRLLEVLERLARESLELNRRILEELRKLVEKSLRAVEKILKRLEEIVRKLLKLVEDNKPREEVKRVLEEARDELRRLLEEYKKIIEELERELERLLREHREVIRRIKEEIDKSSK

SEQ ID NO: 27804 - protein, 232 aa, Artificial Sequence; identical to SEQ ID NO: 27803
  Synthetic sequence.

SEQ ID NO: 27805 - protein, 234 aa, Artificial Sequence
  Synthetic sequence.
SEVERAVEDVKRALEENVRLSKELVDRVTKMAEDNVKLTKDIVDKVRRILEELVEVIERGGSDDTRRELIDKARRLLRKLRDELKESLDDARRLLEDIKRLIEESVKRLRDLLEKIRREKSLPEDLLRLLREVLEELKKINDELLDAVRRVLENSARVLETLLKLIEDVLRELERVTDKDEVRKIVRELVEEAKKVVEYDTENAKRVVEELKRVVKRDADVVRKLVELLDRKAR

SEQ ID NO: 27806 - protein, 234 aa, Artificial Sequence; identical to SEQ ID NO: 27805
  Synthetic sequence.

SEQ ID NO: 27807 - protein, 235 aa, Artificial Sequence
  Synthetic sequence.
SELEEAVKRVRDALRENLDSIRRLVEKIRRVLEEHNKLSKELVDRIEEVLRRTVEAVKKDKPEEDLRRDLERVLEELTRLVDEVRKTNERALTELEKLVRDDKRKLEEVLRELRERLVKIEELLRRLEEVIRRSLRSLEELLKLLERVSRELVEVLRELLELLRKVVKRLLDLLRKGSDKRDVARVVRELIELVKRVLERDKRIVDELVKLVDEVLKRNKEIVDELVRLVDEARR

SEQ ID NO: 27808 - protein, 235 aa, Artificial Sequence; identical to SEQ ID NO: 27807
  Synthetic sequence.

SEQ ID NO: 27809 - protein, 238 aa, Artificial Sequence
  Synthetic sequence.
SELEDLIRLLREVIKRLEESVKELVDIVEEAIERLRKIVKELIDLSRKVIDELLELGVEERVIKKAKEASEEALRKLEDVIRKLKKILEDVLKKLKESIDELLREVDELLKRPQDKEVLREILERLRELLRRHTKVLREVIKEIADALEEVLRVIEEILDLHRRLLDEIRKVLERAGLPEELLDRIRRLIEESIKKLARIADRLRKLIEDLRRLLEELLRRNEELIERLERMLDEKAR

SEQ ID NO: 27810 - protein, 238 aa, Artificial Sequence; identical to SEQ ID NO: 27809
  Synthetic sequence.

SEQ ID NO: 27811 - protein, 238 aa, Artificial Sequence
  Synthetic sequence.
SEKEEAAKAAEEAAEIAERADEKAARSSKEAAKIAEKADKEAAESTRKALDDARRALEEAPADTRARDLARKLAREAEESLKEHKKISEELKKRLDESLKEHREISERLKKELKELREADRDLDELARELERLAKEHADSLREHARRSRELAEEHVKSLKRHAEESEKLAERAAREASDEDAARRAEKAARENADSIRRAAEKSRKAAEDNARSIEKAARESEEAAERAARILKRAKD

SEQ ID NO: 27812 - protein, 238 aa, Artificial Sequence; identical to SEQ ID NO: 27811
  Synthetic sequence.

SEQ ID NO: 27813 - protein, 229 aa, Artificial Sequence
  Synthetic sequence.
KEVEDVVEKLRELIDRALDRNRKVVEEVRDVVRRALEENRKVVEEVRKVIKEILDRVDDETVRTVVELLERLLDEHLRIVEEIVRLLTDLLRRHLRVVEDIVRLLRELLKILTELRRREELEKIARRLLETIDRLIRTLERLYDEAREEIEKLIRELERLYREVDKRIKEAGLPKEATDLIRELIERLRKVLEKSRRLIDRLVKLSRDVLEETKRLVEELIREVKRAET

SEQ ID NO: 27814 - protein, 229 aa, Artificial Sequence; identical to SEQ ID NO: 27813
  Synthetic sequence.

SEQ ID NO: 27815 - protein, 240 aa, Artificial Sequence
  Synthetic sequence.
KLEEIVKKLEDLNKKAVEILRRVLEEHEKLVEKVKKVLRDVLRLLEKVVREVIETLKKKDTDEKVREALKELEEVVRKIKEEVEKVLKRLEEVSKRLKDEVRRVLKESEDVAKKIRRDVRRVRSKDAAKRATDLLKETLRILEEAIRRIVKVIEDSLEILREAVERIVRLLEELLKILARIGLDEEVLRKLKEIIKELKDRLKKLLDDYERIIDELRRELERVLREYEKILEDLRKELED

SEQ ID NO: 27816 - protein, 240 aa, Artificial Sequence; identical to SEQ ID NO: 27815
  Synthetic sequence.

SEQ ID NO: 27817 - protein, 237 aa, Artificial Sequence
  Synthetic sequence.
SELEEAAKALERIAKKAAKAARDWAEEDRRLAEEAIRAAEEWAKENKKLADELAKAAKDNRDEKDLRRILEEVKKRSEKLAREAKKVLKRIADDSKRLAEEAEEVLKRAADELKKIADELRKRGAGAKEAEDVAKKALDAAREAVEEAKDVNREALKLAEEAVREAERVNREAARLAEEARSDEAVRALEEAAKRSEDAARKAAKLARDAAEKSRRAAEKAIRLLEEAAKEAKDAAR

SEQ ID NO: 27818 - protein, 237 aa, Artificial Sequence; identical to SEQ ID NO: 27817
  Synthetic sequence.

SEQ ID NO: 27819 - protein, 239 aa, Artificial Sequence
  Synthetic sequence.
KEAEEIAEAVKRLAEASAKTAEELARAVRKAAEDLVKLAKEHADALRTAADRIAKLIEAEEAARKALEAAKKAIEDNERAAKEALEAAKRAIDIIREAAERSKKAAEEAIDIIRRAKEGREDIERALRELLKANRKAVEDAKRALKELADAAREAVKKAKETAERLIEAIKRAADEAPASEDIRREIKRIADELKEITKRLEDEVEKIIRRLEKIAKEAEDRHRKLAEELRRIAEEAKR

SEQ ID NO: 27820 - protein, 239 aa, Artificial Sequence; identical to SEQ ID NO: 27819
  Synthetic sequence.

SEQ ID NO: 27821 - protein, 241 aa, Artificial Sequence
  Synthetic sequence.
SVDEALEELVRRLLEVLKTVLERTKELSRDDLRVVKEVLRIIEELVKRLLKVIRDGLDDADRVLEEVERVIREAKREVKRWEEVVRKVVEDSRRLIERVLREVEEVIKEAKRLLDERKLGGRREVIEELLRLLREIVRHHKEVSDEHLKLSAELVKRILDVVEETLRLATEIVRRIKEEGNSEDVRRDIERLLEELKRRVERLLEDIERLLRELEKLNEDVLRENKKLLEDLERRVRERKK

SEQ ID NO: 27822 - protein, 241 aa, Artificial Sequence; identical to SEQ ID NO: 27821
  Synthetic sequence.

SEQ ID NO: 27823 - protein, 237 aa, Artificial Sequence
  Synthetic sequence.
DEERIVREIVKIIEEAVKELVRLVREDIELVKDVVRRHNRLNEEIVKLWKELVDEVLKSRDAEELRRILERIKRLHEENSRRLKEVVERWVKLLKESLEKLEDVARKAREKLKTVLDKPRGEELIKDLARVVEEVLRLLEEVIKTHAEINKRALELLKEVSKHAADIVREALKLAAEVVDDKDLLRRAEEEIRRLLKENEDILKRVEEEVKKSNEELRRILDRVRRELEKALKRLRD

SEQ ID NO: 27824 - protein, 237 aa, Artificial Sequence; identical to SEQ ID NO: 27823
  Synthetic sequence.

SEQ ID NO: 27825 - protein, 243 aa, Artificial Sequence
  Synthetic sequence.
SKEEEVKRLIDELKRVNERVNKTIKELVKLLEESHEEVLKEIERLIREVLRVIKEVIEAVDKDRKLERLEEKVRKVVEELKRLLDRSRRILRELIKTIDRLLTEHRKEVDKVVRELRELLRAGADAKELLKILEDLLRKSKEVVKRILDIIRKLLEDSRKVVEELVKLIADLLEEILRALKEGRKEALDKLVDAARRVLEAVRDVLRKDERSVERVLDEVRRVAEELERTHREVVKRVEDAAR

SEQ ID NO: 27826 - protein, 243 aa, Artificial Sequence; identical to SEQ ID NO: 27825
  Synthetic sequence.

SEQ ID NO: 27827 - protein, 243 aa, Artificial Sequence
  Synthetic sequence.
DKEKTVADLIEKVERSHERVLKRLAELIEELKRVNERVNREIERLIRELEEVIDRVIKAVDPDKKLEELEKKVREVSRRLEEILRDHERLVRKVVEELKELLDRSRRLVREVVRKLKKLLEDGSDAKDLLRIIADLLRLSDEVVKELLKLNEKLLKLSEEVVREILKLVKDLLEDLKRALEEGRREMLEELVRVARRVLEAIKTVADELRKRHEEVSREIERVAEEDKRTVEEVLKRIEDAAR

SEQ ID NO: 27828 - protein, 243 aa, Artificial Sequence; identical to SEQ ID NO: 27827
  Synthetic sequence.

SEQ ID NO: 27829 - protein, 233 aa, Artificial Sequence
  Synthetic sequence.
KDEEIIKRLEDLLKENVDRLREILERVERTHRKVIEELKRILEELEEILRRVIEKLRRKNTLDDKLIKKIEEVLKRLLEVLDELLKRIEKASRESLDSTRRLLDSHEKVLREALRVLREIDGERVLEEVKRVVEDVIREWEEALERNKRVVEKLIKTVEDILKRIDEVVRRLIEAVESRDVERLLKELKRIVEEILRLVRELVTRDIDALRRLLESVRRLVDKLIRIVEERRR

SEQ ID NO: 27830 - protein, 233 aa, Artificial Sequence; identical to SEQ ID NO: 27829
  Synthetic sequence.

SEQ ID NO: 27831 - protein, 242 aa, Artificial Sequence
  Synthetic sequence.
SDKDRLLEEIKRLIDESRRKAEEILKRSTELLEDSKRDLREILRRSEKILDELLDLIRRNELPEKDLLRELEEVVKENLELAERLSKKLEDIVRENRDLLEKLSRLLVKILKEIVKMVEEAGLDEELTKLIEEVLEDNKRAVKELEEKLKESLKRNKRVVDDLRDKLRKSLEELKDVVTRLRSKEIKDALRRVLEKHKKVLREAIKKHEESLEEHRKVLEEIIELHKRSLKKLEDVIDTVRK

SEQ ID NO: 27832 - protein, 242 aa, Artificial Sequence; identical to SEQ ID NO: 27831
  Synthetic sequence.

SEQ ID NO: 27833 - protein, 236 aa, Artificial Sequence
  Synthetic sequence.
SKEELIKELKETVKRIIKLLEELSKKMEEIIKRIAELLRELSKKLVDIIKRIIELLRREGAEEEIVKRLDDVAKKNNEAVREIVEELRRIVKENREAVERVAKRLRDVLREVDRVVKELTGEDLKRELDRVLKLLLRILEDAVRELKRSLDEVRKVLKRVVEMHRTSLKELEDILRKVDVREEILKEIKRLLDESKERLDRVLREIEELLRRYEEEVRRVLEEIKKILDELRERIR

SEQ ID NO: 27834 - protein, 236 aa, Artificial Sequence; identical to SEQ ID NO: 27833
  Synthetic sequence.

SEQ ID NO: 27835 - protein, 234 aa, Artificial Sequence
  Synthetic sequence.
DTERAADEARRRLEKLARDHKEKLKKAAEDLRRLLEEAERAHRKIEKELEELTRKVRDLERAAEELLKLAEEAAKASEEAARRLLEIAERIAKSNEDAARELLKIAEDLARRAEKEEAARRLLEAAKRAAEDSRESAKDLLRAAREAAEKIKKSARELLKAAEDAAKTIRDAKDREDAERALKEAADRAREALRRNLRALREAVREAEEAIEKDARAIDEALKKAREAIEEAER

SEQ ID NO: 27836 - protein, 234 aa, Artificial Sequence; identical to SEQ ID NO: 27835
  Synthetic sequence.

SEQ ID NO: 27837 - protein, 238 aa, Artificial Sequence
  Synthetic sequence.
SKVEELAERAARSHKELADAIRELAREAAESHKEAAEVVKRLADEAARAAKEVAKAIEDETAAKILEEAAREALRAAEEAIKLLEDSAREVLRLAEEAIRLNEEAAKRVLDAAREAAELEDKEAVDRALKRALKISRDALEEAKKIAKEALELSKRAADEAARIAKEALETAEDALRKAVRDRKVLEDAKKILEDLRKKAEDALRKHKKILDELEEKAKKAAEKHERILRKLDEDAKR

SEQ ID NO: 27838 - protein, 238 aa, Artificial Sequence; identical to SEQ ID NO: 27837
  Synthetic sequence.

SEQ ID NO: 27839 - protein, 242 aa, Artificial Sequence
  Synthetic sequence.
SEDEEVLKDIKRLLEEVKKTLEEVAKRHEKALREIEERVKEIVKEHEDLLKEVEDKARSNTIDEKDLVEMLRRIHERTVKLIDELVKTLLRLNEETVKALEDLVRKLLKILKDVLERVKDKRVLDLIRELIKKVKDDADKLLELLREVIKRSADIAKEIRDLLDKVIKDSERILDEARRLKNKEDLDRLLKEVLDISRKVLEEVLKIIKRVLEISKRVLEEILRRIEKVLRDIDRVLKKLRE

SEQ ID NO: 27840 - protein, 242 aa, Artificial Sequence; identical to SEQ ID NO: 27839
  Synthetic sequence.

SEQ ID NO: 27841 - protein, 238 aa, Artificial Sequence
  Synthetic sequence.
SREEDLARKIAEAVKELLDADRRLLREIEKLAEELLRINEELLRRLEELARELLEAVDDERVVDELRRVAERIRRVVERATRELKRVLDEIRRISEKSIRDLEKVLEEIRKIIDDVSRLERKEEVLRVIKEILERLEKVLEEVRDVNRKILERLKEVLEEWERINRELLRIAREVLEKVKVEERLLRKLEEILRRLKDESRKVLKKVKEILDRLKRETEEILDKVRKILERLEEEVRR

SEQ ID NO: 27842 - protein, 238 aa, Artificial Sequence; identical to SEQ ID NO: 27841
  Synthetic sequence.

SEQ ID NO: 27843 - protein, 238 aa, Artificial Sequence
  Synthetic sequence.
SAEEAAEEALRRAAEAAKESIKAAREALEEVRKAAEKSIRAAEKALRDVKKAAEEAKSAKDEETAKRAAEKALKALKEAIEINAKAAEEALRALREANRINREAAEKALKAAKEALDRANLPDKKLKTAEDLLRKAKKEVEDANRRSEKLIREAEERVRRALKRSKELLKKLEDDARRERAIEEAAKKAIDLARDHARLVKKIAKDLIDLAKEHADLVREIAKRIIEAAKRIAEIVRK

SEQ ID NO: 27844 - protein, 238 aa, Artificial Sequence; identical to SEQ ID NO: 27843
  Synthetic sequence.

SEQ ID NO: 27845 - protein, 230 aa, Artificial Sequence
  Synthetic sequence.
SDEELLEEIKKILDEVLKKNADAVRSLEKVLDKVLEDNARAVEELKTVLDKVLRDLERRGVGDEEIRELLERLKRELDEALKELAKEYEKLKETLRRVLEELADLYREAKERADRDPDKRKIVEELAKLLDRDVKLNRDLARRVLRLLERDLRVNKELVDRAREVLDEILKRNEDKDVEEVVKEVRDVLRESVDKVRRVIEEVKRVLDRSSEEVERAVEEVKRVLDKVRK

SEQ ID NO: 27846 - protein, 230 aa, Artificial Sequence; identical to SEQ ID NO: 27845
  Synthetic sequence.

SEQ ID NO: 27847 - protein, 239 aa, Artificial Sequence
  Synthetic sequence.
SDEELLERVERLLRELLDTNRRMLEEVEKELRRLLETNKKTLDDVRRLLKELLDVLETRGVKDEKRLRDIRRRLEEVVRRLDKLHRDIAEDLKRVKERLDRLHERIKRRLEEVVKELRDLKDRGVDERKVLERAAEVLRELLELLRESLEEIERIIRRLLELHKRSTEEAARALEELLRGLEGSDDLRELKKRIEDLLKEDKERLEKIARDIERDLERYARDLKRLEDELREDIERARR

SEQ ID NO: 27848 - protein, 239 aa, Artificial Sequence; identical to SEQ ID NO: 27847
  Synthetic sequence.

SEQ ID NO: 27849 - protein, 239 aa, Artificial Sequence; identical to SEQ ID NO: 27847
  Synthetic sequence.

SEQ ID NO: 27850 - protein, 239 aa, Artificial Sequence; identical to SEQ ID NO: 27847
  Synthetic sequence.

SEQ ID NO: 27851 - protein, 238 aa, Artificial Sequence
  Synthetic sequence.
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 27852 - protein, 238 aa, Artificial Sequence; identical to SEQ ID NO: 27851
  Synthetic sequence.

SEQ ID NO: 27853 - protein, 238 aa, Artificial Sequence; identical to SEQ ID NO: 27851
  Synthetic sequence.

SEQ ID NO: 27854 - protein, 238 aa, Artificial Sequence; identical to SEQ ID NO: 27851
  Synthetic sequence.

SEQ ID NO: 27855 - protein, 245 aa, Artificial Sequence
  Synthetic sequence.
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDLTETKKELEKRHEDLRRELEKLLRDYKRELEEIERALEEIEKTLKRRADETRR

SEQ ID NO: 27856 - protein, 245 aa, Artificial Sequence; identical to SEQ ID NO: 27855
  Synthetic sequence.

SEQ ID NO: 27857 - protein, 245 aa, Artificial Sequence; identical to SEQ ID NO: 27855
  Synthetic sequence.

SEQ ID NO: 27858 - protein, 245 aa, Artificial Sequence; identical to SEQ ID NO: 27855
  Synthetic sequence.

SEQ ID NO: 27859 - protein, 234 aa, Artificial Sequence
  Synthetic sequence.
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDKELEKLLEDLEREIRRLAKRLKELSDRLEEKIRKIKRELDDLSARLREKIERTRK

SEQ ID NO: 27860 - protein, 234 aa, Artificial Sequence; identical to SEQ ID NO: 27859
  Synthetic sequence.

SEQ ID NO: 27861 - protein, 234 aa, Artificial Sequence; identical to SEQ ID NO: 27859
  Synthetic sequence.

SEQ ID NO: 27862 - protein, 234 aa, Artificial Sequence; identical to SEQ ID NO: 27859
  Synthetic sequence.

SEQ ID NO: 27863 - protein, 238 aa, Artificial Sequence
  Synthetic sequence.
SKEDKARELEKRLRDNLKKLEEVVRELAEVLKRNLEKLRRLAEELLRALKRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRDIRRELKELEERARKILRDDERDLRALEKRIRDIIREDREELERLKERARK

SEQ ID NO: 27864 - protein, 238 aa, Artificial Sequence; identical to SEQ ID NO: 27863
  Synthetic sequence.

SEQ ID NO: 27865 - protein, 238 aa, Artificial Sequence; identical to SEQ ID NO: 27863
  Synthetic sequence.

SEQ ID NO: 27866 - protein, 238 aa, Artificial Sequence; identical to SEQ ID NO: 27863
  Synthetic sequence.

SEQ ID NO: 27867 - protein, 243 aa, Artificial Sequence
  Synthetic sequence.
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIKRLKEELERRHRRLEEEVERVARELEKAHRDLERDIRRVAEELKKLLKKLRDDRR

SEQ ID NO: 27868 - protein, 243 aa, Artificial Sequence; identical to SEQ ID NO: 27867
  Synthetic sequence.

SEQ ID NO: 27869 - protein, 243 aa, Artificial Sequence; identical to SEQ ID NO: 27867
  Synthetic sequence.

SEQ ID NO: 27870 - protein, 243 aa, Artificial Sequence; identical to SEQ ID NO: 27867
  Synthetic sequence.

SEQ ID NO: 27871 - protein, 236 aa, Artificial Sequence
  Synthetic sequence.
SAEETVERLLEEARKRHEEIIKKAKELLDRAREEHERIIREAEKLLEEIKKRVDELVRDGQPAEEVLRDLERVVEEILEVLRRLLDANRRVVDDVLRVLEELLRVNEEVNRRIIETIGLPEEVVEELKEENKRLRDRLDKLVKDLKKTNKEIEDKLRKLAEELKEELERIADRIRKTGTDRKTLLREIEKLLKTLEDILRDLLRLVEKTLKELEEILKDLVDKARENLKRLRERIR

SEQ ID NO: 27872 - protein, 236 aa, Artificial Sequence; identical to SEQ ID NO: 27871
  Synthetic sequence.

SEQ ID NO: 27873 - protein, 236 aa, Artificial Sequence; identical to SEQ ID NO: 27871
  Synthetic sequence.

SEQ ID NO: 27874 - protein, 236 aa, Artificial Sequence; identical to SEQ ID NO: 27871
  Synthetic sequence.

SEQ ID NO: 27875 - protein, 239 aa, Artificial Sequence
  Synthetic sequence.
SEKEELKRLLDKLLKELKRLSDELKATIDKILKILKEVSEEVKRTADELLDAIRRGGVDEEVLREIKREIEEIEKKLRKVNKEIEDEIREIKKKLDEVDDKITKEVEKIKEALDKGGVDAKEVIKALKEILKEHADVFEDVLRRLKEIIKRHRDVVKEVLEELRKILEKVAEVLKRQGRSEDELRKVEEDLKRLEDKLKKLLEDYEKKVRELEETLDDLLRKYEETLRRLEKELEEAER

SEQ ID NO: 27876 - protein, 239 aa, Artificial Sequence; identical to SEQ ID NO: 27875
  Synthetic sequence.

SEQ ID NO: 27877 - protein, 239 aa, Artificial Sequence; identical to SEQ ID NO: 27875
  Synthetic sequence.

SEQ ID NO: 27878 - protein, 239 aa, Artificial Sequence; identical to SEQ ID NO: 27875
  Synthetic sequence.

SEQ ID NO: 27879 - protein, 244 aa, Artificial Sequence
  Synthetic sequence.
SDAERLVKKIADSLRAYEDLLRKLVERIRDLLRAYEEELRKLLTEIEKTLEDVRDVLRRGNVDERAKEVAKRLVEAVKSLIEIVKRILEKTARVVKKLEDLLRRAAELNRDVVEKILEIIKRGGPEDDFRRIVRRLEELHREVEDAVRKLVEDLKRLHREVVEELADIIRKLDKLLAEVERDIDLGDLLEALRRLVERLKRLIERVLKLNRELVKKLLELLEEALRANRRLVEDILKIADEARK

SEQ ID NO: 27880 - protein, 244 aa, Artificial Sequence; identical to SEQ ID NO: 27879
  Synthetic sequence.

SEQ ID NO: 27881 - protein, 244 aa, Artificial Sequence; identical to SEQ ID NO: 27879
  Synthetic sequence.

SEQ ID NO: 27882 - protein, 244 aa, Artificial Sequence; identical to SEQ ID NO: 27879
  Synthetic sequence.

SEQ ID NO: 27883 - protein, 247 aa, Artificial Sequence
  Synthetic sequence.
SATERVLDLARDLIRILLEIHKRALKLIAELVSKLLKIHEDVLKLSEELVEELLEIVKRGLPREDLLRALKELLEKIEDVVRDIERRHRDLLREAEEVVEKLKREHEEVKERIERAVKKLAEDGVDKDKLKELVDVLEEILRLSKTTLEELVKALRDVIRASLEALKENLRILRKIIRELEGLEGVDEDTLRRVLERIREEVERVKEKHRRLLEELKKLLEELRARSADLLEDIKRKVRELEEKTRR

SEQ ID NO: 27884 - protein, 247 aa, Artificial Sequence; identical to SEQ ID NO: 27883
  Synthetic sequence.

SEQ ID NO: 27885 - protein, 247 aa, Artificial Sequence; identical to SEQ ID NO: 27883
  Synthetic sequence.

SEQ ID NO: 27886 - protein, 247 aa, Artificial Sequence; identical to SEQ ID NO: 27883
  Synthetic sequence.

SEQ ID NO: 27887 - protein, 244 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 27888 - protein, 244 aa, Artificial Sequence; identical to SEQ ID NO: 27887
  Synthetic sequence.

SEQ ID NO: 27889 - protein, 244 aa, Artificial Sequence; identical to SEQ ID NO: 27887
  Synthetic sequence.

SEQ ID NO: 27890 - protein, 244 aa, Artificial Sequence; identical to SEQ ID NO: 27887
  Synthetic sequence.

SEQ ID NO: 27891 - protein, 250 aa, Artificial Sequence
  Synthetic sequence.
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLEEKERRIRTRYEELRRRLRKRVKDYEDKLREIEKKVRRDAERIEEELERAKK

SEQ ID NO: 27892 - protein, 250 aa, Artificial Sequence; identical to SEQ ID NO: 27891
  Synthetic sequence.

SEQ ID NO: 27893 - protein, 250 aa, Artificial Sequence; identical to SEQ ID NO: 27891
  Synthetic sequence.

SEQ ID NO: 27894 - protein, 250 aa, Artificial Sequence; identical to SEQ ID NO: 27891
  Synthetic sequence.

SEQ ID NO: 27895 - protein, 247 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRNLEDVRRVIEDVKRKSARILEEARRLIEEVERELEKIRK

SEQ ID NO: 27896 - protein, 247 aa, Artificial Sequence; identical to SEQ ID NO: 27895
  Synthetic sequence.

SEQ ID NO: 27897 - protein, 247 aa, Artificial Sequence; identical to SEQ ID NO: 27895
  Synthetic sequence.

SEQ ID NO: 27898 - protein, 247 aa, Artificial Sequence; identical to SEQ ID NO: 27895
  Synthetic sequence.

SEQ ID NO: 27899 - protein, 236 aa, Artificial Sequence
  Synthetic sequence.
SRAERIKRALEEHIRKLKEITDEVRKTNEELLELTRRILEEAKKANEELVKKIREAGDKSKELEEEIRKLIEESERIVEELEERSKELLKRSREEVEEWRRRSEELLRRLEAILRGVKDEKELVERAVKILRDDSRIAKEILRRNLRLIEENLERLKEIIERNLDLLRRLLELLKRAGVDEEALKELEEKLDRYRRKLEDLLRKYAKKLEDYKRKVKKLEEENEELLKRIEKEMEK

SEQ ID NO: 27900 - protein, 236 aa, Artificial Sequence; identical to SEQ ID NO: 27899
  Synthetic sequence.

SEQ ID NO: 27901 - protein, 236 aa, Artificial Sequence; identical to SEQ ID NO: 27899
  Synthetic sequence.

SEQ ID NO: 27902 - protein, 236 aa, Artificial Sequence; identical to SEQ ID NO: 27899
  Synthetic sequence.

SEQ ID NO: 27903 - protein, 238 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 27904 - protein, 238 aa, Artificial Sequence; identical to SEQ ID NO: 27903
  Synthetic sequence.

SEQ ID NO: 27905 - protein, 238 aa, Artificial Sequence; identical to SEQ ID NO: 27903
  Synthetic sequence.

SEQ ID NO: 27906 - protein, 238 aa, Artificial Sequence; identical to SEQ ID NO: 27903
  Synthetic sequence.

SEQ ID NO: 27907 - protein, 248 aa, Artificial Sequence
  Synthetic sequence.
SAEEELEKLVRKVEEDLKRLEEESERIKKEIKDTLRAIRKRSEDLKRKVKELLRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRKLVELVDEVLKVHEESLRKLLTLAAKVLEVLRKITK

SEQ ID NO: 27908 - protein, 248 aa, Artificial Sequence; identical to SEQ ID NO: 27907
  Synthetic sequence.

SEQ ID NO: 27909 - protein, 248 aa, Artificial Sequence; identical to SEQ ID NO: 27907
  Synthetic sequence.

SEQ ID NO: 27910 - protein, 248 aa, Artificial Sequence; identical to SEQ ID NO: 27907
  Synthetic sequence.

SEQ ID NO: 27911 - protein, 244 aa, Artificial Sequence
  Synthetic sequence.
DDERRKLEDLERMVEELKRKSDKLLKEIREEVERLERETRKLLEELKAKVDELREDLRRNPGDRVLEKLVKLLEDILDKVRKLLKENLDLLKRLLDIIEKLLRDNVRLLEELLRIVRELGKSGDEEKLTRKLEKALKEVRDAARETRERLKEAKKEVKTVADRNRARLEELEEEVKRVLDEIRKEGGPSEDLEKAERLVKDILRLNEEHTAELEDVVRDLLRALEKHTRDLEKLVKDALDKVKT

SEQ ID NO: 27912 - protein, 244 aa, Artificial Sequence; identical to SEQ ID NO: 27911
  Synthetic sequence.

SEQ ID NO: 27913 - protein, 244 aa, Artificial Sequence; identical to SEQ ID NO: 27911
  Synthetic sequence.

SEQ ID NO: 27914 - protein, 244 aa, Artificial Sequence; identical to SEQ ID NO: 27911
  Synthetic sequence.

SEQ ID NO: 27915 - protein, 244 aa, Artificial Sequence
  Synthetic sequence.
SKIDEALKKLAKILEDAIKLNKELNDTTAEILKEIIKLNAEVLEKIRRILKELVDLILKGLKDDEEAKKELKKVLEEVARRLEEIKKETDRIVKEVEELNERNDREVKRAAEEVRRLLEEIKRSDRDEKELIKALKEIVDRIREAHRRSVEELSEVVKRILDALKDTLRKLEDVVRKLLELARRIAGDTEELRRVVEKVRKELEDDKERYKRLEEEVRRLLEEMKRRSEDLERKVEEILRRLTE

SEQ ID NO: 27916 - protein, 244 aa, Artificial Sequence; identical to SEQ ID NO: 27915
  Synthetic sequence.

SEQ ID NO: 27917 - protein, 244 aa, Artificial Sequence; identical to SEQ ID NO: 27915
  Synthetic sequence.

SEQ ID NO: 27918 - protein, 244 aa, Artificial Sequence; identical to SEQ ID NO: 27915
  Synthetic sequence.

SEQ ID NO: 27919 - protein, 239 aa, Artificial Sequence
  Synthetic sequence.
DEEEKIREDLERTLREYERELRRAKEELKETLKRYEEELREVKEDLDRTLEEVDDLLRRGSLSDREAIRILRELLKKLEEIIRRSKEVLDKLIKDLEDISRRSIEVLEELVKKVRKDGLPEEVLRRIKDLIRRLRERNKEILDRIRKLIEELVERNKRALDRLRKLIKELEERVRRTDDKETLARDLKEALKTLIKLIREILEDNLRVLRRIIELIETLLEDNRRVLEEIIKLIEEATT

SEQ ID NO: 27920 - protein, 239 aa, Artificial Sequence; identical to SEQ ID NO: 27919
  Synthetic sequence.

SEQ ID NO: 27921 - protein, 239 aa, Artificial Sequence; identical to SEQ ID NO: 27919
  Synthetic sequence.

SEQ ID NO: 27922 - protein, 239 aa, Artificial Sequence; identical to SEQ ID NO: 27919
  Synthetic sequence.

SEQ ID NO: 27923 - protein, 244 aa, Artificial Sequence
  Synthetic sequence.
DELEKVERLLEEIEKIIEDLIRRVEELVRRILEFNKTTLKRNEELVRELEKLVKETTGGTEELKKIVEKLEKLHREVKKKSDDLVKRAEELLKEVKERLKEIVKTIREELRKVKESGGDREELLKLLAEILDKLLKLLKRIIEELLRILKELIKASKESLDDLKRINEELLRDIEDLIRKGIKESKEVVRKLEEDLRRVRERSKKLVREHEKFLEDLEETIKEEKRRVDEELKRIKEEIKETRR

SEQ ID NO: 27924 - protein, 244 aa, Artificial Sequence; identical to SEQ ID NO: 27923
  Synthetic sequence.

SEQ ID NO: 27925 - protein, 244 aa, Artificial Sequence; identical to SEQ ID NO: 27923
  Synthetic sequence.

SEQ ID NO: 27926 - protein, 244 aa, Artificial Sequence; identical to SEQ ID NO: 27923
  Synthetic sequence.

SEQ ID NO: 27927 - protein, 242 aa, Artificial Sequence
  Synthetic sequence.
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLREALKKLEDDLRKIERDAEREYKKLKDELEELTERYRREIRKLKEELKADRK

SEQ ID NO: 27928 - protein, 242 aa, Artificial Sequence; identical to SEQ ID NO: 27927
  Synthetic sequence.

SEQ ID NO: 27929 - protein, 242 aa, Artificial Sequence; identical to SEQ ID NO: 27927
  Synthetic sequence.

SEQ ID NO: 27930 - protein, 242 aa, Artificial Sequence; identical to SEQ ID NO: 27927
  Synthetic sequence.

SEQ ID NO: 27931 - protein, 247 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRETHKKIEKELREALKRVRDRST

SEQ ID NO: 27932 - protein, 247 aa, Artificial Sequence; identical to SEQ ID NO: 27931
  Synthetic sequence.

SEQ ID NO: 27933 - protein, 247 aa, Artificial Sequence; identical to SEQ ID NO: 27931
  Synthetic sequence.

SEQ ID NO: 27934 - protein, 247 aa, Artificial Sequence; identical to SEQ ID NO: 27931
  Synthetic sequence.

SEQ ID NO: 27935 - protein, 240 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 27936 - protein, 240 aa, Artificial Sequence; identical to SEQ ID NO: 27935
  Synthetic sequence.

SEQ ID NO: 27937 - protein, 240 aa, Artificial Sequence; identical to SEQ ID NO: 27935
  Synthetic sequence.

SEQ ID NO: 27938 - protein, 240 aa, Artificial Sequence; identical to SEQ ID NO: 27935
  Synthetic sequence.

SEQ ID NO: 27939 - protein, 248 aa, Artificial Sequence
  Synthetic sequence.
DEEERVKKLLTDLRRLLRKLHEESKKLLDELRKKLRELRRRSEEKLREVERRLREAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDENLKMVERLIRELEKVLDDHERKVRRLIEELLEVLDRDAK

SEQ ID NO: 27940 - protein, 248 aa, Artificial Sequence; identical to SEQ ID NO: 27939
  Synthetic sequence.

SEQ ID NO: 27941 - protein, 248 aa, Artificial Sequence; identical to SEQ ID NO: 27939
  Synthetic sequence.

SEQ ID NO: 27942 - protein, 248 aa, Artificial Sequence; identical to SEQ ID NO: 27939
  Synthetic sequence.

SEQ ID NO: 27943 - protein, 248 aa, Artificial Sequence
  Synthetic sequence.
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 27944 - protein, 248 aa, Artificial Sequence; identical to SEQ ID NO: 27943
  Synthetic sequence.

SEQ ID NO: 27945 - protein, 248 aa, Artificial Sequence; identical to SEQ ID NO: 27943
  Synthetic sequence.

SEQ ID NO: 27946 - protein, 248 aa, Artificial Sequence; identical to SEQ ID NO: 27943
  Synthetic sequence.

SEQ ID NO: 27947 - protein, 251 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDTEKKLRDLREKHAEIAKELERLLRENRRRLEELAREAKKVLDELRKRLEDERR

SEQ ID NO: 27948 - protein, 251 aa, Artificial Sequence; identical to SEQ ID NO: 27947
  Synthetic sequence.

SEQ ID NO: 27949 - protein, 251 aa, Artificial Sequence; identical to SEQ ID NO: 27947
  Synthetic sequence.

SEQ ID NO: 27950 - protein, 251 aa, Artificial Sequence; identical to SEQ ID NO: 27947
  Synthetic sequence.

SEQ ID NO: 27951 - protein, 242 aa, Artificial Sequence
  Synthetic sequence.
SEKEKLLKESEEEVRRLRRTLEELLRKYREVLERLRKELREIEERVRDVVRRLKEVLDRKGLDIDTIIKEVEDLLKTVLDRLRELLDKIRRLTKEAIEVVREIIERIVRHAERVKDELRKEGGDKEKLDRVDRLIKENTRHLKEILDRIEDLVRRSEKKLRDIIREVRRLIEELRKKAEEIKKGPDERLVKTLIEDVEAVIKRILELITRVAEDNERVLERIIRELTDNLERHLKIVREIVK

SEQ ID NO: 27952 - protein, 242 aa, Artificial Sequence; identical to SEQ ID NO: 27951
  Synthetic sequence.

SEQ ID NO: 27953 - protein, 242 aa, Artificial Sequence; identical to SEQ ID NO: 27951
  Synthetic sequence.

SEQ ID NO: 27954 - protein, 242 aa, Artificial Sequence; identical to SEQ ID NO: 27951
  Synthetic sequence.

SEQ ID NO: 27955 - protein, 244 aa, Artificial Sequence
  Synthetic sequence.
SELERAEELIKKLLKLHEDVLRRLTEVDDELLEIHDRVLKRLKEVDDELLKLIRDMLRRGNISEDLVREVEERLKTLEKRSRDKKAENEKALRELKKKSEKLRRESRKLLEELRKKVEELRGVDKKDVEKLIKEIVEVHRAMLEKWLRLNEEIAKVHEDSVRDWLKANEEIARTIEEILRRVLRGDEEAKDIREKLERLLRKSEELVRKSLKELKELLDKSKKLLEDSKRRLEEILKEIKDDSR

SEQ ID NO: 27956 - protein, 244 aa, Artificial Sequence; identical to SEQ ID NO: 27955
  Synthetic sequence.

SEQ ID NO: 27957 - protein, 244 aa, Artificial Sequence; identical to SEQ ID NO: 27955
  Synthetic sequence.

SEQ ID NO: 27958 - protein, 244 aa, Artificial Sequence; identical to SEQ ID NO: 27955
  Synthetic sequence.

SEQ ID NO: 27959 - protein, 244 aa, Artificial Sequence
  Synthetic sequence.
SLKEIVKEIIDRASELLKRLLERSEDSLRTASELLRKILEDSRRSLRTIARLLEELLRTSGPEEELERAARRVKEELERLHKEIRDVIEEIKKTLAKLNEDLREAIERVKRELERLLKELEDSGVPEELLELVKRVVELMAELLDRLLALNEKILRDIMSILDEILDLNREILRLVKEIIELIRRDGPDREIEKEIRRILEELKAKHDEIEKKIRELEREIKRAHEELEDRIRKIERDLDRRTK

SEQ ID NO: 27960 - protein, 244 aa, Artificial Sequence; identical to SEQ ID NO: 27959
  Synthetic sequence.

SEQ ID NO: 27961 - protein, 244 aa, Artificial Sequence; identical to SEQ ID NO: 27959
  Synthetic sequence.

SEQ ID NO: 27962 - protein, 244 aa, Artificial Sequence; identical to SEQ ID NO: 27959
  Synthetic sequence.

SEQ ID NO: 27963 - protein, 242 aa, Artificial Sequence
  Synthetic sequence.
SSEELLKRIVDEDERVLEEWARVLEEIKDLSKAVVDLLDKVLKEIEAIVDEVTRRLERDGTDDKKKIRDLVEEIKDIIRRAREKLRRIVKENEEILEEAKRRLDKIAEDNRRTLEKVRKELEETKSEREVKRILERVLREAEDSHRRAVELLEELLDRSRRTIEEAIRLIKELLDRILELLKRLGLPKDLLETIKKRVEEIRRTLEKIKRDYDKAIEEIRAKLERKLEEYKEVIDDLRRKTK

SEQ ID NO: 27964 - protein, 242 aa, Artificial Sequence; identical to SEQ ID NO: 27963
  Synthetic sequence.

SEQ ID NO: 27965 - protein, 242 aa, Artificial Sequence; identical to SEQ ID NO: 27963
  Synthetic sequence.

SEQ ID NO: 27966 - protein, 242 aa, Artificial Sequence; identical to SEQ ID NO: 27963
  Synthetic sequence.

SEQ ID NO: 27967 - protein, 238 aa, Artificial Sequence; identical to SEQ ID NO: 27127
  Synthetic sequence.

SEQ ID NO: 27968 - protein, 238 aa, Artificial Sequence; identical to SEQ ID NO: 27127
  Synthetic sequence.

SEQ ID NO: 27969 - protein, 238 aa, Artificial Sequence; identical to SEQ ID NO: 27127
  Synthetic sequence.

SEQ ID NO: 27970 - protein, 238 aa, Artificial Sequence; identical to SEQ ID NO: 27127
  Synthetic sequence.

SEQ ID NO: 27971 - protein, 231 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDVARRSEEELRRIIKKLKEVVKEIRKKLK

SEQ ID NO: 27972 - protein, 231 aa, Artificial Sequence; identical to SEQ ID NO: 27971
  Synthetic sequence.

SEQ ID NO: 27973 - protein, 231 aa, Artificial Sequence; identical to SEQ ID NO: 27971
  Synthetic sequence.

SEQ ID NO: 27974 - protein, 231 aa, Artificial Sequence; identical to SEQ ID NO: 27971
  Synthetic sequence.

SEQ ID NO: 27975 - protein, 236 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 27976 - protein, 236 aa, Artificial Sequence; identical to SEQ ID NO: 27975
  Synthetic sequence.

SEQ ID NO: 27977 - protein, 236 aa, Artificial Sequence; identical to SEQ ID NO: 27975
  Synthetic sequence.

SEQ ID NO: 27978 - protein, 236 aa, Artificial Sequence; identical to SEQ ID NO: 27975
  Synthetic sequence.

SEQ ID NO: 27979 - protein, 247 aa, Artificial Sequence
  Synthetic sequence.
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTIERLIEESIRVNEELLEVIERLLDRARK

SEQ ID NO: 27980 - protein, 247 aa, Artificial Sequence; identical to SEQ ID NO: 27979
  Synthetic sequence.

SEQ ID NO: 27981 - protein, 247 aa, Artificial Sequence; identical to SEQ ID NO: 27979
  Synthetic sequence.

SEQ ID NO: 27982 - protein, 247 aa, Artificial Sequence; identical to SEQ ID NO: 27979
  Synthetic sequence.

SEQ ID NO: 27983 - protein, 243 aa, Artificial Sequence
  Synthetic sequence.
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDEDLLTELEKKLRKLKRDSEKVVDDLKKELERIKREVKRLIEENARTLADIKRAVDEARK

SEQ ID NO: 27984 - protein, 243 aa, Artificial Sequence; identical to SEQ ID NO: 27983
  Synthetic sequence.

SEQ ID NO: 27985 - protein, 243 aa, Artificial Sequence; identical to SEQ ID NO: 27983
  Synthetic sequence.

SEQ ID NO: 27986 - protein, 243 aa, Artificial Sequence; identical to SEQ ID NO: 27983
  Synthetic sequence.

SEQ ID NO: 27987 - protein, 239 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERTLKKLLDDSARMAEEVKKTLKELLERSEKVAEDVRK

SEQ ID NO: 27988 - protein, 239 aa, Artificial Sequence; identical to SEQ ID NO: 27987
  Synthetic sequence.

SEQ ID NO: 27989 - protein, 239 aa, Artificial Sequence; identical to SEQ ID NO: 27987
  Synthetic sequence.

SEQ ID NO: 27990 - protein, 239 aa, Artificial Sequence; identical to SEQ ID NO: 27987
  Synthetic sequence.

SEQ ID NO: 27991 - protein, 241 aa, Artificial Sequence
  Synthetic sequence.
KKEEDLRREVEEVKEEIRELIERSRESVRRILKEIKDLIRKSKESIDKILEDLKRKNLDETLIRAVEKLLRENLELLKKLLETVKELLERNEELLKRLVEEAERILEELLEVARRSGDEKALERVVREVEKELKRLDDELKKALKDSEEELKRLEDELRRAKEENEKTLKKLRDDLRREGRDEEVLRVVEELLKLLKEHLEENVRILRRILELLRRHHDTNRKIVKRILELLRRVLESIRK

SEQ ID NO: 27992 - protein, 241 aa, Artificial Sequence; identical to SEQ ID NO: 27991
  Synthetic sequence.

SEQ ID NO: 27993 - protein, 241 aa, Artificial Sequence; identical to SEQ ID NO: 27991
  Synthetic sequence.

SEQ ID NO: 27994 - protein, 241 aa, Artificial Sequence; identical to SEQ ID NO: 27991
  Synthetic sequence.

SEQ ID NO: 27995 - protein, 241 aa, Artificial Sequence
  Synthetic sequence.
SKKELLEEVVRRAIELLKRHLEKLKRILEEIVRLLEEHLEKVERVLEAILSLLDDLLRRGGDERAIRTLEDVKRRLREILERLADENAKAIKRLADLLDKLEKRNKEAIERLEEILEELKRVRRDEELLRVLETLLKIIEDILRENTKVLEDLLRLVEEILEANLRVVEELLRLAREILTEIVGDEDKLKEIEDELRRLLEELRRLDKAIKDRLRELKKDLDEANRRIKETLKKLLREVEK

SEQ ID NO: 27996 - protein, 241 aa, Artificial Sequence; identical to SEQ ID NO: 27995
  Synthetic sequence.

SEQ ID NO: 27997 - protein, 241 aa, Artificial Sequence; identical to SEQ ID NO: 27995
  Synthetic sequence.

SEQ ID NO: 27998 - protein, 241 aa, Artificial Sequence; identical to SEQ ID NO: 27995
  Synthetic sequence.

SEQ ID NO: 27999 - protein, 238 aa, Artificial Sequence
  Synthetic sequence.
SDLEELEALIRRLLKINEDLIRIIEDLIRKSLTLLKRIVDLIRELIREIEEIIRRTGIPKELVDEAREKIKRILDEVERLLRELAKAHREILEELRANLERVRRELKKILDRLRDLKRGSGSEEEIRKLIEELLKVHKESLDSIRRLIEKLLRVHETALRRLAELIRRLLEVLKEVLDKGPVSEEIRKRVRDLEEKVKKLLRDLEEESRRVAEKVEEDLKRVEEESRRTAREVEEKER

SEQ ID NO: 28000 - protein, 238 aa, Artificial Sequence; identical to SEQ ID NO: 27999
  Synthetic sequence.

SEQ ID NO: 28001 - protein, 238 aa, Artificial Sequence; identical to SEQ ID NO: 27999
  Synthetic sequence.

SEQ ID NO: 28002 - protein, 238 aa, Artificial Sequence; identical to SEQ ID NO: 27999
  Synthetic sequence.

SEQ ID NO: 28003 - protein, 234 aa, Artificial Sequence
  Synthetic sequence.
SERDVLRELLERIKKLLETLIRIVEELVRRSEETIKRLAELNRRLIEEIRRIVEEVKKGVSEEALRDVERLLKELADETEKILREVKKRLDDNLKRLEEIVRDVERLLKELKEEVDRGDKSKEELVREILKVAEEILRKIEELVKHHLDLNRDILRLFTESAEKLEEILREVLRKLGLDEEVKKRVEELRREYRETLKRLRDESEKIAEELKRLLDELRRRLEELARELRERTK

SEQ ID NO: 28004 - protein, 234 aa, Artificial Sequence; identical to SEQ ID NO: 28003
  Synthetic sequence.

SEQ ID NO: 28005 - protein, 234 aa, Artificial Sequence; identical to SEQ ID NO: 28003
  Synthetic sequence.

SEQ ID NO: 28006 - protein, 234 aa, Artificial Sequence; identical to SEQ ID NO: 28003
  Synthetic sequence.

SEQ ID NO: 28007 - protein, 241 aa, Artificial Sequence
  Synthetic sequence.
SKEELVKEIDELNKRVNDLLEELLRKSEKLHKEILELLERLLREIISLLRRILEIVERRLEDETLKRVLEKLEETLRRLKKKVDEELKRLEDENRRLKEEMDRLLRKSAEELERLREKVVRDGGSGDEVLARLLELHTEDLKHAREVLDEVLRLNKKALDLIRAILTEVLKLIKELLKLIEAGADEDELRRLLEDIERKIEALLRELKKESEEIRKRIRELLEDNRDKSRKIKKAIEELKK

SEQ ID NO: 28008 - protein, 241 aa, Artificial Sequence; identical to SEQ ID NO: 28007
  Synthetic sequence.

SEQ ID NO: 28009 - protein, 241 aa, Artificial Sequence; identical to SEQ ID NO: 28007
  Synthetic sequence.

SEQ ID NO: 28010 - protein, 241 aa, Artificial Sequence; identical to SEQ ID NO: 28007
  Synthetic sequence.

SEQ ID NO: 28011 - protein, 246 aa, Artificial Sequence
  Synthetic sequence.
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVEELEKALEEIKRRLKEVIDRYEDELRKLRKEYKEKIDKYERKLEEIERRERT

SEQ ID NO: 28012 - protein, 246 aa, Artificial Sequence; identical to SEQ ID NO: 28011
  Synthetic sequence.

SEQ ID NO: 28013 - protein, 246 aa, Artificial Sequence; identical to SEQ ID NO: 28011
  Synthetic sequence.

SEQ ID NO: 28014 - protein, 246 aa, Artificial Sequence; identical to SEQ ID NO: 28011
  Synthetic sequence.

SEQ ID NO: 28015 - protein, 231 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 28016 - protein, 231 aa, Artificial Sequence; identical to SEQ ID NO: 28015
  Synthetic sequence.

SEQ ID NO: 28017 - protein, 231 aa, Artificial Sequence; identical to SEQ ID NO: 28015
  Synthetic sequence.

SEQ ID NO: 28018 - protein, 231 aa, Artificial Sequence; identical to SEQ ID NO: 28015
  Synthetic sequence.

SEQ ID NO: 28019 - protein, 245 aa, Artificial Sequence
  Synthetic sequence.
DEDELIRKLLEDLKDIVRKILELIERDLRDIERVVRRIVKVIRDDLKKIKEVVDDIARGVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRIRKLIEDLERHTAKVLEDVKRAITELRKNSKDILEEVRKLIDELRKRIKEVED

SEQ ID NO: 28020 - protein, 245 aa, Artificial Sequence; identical to SEQ ID NO: 28019
  Synthetic sequence.

SEQ ID NO: 28021 - protein, 245 aa, Artificial Sequence; identical to SEQ ID NO: 28019
  Synthetic sequence.

SEQ ID NO: 28022 - protein, 245 aa, Artificial Sequence; identical to SEQ ID NO: 28019
  Synthetic sequence.

SEQ ID NO: 28023 - protein, 247 aa, Artificial Sequence
  Synthetic sequence.
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 28024 - protein, 247 aa, Artificial Sequence; identical to SEQ ID NO: 28023
  Synthetic sequence.

SEQ ID NO: 28025 - protein, 247 aa, Artificial Sequence; identical to SEQ ID NO: 28023
  Synthetic sequence.

SEQ ID NO: 28026 - protein, 247 aa, Artificial Sequence; identical to SEQ ID NO: 28023
  Synthetic sequence.

SEQ ID NO: 28027 - protein, 231 aa, Artificial Sequence
  Synthetic sequence.
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 28028 - protein, 231 aa, Artificial Sequence; identical to SEQ ID NO: 28027
  Synthetic sequence.

SEQ ID NO: 28029 - protein, 231 aa, Artificial Sequence; identical to SEQ ID NO: 28027
  Synthetic sequence.

SEQ ID NO: 28030 - protein, 231 aa, Artificial Sequence; identical to SEQ ID NO: 28027
  Synthetic sequence.

SEQ ID NO: 28031 - protein, 235 aa, Artificial Sequence
  Synthetic sequence.
SAAETVKRLAEESSERIRKIVEDDKRVADDSSRKIKELIEEIKRRVKELLDRIKGLGSTEDLEKLLDELLKEVKRLLEELLDAHAKWSDDSRRLLEAVLRTHKELIDRLIKLLRDGGKPEEAVRRLEKVLRESLRRVKEVIKELIDLNKETLDRLKKIVEDLERVLREVLTELRRGSDSKEAVIRLIEELVKLLEDVLRRLLEVNETLVELNKRVWDRLVRINEELAEVALRVAT

SEQ ID NO: 28032 - protein, 235 aa, Artificial Sequence; identical to SEQ ID NO: 28031
  Synthetic sequence.

SEQ ID NO: 28033 - protein, 235 aa, Artificial Sequence; identical to SEQ ID NO: 28031
  Synthetic sequence.

SEQ ID NO: 28034 - protein, 235 aa, Artificial Sequence; identical to SEQ ID NO: 28031
  Synthetic sequence.

SEQ ID NO: 28035 - protein, 235 aa, Artificial Sequence
  Synthetic sequence.
SALETVKKLLEDSSEKIERIVEEDERVAKESSDRIRRLVEEDKRVADEILDLIEKIGDTDTLLKLVEEWSRTSKKLLDDVLKLHKDWSDDSRRLLEEILRVHEELIRRVKEILDREGKPEEVVRELEKVLKESLDTLEEIIRRLDEANAATVKRVADVIRELEDINRKVLEEIKRGSDDAEAVIKVIEKLIRANKRVWDALLKINEDLVRVNKTVWKELLRVNEKLARDLERVVK

SEQ ID NO: 28036 - protein, 235 aa, Artificial Sequence; identical to SEQ ID NO: 28035
  Synthetic sequence.

SEQ ID NO: 28037 - protein, 235 aa, Artificial Sequence; identical to SEQ ID NO: 28035
  Synthetic sequence.

SEQ ID NO: 28038 - protein, 235 aa, Artificial Sequence; identical to SEQ ID NO: 28035
  Synthetic sequence.

SEQ ID NO: 28039 - protein, 242 aa, Artificial Sequence
  Synthetic sequence.
DEIETVLKRLAELIKESLDLLRETLDELRKIIEESKKSLEDVLRRLKELIDRLRRLAKEGGSEELLRLLIEVIERLLKVVEDLLRESNRVVERLIRVNREALRLSNRVVADLLKVLKDAGPDSEELRKLAEDVLRENAELSRESVKIAEKMLEENRDLTRRLKELAKKVLEEIRDLVRGVRDADELLRRVEEILKRLLELIRRIIEEHRKILERLLETHEDLIRKHEEILRRLLKAADEERQ

SEQ ID NO: 28040 - protein, 242 aa, Artificial Sequence; identical to SEQ ID NO: 28039
  Synthetic sequence.

SEQ ID NO: 28041 - protein, 242 aa, Artificial Sequence; identical to SEQ ID NO: 28039
  Synthetic sequence.

SEQ ID NO: 28042 - protein, 242 aa, Artificial Sequence; identical to SEQ ID NO: 28039
  Synthetic sequence.

SEQ ID NO: 28043 - protein, 233 aa, Artificial Sequence
  Synthetic sequence.
SKEEKLKDDVRAVLEDLDRVLKELEKLSEDNLRELKRVLDRITDLHRRILDELRKGIGSEELLRRVEKVLKDNLDLLRKLVEEHKESSERDLKRVEDLVREIKEVLRKLLELEDRGTDIRKIEEEIERLLRKIRKAVEESKDLNRRNSERIEEVARRSEELARRLLKEIRERGDSKAAEDILRVLEKLVKVSREAIKLILELSEHHVRVSTRIARLLLDVARKLAEVIKEAER

SEQ ID NO: 28044 - protein, 233 aa, Artificial Sequence; identical to SEQ ID NO: 28043
  Synthetic sequence.

SEQ ID NO: 28045 - protein, 233 aa, Artificial Sequence; identical to SEQ ID NO: 28043
  Synthetic sequence.

SEQ ID NO: 28046 - protein, 233 aa, Artificial Sequence; identical to SEQ ID NO: 28043
  Synthetic sequence.

SEQ ID NO: 28047 - protein, 238 aa, Artificial Sequence
  Synthetic sequence.
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKRIKEASDKVREDVDRLIKELKEAAD

SEQ ID NO: 28048 - protein, 238 aa, Artificial Sequence; identical to SEQ ID NO: 28047
  Synthetic sequence.

SEQ ID NO: 28049 - protein, 238 aa, Artificial Sequence; identical to SEQ ID NO: 28047
  Synthetic sequence.

SEQ ID NO: 28050 - protein, 238 aa, Artificial Sequence; identical to SEQ ID NO: 28047
  Synthetic sequence.

SEQ ID NO: 28051 - protein, 246 aa, Artificial Sequence
  Synthetic sequence.
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELVELLEEILERNTRVIKEIIDLLRTVIRIHEKIVEDLIKLLEELLRRLEEATR

SEQ ID NO: 28052 - protein, 246 aa, Artificial Sequence; identical to SEQ ID NO: 28051
  Synthetic sequence.

SEQ ID NO: 28053 - protein, 246 aa, Artificial Sequence; identical to SEQ ID NO: 28051
  Synthetic sequence.

SEQ ID NO: 28054 - protein, 246 aa, Artificial Sequence; identical to SEQ ID NO: 28051
  Synthetic sequence.

SEQ ID NO: 28055 - protein, 237 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 28056 - protein, 237 aa, Artificial Sequence; identical to SEQ ID NO: 28055
  Synthetic sequence.

SEQ ID NO: 28057 - protein, 237 aa, Artificial Sequence; identical to SEQ ID NO: 28055
  Synthetic sequence.

SEQ ID NO: 28058 - protein, 237 aa, Artificial Sequence; identical to SEQ ID NO: 28055
  Synthetic sequence.

SEQ ID NO: 28059 - protein, 229 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 28060 - protein, 229 aa, Artificial Sequence; identical to SEQ ID NO: 28059
  Synthetic sequence.

SEQ ID NO: 28061 - protein, 229 aa, Artificial Sequence; identical to SEQ ID NO: 28059
  Synthetic sequence.

SEQ ID NO: 28062 - protein, 229 aa, Artificial Sequence; identical to SEQ ID NO: 28059
  Synthetic sequence.

SEQ ID NO: 28063 - protein, 241 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 28064 - protein, 241 aa, Artificial Sequence; identical to SEQ ID NO: 28063
  Synthetic sequence.

SEQ ID NO: 28065 - protein, 241 aa, Artificial Sequence; identical to SEQ ID NO: 28063
  Synthetic sequence.

SEQ ID NO: 28066 - protein, 241 aa, Artificial Sequence; identical to SEQ ID NO: 28063
  Synthetic sequence.

SEQ ID NO: 28067 - protein, 248 aa, Artificial Sequence
  Synthetic sequence.
SEDELLEKIVRKLAEAVKRIEEELRKSKREIERLVKEIKEKLEDSLARVKETLDRIRETRKGPSDEEVLERLVRTLEELLARHLKLIEDIARELKKLLKEHLDRIETIVRDLKRLLKEILDELERTGLPREALEAVRELVKTVARLLDEVLKNNKKLLDDLKKELDDVLANNKRIVDELARLLERVRRGKEDLEELLRLLKEVIERSIESLERLLELILRVLEYSVASLEELLRRLLEVIKRIVDTTK

SEQ ID NO: 28068 - protein, 248 aa, Artificial Sequence; identical to SEQ ID NO: 28067
  Synthetic sequence.

SEQ ID NO: 28069 - protein, 248 aa, Artificial Sequence; identical to SEQ ID NO: 28067
  Synthetic sequence.

SEQ ID NO: 28070 - protein, 248 aa, Artificial Sequence; identical to SEQ ID NO: 28067
  Synthetic sequence.

SEQ ID NO: 28071 - protein, 237 aa, Artificial Sequence
  Synthetic sequence.
DEDEIAEELKRLLREVEEASKEIVRRMRELAREANKASEDILRTLEKLLEELRRRVEESGGSSKAVLDKIREVLETLKELLDRHHETVRDLVRRLKELLDRHNETVAKLVEDIKALLDKSGGREEIKKRLEDALREHNRIIAEIKKLLDKVLKDHKDILDDIKKKLDDVLREVTEILKRGRIDEVVRRIERVIREVIKILARANKRLHDVVEEIIRLLEEVTDELRRVVEEVIRRTK

SEQ ID NO: 28072 - protein, 237 aa, Artificial Sequence; identical to SEQ ID NO: 28071
  Synthetic sequence.

SEQ ID NO: 28073 - protein, 237 aa, Artificial Sequence; identical to SEQ ID NO: 28071
  Synthetic sequence.

SEQ ID NO: 28074 - protein, 237 aa, Artificial Sequence; identical to SEQ ID NO: 28071
  Synthetic sequence.

SEQ ID NO: 28075 - protein, 246 aa, Artificial Sequence
  Synthetic sequence.
DAEEKAKKIEDVARRYAEEVKRVLDDLERLLRESEEEVERIVRKLEKLARDLEERVREGTKSEAVERLVRELLKAIKELIDVLRDVVRLSAEVIKELLDVLRELVELNLRAIKEIIEVLSKGKSEEVKKALDEILEKIEKVNTDVNRRLAEIIRKLREIHEEVLRELDKILRDIESVVRDVERGIDDKEVIDALKELLKVLEDLLREIKEALTRNLEKIDELLKLLHELSRRVIEELRKLLEDLKR

SEQ ID NO: 28076 - protein, 246 aa, Artificial Sequence; identical to SEQ ID NO: 28075
  Synthetic sequence.

SEQ ID NO: 28077 - protein, 246 aa, Artificial Sequence; identical to SEQ ID NO: 28075
  Synthetic sequence.

SEQ ID NO: 28078 - protein, 246 aa, Artificial Sequence; identical to SEQ ID NO: 28075
  Synthetic sequence.

SEQ ID NO: 28079 - protein, 240 aa, Artificial Sequence
  Synthetic sequence.
DEEELLREIKTILDESLKALEELIRKIMRILDKSLKDLEEIVREIKKTIDELLEKVRRSGLPEEVLKKVASVAEKVKEDIDRLLEDVERSHREVKKKLDELLKEVKRSHEEVKKELDSLRGDSDRDTVAREILRVLKKNLDVLAEVVEKIVKVLEDNLKSLKAVLETLVDLLRKLIKVLREGGLSEEALDDLRRLVKELADKLRKLLKDYKDLLKELKDEAKKLLDDYARLIEELEKKAR

SEQ ID NO: 28080 - protein, 240 aa, Artificial Sequence; identical to SEQ ID NO: 28079
  Synthetic sequence.

SEQ ID NO: 28081 - protein, 240 aa, Artificial Sequence; identical to SEQ ID NO: 28079
  Synthetic sequence.

SEQ ID NO: 28082 - protein, 240 aa, Artificial Sequence; identical to SEQ ID NO: 28079
  Synthetic sequence.

SEQ ID NO: 28083 - protein, 237 aa, Artificial Sequence
  Synthetic sequence.
SREELLDRILEAIAKILEDLKRLIDENLARLEEVVRELERIIDRNLKLIREILDELKKGSGSEEILEKIKKVDKELEDLIRRLLKKLEDLIRETERRLREILKRIRDLLKEVKDRDKDLERLLEVLEEVLRVIAELAKELLDSLRKVLKVVEEVLRLLNEVNKEVLDVIRELAKDGGSDEIIRKLDELLKEVEKVHKEVKDRIRKLLEDHKRSLDEVKKKLERLLERAKEVVEREKK

SEQ ID NO: 28084 - protein, 237 aa, Artificial Sequence; identical to SEQ ID NO: 28083
  Synthetic sequence.

SEQ ID NO: 28085 - protein, 237 aa, Artificial Sequence; identical to SEQ ID NO: 28083
  Synthetic sequence.

SEQ ID NO: 28086 - protein, 237 aa, Artificial Sequence; identical to SEQ ID NO: 28083
  Synthetic sequence.

SEQ ID NO: 28087 - protein, 246 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETVRELIERLKRVLEEAIEVVERVAR

SEQ ID NO: 28088 - protein, 246 aa, Artificial Sequence; identical to SEQ ID NO: 28087
  Synthetic sequence.

SEQ ID NO: 28089 - protein, 246 aa, Artificial Sequence; identical to SEQ ID NO: 28087
  Synthetic sequence.

SEQ ID NO: 28090 - protein, 246 aa, Artificial Sequence; identical to SEQ ID NO: 28087
  Synthetic sequence.

SEQ ID NO: 28091 - protein, 240 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 28092 - protein, 240 aa, Artificial Sequence; identical to SEQ ID NO: 28091
  Synthetic sequence.

SEQ ID NO: 28093 - protein, 240 aa, Artificial Sequence; identical to SEQ ID NO: 28091
  Synthetic sequence.

SEQ ID NO: 28094 - protein, 240 aa, Artificial Sequence; identical to SEQ ID NO: 28091
  Synthetic sequence.

SEQ ID NO: 28095 - protein, 252 aa, Artificial Sequence
  Synthetic sequence.
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLREVVRKVLEEAKRLLDELEEVHKRVKKELEDIIEENRRVVKRVRDELREIKRELDE

SEQ ID NO: 28096 - protein, 252 aa, Artificial Sequence; identical to SEQ ID NO: 28095
  Synthetic sequence.

SEQ ID NO: 28097 - protein, 252 aa, Artificial Sequence; identical to SEQ ID NO: 28095
  Synthetic sequence.

SEQ ID NO: 28098 - protein, 252 aa, Artificial Sequence; identical to SEQ ID NO: 28095
  Synthetic sequence.

SEQ ID NO: 28099 - protein, 241 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKELEKLKRELERLLEESRRKLEKLKRDLERVLEETRR

SEQ ID NO: 28100 - protein, 241 aa, Artificial Sequence; identical to SEQ ID NO: 28099
  Synthetic sequence.

SEQ ID NO: 28101 - protein, 241 aa, Artificial Sequence; identical to SEQ ID NO: 28099
  Synthetic sequence.

SEQ ID NO: 28102 - protein, 241 aa, Artificial Sequence; identical to SEQ ID NO: 28099
  Synthetic sequence.

SEQ ID NO: 28103 - protein, 237 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 28104 - protein, 237 aa, Artificial Sequence; identical to SEQ ID NO: 28103
  Synthetic sequence.

SEQ ID NO: 28105 - protein, 237 aa, Artificial Sequence; identical to SEQ ID NO: 28103
  Synthetic sequence.

SEQ ID NO: 28106 - protein, 237 aa, Artificial Sequence; identical to SEQ ID NO: 28103
  Synthetic sequence.

SEQ ID NO: 28107 - protein, 237 aa, Artificial Sequence
  Synthetic sequence.
SREDLLRSLAELIETILRKSSELLDRLLKLVREHSETSERLIRELKKILEDILKLIKGGISEDDVRRIVKEAKDELRRSVEEVKKSVDDLKEELKRSLREVRELVKSIADALEEIVRRSSGLGEVIKKLLELLRRLLEVHERTIRLLAELLERHLEVHEESIRLLLRLLEELLELVERKGDEKELRRIAEAVERVLRDHKAKNDKILRDVEEVLRRHLEELARILKDVKKVLDEARK

SEQ ID NO: 28108 - protein, 237 aa, Artificial Sequence; identical to SEQ ID NO: 28107
  Synthetic sequence.

SEQ ID NO: 28109 - protein, 237 aa, Artificial Sequence; identical to SEQ ID NO: 28107
  Synthetic sequence.

SEQ ID NO: 28110 - protein, 237 aa, Artificial Sequence; identical to SEQ ID NO: 28107
  Synthetic sequence.

SEQ ID NO: 28111 - protein, 239 aa, Artificial Sequence
  Synthetic sequence.
SEEDEVLKTLDRKHKEAKKELDKVLRELEEEHKKVKRELDEVLKRLEDIHRRITELLRRGGISLEDVLRMVKEANRELVEVIKRIVKTVEDLNARAVEVVKRLAEELERLNAEMVKVLRKSGRSEEIEKDLRRSSADIRRLVEEIERRLRDSLRKLRKLADDLAKKLKESLDKLEELVRRGVDEEAVERVLKENKELIEEIVRLIRKILDENIELIRRIVRLLERLLRENLRLIEEARK

SEQ ID NO: 28112 - protein, 239 aa, Artificial Sequence; identical to SEQ ID NO: 28111
  Synthetic sequence.

SEQ ID NO: 28113 - protein, 239 aa, Artificial Sequence; identical to SEQ ID NO: 28111
  Synthetic sequence.

SEQ ID NO: 28114 - protein, 239 aa, Artificial Sequence; identical to SEQ ID NO: 28111
  Synthetic sequence.

SEQ ID NO: 28115 - protein, 248 aa, Artificial Sequence
  Synthetic sequence.
SKEEDVRRLIEELVRELRRILEENRRMLKELVEKLEEVLRRSEEVWRRLAKELDELLKEGNSDAVREAVETIRRVLEDLVELDRRVVKVIKEVLERHAKSSTELVRELEDVLRAAVEAIEKGKSEEDLKRELRKLKERLKSVLKRHDDTNKELFRELEDVLRKHEEELRRLADELRRLLEDLKRSGDIPEEVIKKIEDLVRKTERELREVHKELRRLVEEAKEVVDRSVEILRDLVRKIVRILEESAR

SEQ ID NO: 28116 - protein, 248 aa, Artificial Sequence; identical to SEQ ID NO: 28115
  Synthetic sequence.

SEQ ID NO: 28117 - protein, 248 aa, Artificial Sequence; identical to SEQ ID NO: 28115
  Synthetic sequence.

SEQ ID NO: 28118 - protein, 248 aa, Artificial Sequence; identical to SEQ ID NO: 28115
  Synthetic sequence.

SEQ ID NO: 28119 - protein, 233 aa, Artificial Sequence
  Synthetic sequence.
SEKEAIKEVAELLKALIDDLLRLLKEDVDTARRVLDEIKKLLEENESIAREVLRRLREGKGAERAEELVREWIERTREILKRIEELLRRWTRKTREILKRIEELVRRVIEVVRRGGVPKELVDKLEEVLRKLLKLVEDHVRKVEKIISELLKLIKEHVEKVERIARKLLELLRRGGDETDLDRIVKEMEKVLEDSIRELEKLVKRLEDILRESEKALRDLLSELAKVLEEVRT

SEQ ID NO: 28120 - protein, 233 aa, Artificial Sequence; identical to SEQ ID NO: 28119
  Synthetic sequence.

SEQ ID NO: 28121 - protein, 233 aa, Artificial Sequence; identical to SEQ ID NO: 28119
  Synthetic sequence.

SEQ ID NO: 28122 - protein, 233 aa, Artificial Sequence; identical to SEQ ID NO: 28119
  Synthetic sequence.

SEQ ID NO: 28123 - protein, 237 aa, Artificial Sequence
  Synthetic sequence.
SREELLKELRKLVEEIKRRSEELLRRLEKLLEDNERRTRELLERLKELLREIEERIRGGGPSEEVIRLLEELVRAIERVLEEHLESNRRLVEAAESVLREHVELVKSLVRAIEDVVEKGLSEDKIRTIKKLLDEWARRLEKLVRDVRRKLEEWIKRTEEMIDEVARLLEELKETIRRKGGDEDTVRELTELVRRLLKRVEELLKRSLEILRELIKAIADAIKESLDILDRLLREVAR

SEQ ID NO: 28124 - protein, 237 aa, Artificial Sequence; identical to SEQ ID NO: 28123
  Synthetic sequence.

SEQ ID NO: 28125 - protein, 237 aa, Artificial Sequence; identical to SEQ ID NO: 28123
  Synthetic sequence.

SEQ ID NO: 28126 - protein, 237 aa, Artificial Sequence; identical to SEQ ID NO: 28123
  Synthetic sequence.

SEQ ID NO: 28127 - protein, 243 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 28128 - protein, 243 aa, Artificial Sequence; identical to SEQ ID NO: 28127
  Synthetic sequence.

SEQ ID NO: 28129 - protein, 243 aa, Artificial Sequence; identical to SEQ ID NO: 28127
  Synthetic sequence.

SEQ ID NO: 28130 - protein, 243 aa, Artificial Sequence; identical to SEQ ID NO: 28127
  Synthetic sequence.

SEQ ID NO: 28131 - protein, 245 aa, Artificial Sequence
  Synthetic sequence.
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 28132 - protein, 245 aa, Artificial Sequence; identical to SEQ ID NO: 28131
  Synthetic sequence.

SEQ ID NO: 28133 - protein, 245 aa, Artificial Sequence; identical to SEQ ID NO: 28131
  Synthetic sequence.

SEQ ID NO: 28134 - protein, 245 aa, Artificial Sequence; identical to SEQ ID NO: 28131
  Synthetic sequence.

SEQ ID NO: 28135 - protein, 239 aa, Artificial Sequence
  Synthetic sequence.
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLVELVRRHNKVLKELVEELEKLVRDHNRVVEEVVRELVELLSRAVEVIKEVVK

SEQ ID NO: 28136 - protein, 239 aa, Artificial Sequence; identical to SEQ ID NO: 28135
  Synthetic sequence.

SEQ ID NO: 28137 - protein, 239 aa, Artificial Sequence; identical to SEQ ID NO: 28135
  Synthetic sequence.

SEQ ID NO: 28138 - protein, 239 aa, Artificial Sequence; identical to SEQ ID NO: 28135
  Synthetic sequence.

SEQ ID NO: 28139 - protein, 232 aa, Artificial Sequence
  Synthetic sequence.
SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDDLLKTSRDLVKRVLDLVDEVVKRVEDLVERVKEKIDT

SEQ ID NO: 28140 - protein, 232 aa, Artificial Sequence; identical to SEQ ID NO: 28139
  Synthetic sequence.

SEQ ID NO: 28141 - protein, 232 aa, Artificial Sequence; identical to SEQ ID NO: 28139
  Synthetic sequence.

SEQ ID NO: 28142 - protein, 232 aa, Artificial Sequence; identical to SEQ ID NO: 28139
  Synthetic sequence.

SEQ ID NO: 28143 - protein, 247 aa, Artificial Sequence
  Synthetic sequence.
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTEEDVERAVKEIRDRLRKLLEDYERAVRRLEDKLRRVRERYEAVLKRIKDKLEETKR

SEQ ID NO: 28144 - protein, 247 aa, Artificial Sequence; identical to SEQ ID NO: 28143
  Synthetic sequence.

SEQ ID NO: 28145 - protein, 247 aa, Artificial Sequence; identical to SEQ ID NO: 28143
  Synthetic sequence.

SEQ ID NO: 28146 - protein, 247 aa, Artificial Sequence; identical to SEQ ID NO: 28143
  Synthetic sequence.

SEQ ID NO: 28147 - protein, 243 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 28148 - protein, 243 aa, Artificial Sequence; identical to SEQ ID NO: 28147
  Synthetic sequence.

SEQ ID NO: 28149 - protein, 243 aa, Artificial Sequence; identical to SEQ ID NO: 28147
  Synthetic sequence.

SEQ ID NO: 28150 - protein, 243 aa, Artificial Sequence; identical to SEQ ID NO: 28147
  Synthetic sequence.

SEQ ID NO: 28151 - protein, 244 aa, Artificial Sequence
  Synthetic sequence.
DEDRRLEDAVAKLRKEHADIMKKLDDIMRELDEDHARIKERLDRILEELKALLTRVLRETREDELLRKVLELLTRLLKLLADVLEENKRLLEDILRLLKELIETNLRLLEEILALLRKVARGPVSEEEAKRLVEEITRLLEASTEEARKLVETIKRLLEESLDKLRSLVEEIERRLRTVLEEIRRRGAPEEIERIIRRVIEVIREILDLVRKVNKKALRVIEEILEDLARVNKKAVDAIDELAK

SEQ ID NO: 28152 - protein, 244 aa, Artificial Sequence; identical to SEQ ID NO: 28151
  Synthetic sequence.

SEQ ID NO: 28153 - protein, 244 aa, Artificial Sequence; identical to SEQ ID NO: 28151
  Synthetic sequence.

SEQ ID NO: 28154 - protein, 244 aa, Artificial Sequence; identical to SEQ ID NO: 28151
  Synthetic sequence.

SEQ ID NO: 28155 - protein, 240 aa, Artificial Sequence
  Synthetic sequence.
DEVEELLKRVRELLKASEELVRKILEDVKRLLERSIEEVEDLLRKVEELLKRLLDLVERGGSLDEILRELVRLLKEIVRKVLELNRKLVEDVIRIAKRLLELNAESVKEWDRILKLLRDGTGDKEELLKDAEEALEKYERAVREILKELEEIIKEYVRRVEELLKELKDAVDKAKDEVRKGSGDEDLIRDVDRVLKEIMDLLRDLVRRTKELLEELLRLLEELVRAHKELVRSILDEIRK

SEQ ID NO: 28156 - protein, 240 aa, Artificial Sequence; identical to SEQ ID NO: 28155
  Synthetic sequence.

SEQ ID NO: 28157 - protein, 240 aa, Artificial Sequence; identical to SEQ ID NO: 28155
  Synthetic sequence.

SEQ ID NO: 28158 - protein, 240 aa, Artificial Sequence; identical to SEQ ID NO: 28155
  Synthetic sequence.

SEQ ID NO: 28159 - protein, 247 aa, Artificial Sequence
  Synthetic sequence.
SEAEELLRELEELLKKSEKVLEDLLRKNAELIKDSKARLDEVRRKVEKLAEEVEEVIRRGVSEEELIRVIKKVLDDLRSIIKELIEVSRKYLRTTLELVKELLDVSRDVLREVLRIIKALLDTGGKDGSEEKIKEIADVADEIRKLAEEDIRLIKKLLEESAKLVDEDVRKLEEIAKEITELVERLRRTGDKDAVRKLIEELKKLLEDLVEHHERLLKEDHERLKALLDHHRELLKTVLTILRETAK

SEQ ID NO: 28160 - protein, 247 aa, Artificial Sequence; identical to SEQ ID NO: 28159
  Synthetic sequence.

SEQ ID NO: 28161 - protein, 247 aa, Artificial Sequence; identical to SEQ ID NO: 28159
  Synthetic sequence.

SEQ ID NO: 28162 - protein, 247 aa, Artificial Sequence; identical to SEQ ID NO: 28159
  Synthetic sequence.

SEQ ID NO: 28163 - protein, 245 aa, Artificial Sequence
  Synthetic sequence.
DEEELLRRVTEELKRLLDEARKLHEDVKRELEKLLKENDDLLADVKRKLESLLEALKRGSGTADEVIERILRLVEELLKRHAETVERILKLVRDLLRLHEKLVKEILDLLTRLLELLERRGGSGNSEKVDALKKLAKSVVDEVERSLEELRRLVEEVIKRIRDSLRASARIVKEAVRELRELLRDGRDADKLLERIRALLETLLEVLKRDNEEIKRILEELLRVAEENLRRIKEIIDRLLDATRR

SEQ ID NO: 28164 - protein, 245 aa, Artificial Sequence; identical to SEQ ID NO: 28163
  Synthetic sequence.

SEQ ID NO: 28165 - protein, 245 aa, Artificial Sequence; identical to SEQ ID NO: 28163
  Synthetic sequence.

SEQ ID NO: 28166 - protein, 245 aa, Artificial Sequence; identical to SEQ ID NO: 28163
  Synthetic sequence.

SEQ ID NO: 28167 - protein, 249 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 28168 - protein, 249 aa, Artificial Sequence; identical to SEQ ID NO: 28167
  Synthetic sequence.

SEQ ID NO: 28169 - protein, 249 aa, Artificial Sequence; identical to SEQ ID NO: 28167
  Synthetic sequence.

SEQ ID NO: 28170 - protein, 249 aa, Artificial Sequence; identical to SEQ ID NO: 28167
  Synthetic sequence.

SEQ ID NO: 28171 - protein, 240 aa, Artificial Sequence
  Synthetic sequence.
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 28172 - protein, 240 aa, Artificial Sequence; identical to SEQ ID NO: 28171
  Synthetic sequence.

SEQ ID NO: 28173 - protein, 240 aa, Artificial Sequence; identical to SEQ ID NO: 28171
  Synthetic sequence.

SEQ ID NO: 28174 - protein, 240 aa, Artificial Sequence; identical to SEQ ID NO: 28171
  Synthetic sequence.

SEQ ID NO: 28175 - protein, 240 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 28176 - protein, 240 aa, Artificial Sequence; identical to SEQ ID NO: 28175
  Synthetic sequence.

SEQ ID NO: 28177 - protein, 240 aa, Artificial Sequence; identical to SEQ ID NO: 28175
  Synthetic sequence.

SEQ ID NO: 28178 - protein, 240 aa, Artificial Sequence; identical to SEQ ID NO: 28175
  Synthetic sequence.

SEQ ID NO: 28179 - protein, 243 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 28180 - protein, 243 aa, Artificial Sequence; identical to SEQ ID NO: 28179
  Synthetic sequence.

SEQ ID NO: 28181 - protein, 243 aa, Artificial Sequence; identical to SEQ ID NO: 28179
  Synthetic sequence.

SEQ ID NO: 28182 - protein, 243 aa, Artificial Sequence; identical to SEQ ID NO: 28179
  Synthetic sequence.

SEQ ID NO: 28183 - protein, 243 aa, Artificial Sequence
  Synthetic sequence.
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 28184 - protein, 243 aa, Artificial Sequence; identical to SEQ ID NO: 28183
  Synthetic sequence.

SEQ ID NO: 28185 - protein, 243 aa, Artificial Sequence; identical to SEQ ID NO: 28183
  Synthetic sequence.

SEQ ID NO: 28186 - protein, 243 aa, Artificial Sequence; identical to SEQ ID NO: 28183
  Synthetic sequence.

SEQ ID NO: 28187 - protein, 239 aa, Artificial Sequence
  Synthetic sequence.
SEVEDILRRLAELNKRLIDKLRELIDRIARLNEELLRVVEDILSRLKRLADELIRVVRERGDIPEELLRKLEEELKKIVDELRRLVEEYEKALRDLIKELRKAVEEYRRTLAELVERLRRLEGPEELLKDLAEDVSRNIKAVEEVIRRFEKNVEDNIEVVRRLVDALEKLVRRLESVLRGKGSDEDLKRLLEKLKEDVERVLKEVRDRTAESLKHLEDVIRELEKKTEDSLRHMEERRK

SEQ ID NO: 28188 - protein, 239 aa, Artificial Sequence; identical to SEQ ID NO: 28187
  Synthetic sequence.

SEQ ID NO: 28189 - protein, 239 aa, Artificial Sequence; identical to SEQ ID NO: 28187
  Synthetic sequence.

SEQ ID NO: 28190 - protein, 239 aa, Artificial Sequence; identical to SEQ ID NO: 28187
  Synthetic sequence.

SEQ ID NO: 28191 - protein, 243 aa, Artificial Sequence
  Synthetic sequence.
DEERIIKTLEDINAKLVEDIKRILDKVAELNERLADAIRKILEETKRILEATTRKVRKDGEISEELLRRLEEKLRKLLEDLERVLAEHEDESRRILEEVERLLKRHADASKELLDRARSVARGVKSDKELVDRLKKLIDDSLESVRELIERLKELLDRLVKSVEDLIRTIKELLDRLVEVLREGVSDKDTLRTVEKLVEDVKRRLDKLLEDYKRLIEEVKKELDKLLKEYEDALREIKKRIDE

SEQ ID NO: 28192 - protein, 243 aa, Artificial Sequence; identical to SEQ ID NO: 28191
  Synthetic sequence.

SEQ ID NO: 28193 - protein, 243 aa, Artificial Sequence; identical to SEQ ID NO: 28191
  Synthetic sequence.

SEQ ID NO: 28194 - protein, 243 aa, Artificial Sequence; identical to SEQ ID NO: 28191
  Synthetic sequence.

SEQ ID NO: 28195 - protein, 232 aa, Artificial Sequence
  Synthetic sequence.
TEEEVVEDVKRVLDESHDDLRRLIETLTRVLRESLKRIKEALEELERVLKKLLDLLEGGRDAREVLDEIRKVLERLREVIEELLRINKEVLRELERVIRELLKKNEDLARRVRSGVKSRLLEVLERLARESLELNRAILEELRKLVEKSLRAVEKILKRLEEIVRKLLKLVEDGGPREEVKRVLEEARDELRRLLEEYKAIIEELERELERLLREHREVIRRIKEEIDKSSK

SEQ ID NO: 28196 - protein, 232 aa, Artificial Sequence; identical to SEQ ID NO: 28195
  Synthetic sequence.

SEQ ID NO: 28197 - protein, 232 aa, Artificial Sequence; identical to SEQ ID NO: 28195
  Synthetic sequence.

SEQ ID NO: 28198 - protein, 232 aa, Artificial Sequence; identical to SEQ ID NO: 28195
  Synthetic sequence.

SEQ ID NO: 28199 - protein, 234 aa, Artificial Sequence; identical to SEQ ID NO: 27805
  Synthetic sequence.

SEQ ID NO: 28200 - protein, 234 aa, Artificial Sequence; identical to SEQ ID NO: 27805
  Synthetic sequence.

SEQ ID NO: 28201 - protein, 234 aa, Artificial Sequence; identical to SEQ ID NO: 27805
  Synthetic sequence.

SEQ ID NO: 28202 - protein, 234 aa, Artificial Sequence; identical to SEQ ID NO: 27805
  Synthetic sequence.

SEQ ID NO: 28203 - protein, 240 aa, Artificial Sequence
  Synthetic sequence.
SLEEIVKKLEDLNKKAVEILRRVLEEHEKLVEKVKKVLRDVLRLLEKVVREVIETLKKGDTDEKTREALKELEEVVRKIKEEVEKVLKRLEEVSKRLKDEVRRVLKESEDVAKKIRRDVRGVRSEDAAKRATDLLKETLTILEEAIRRIVKVIEDSLEILREAVEAIVRLLEELLSILARIGLDEEVLRKLKEIIKELKDRLKKLLDDYERIIDELRAELERVLREYEKILEDLRKELED

SEQ ID NO: 28204 - protein, 240 aa, Artificial Sequence; identical to SEQ ID NO: 28203
  Synthetic sequence.

SEQ ID NO: 28205 - protein, 240 aa, Artificial Sequence; identical to SEQ ID NO: 28203
  Synthetic sequence.

SEQ ID NO: 28206 - protein, 240 aa, Artificial Sequence; identical to SEQ ID NO: 28203
  Synthetic sequence.

SEQ ID NO: 28207 - protein, 241 aa, Artificial Sequence
  Synthetic sequence.
SADEALEELVRRLLEVLKTVLERTKELSRDDLRVVKEVLRIIEELVKRLLKVIRDGLDDADRVLEEVERVIREAKREVKRWEEVVRKVVEDSRRLIERVLAEVEEVIKEAKRLLDERKSGGSREVIEELLSLLREIVRHHKEVSDEHLKLSAELVKRILDVVEETLRLATEIVRRIKEGGNSEDVRRDIERLLEELKRRVERLLEDIERLLAELEKLNEDVLRENKALLEDLERRVRERKK

SEQ ID NO: 28208 - protein, 241 aa, Artificial Sequence; identical to SEQ ID NO: 28207
  Synthetic sequence.

SEQ ID NO: 28209 - protein, 241 aa, Artificial Sequence; identical to SEQ ID NO: 28207
  Synthetic sequence.

SEQ ID NO: 28210 - protein, 241 aa, Artificial Sequence; identical to SEQ ID NO: 28207
  Synthetic sequence.

SEQ ID NO: 28211 - protein, 21 aa, Artificial Sequence
  Synthetic sequence.
MQELDKRAASLQNGDFYALRL

SEQ ID NO: 28212 - protein, 8 aa, Artificial Sequence
  Synthetic sequence.
ILRIGDFY

SEQ ID NO: 28213 - protein, 20 aa, Artificial Sequence
  Synthetic sequence.
EIWIAQELRRIGDEFNAYYA

SEQ ID NO: 28214 - protein, 56 aa, Artificial Sequence
  Synthetic sequence.
DSEELLKRLATESRKIAKKHAKTADDVERKIEKTLRDLRRKIDEAEKQAKKTEDDS

SEQ ID NO: 28215 - protein, 56 aa, Artificial Sequence
  Synthetic sequence.
SSKELKDIATEAAKTLKKIQDDIEREAKKVEEEYEEKLKKSKKHADDVRKRLTDIS

SEQ ID NO: 28216 - protein, 56 aa, Artificial Sequence
  Synthetic sequence.
DKKLLDDVKETLKEIAKTAKRIVEEAEKIARKIAKEAKDLARKSKRHAKEQQKTTS

SEQ ID NO: 28217 - protein, 56 aa, Artificial Sequence
  Synthetic sequence.
DREALKKVKRTLTEIAKTAEKIAQDANRTHKRLADEARKLLEKLKREAKKSQKDIS

SEQ ID NO: 28218 - protein, 56 aa, Artificial Sequence
  Synthetic sequence.
DKELLDTVKKILEDILRTAQKIADDTSRILERILREHEKLQRKLQEDAKKLEKDIS

SEQ ID NO: 28219 - protein, 9 aa, Artificial Sequence
  Synthetic sequence.
LPMSCAQES

SEQ ID NO: 28220 - protein, 8 aa, Artificial Sequence
  Synthetic sequence.
LMSCAQES
